United States Patent 10,233,495 (METHODS AND COMPOSITIONS FOR SCREENING AND TREATING DEVELOPMENTAL DISORDERS) - sequence listing, part 184

SEQ ID NO: 1208 - DNA, 105471 bp, Homo sapiens
tgtaatttcatttagtttattaatatgatccaaacagatttagcttaagagatgaggacaggacataaaacaagatttggctgagctatataaagaaaaccaaaagagtgacaagattttcaattggtgacaatttaaagtcatttattaactaatataaaaataaatctacaatagaaccatgacttaaactgagccagtatgtggtacatgtgtcacccaaagtcagcaaggaaccattcagaacttacaccctcctggactggctcacacggcctgtctttgatctggaacctcatataagtcacctcacagcactgggtttgcagccagctacattttttctcctcagcctatgatcagttattaatacataccatttctatgtttcccatagcctctttcttttcagatagtgacagagctctagaaaaaactcatctggccagtactaaacagggaaggtgaaaaaaagtactttaagatgggtgtggggtcatttggggtaccaacagactcagataaacaagggaaccagagtgggcatcaacaaaaagcattgaggtaaggggcccagtggtaattcacagaaaagaccagaactggacaatattaaagtcaggaagaatggctgttacacttgaaaagtcacactagaagaacaacaaagaagaagaaaactggaatgaacagtagtcccttttatattttttaaaaggaaggaattttttaaagaaatataaaagtcaagtcaaaaagtgaaatagcaacaatgagtatttaaataaaacagaatgtagtaggaaagaaagaattcttttattcccacatgacagcccaattttttaaaatggttatcttaagtcaggccagttttattttattgaccatgtatatataacatcagatatttctaagaaagagaagagaacctgattgatgtctctcatgtaacatggaaaggaaaaaggagggagggaaaatggggaagaaaagtctccacactcttcatgcccaaagtggacacagtctttaacctgtacttcaaatgacaggttcagatcatagaaaacattgtcaagtccaacagaattttgatcacaagctcttggtgctcagcgtgcagctgagtagcagaaggcaaacaagcaagttgatggagaaatctctgtgcagggaagaggaagaagacgtgccacacaccaaaggttctgctttatagggtctttctatatctggaggtaatgctgtcattccttgaatctgaaaatggaagcacaaacaatgcaaatgaacatctgatttaaggcagcacagtgaccaggccgctcagctgcccacacttctgcaggggataaagggggcaggagtggttaccaaaggagtcacacactgggggagtcagaaacctagggttaaggaggaaacagaaaagagggccaggcactcctttggaaaagaatacaaagcaggctctattgctttttgcagcactcattccggcctgttcctgctctatcccaaccttagttttagaactaatttttctcttgaaagggggtagaatgaggagttttcagtcaatccaagtaatcattgaacaaaaattatcagacattagaaggcaactggacccctggatttatggatatttgtcttctccttaggttttcctgtaatagattcagataaaatgtgtcatctgggttgtcagaggttaaaaagagcttaccgaccactcagcattgtctgtcttggaacatctcacattcactggcaggctgaggaccagcttgttgaaggagagaccttcctttttagtccatttaaacttattcatagcatccatgaaagaaaggtttttatattgcttgggacttttgataatgaaaggccaggtcctgaatttaaaagacacagttagtcatattcagaacaaatgcattacatgtttcctttacttttcagcatcctaaaatagatctcacacttattcattttcatacacatagataacctaatgcaaaatgttgatgagctcatcagtgattactagaagaaataccaaataaaagatttttaaagaatgatatttattttttagtagcagattggcattaattttatttttaattttatattttttaatagatatggggtcttgctatgttgcccaggttggtctggaactcccaggcgcaagcaaccctcccacctccaccactcaaagtgctgggattataggtgtgagccaccatgcccggtcaaaatttaaacaaataattttgtctcagaaagcttctacagagtctcacaattctacattaatttggtttggttctagttaaaaaattaactggtaagcattcatttctgaaaagtacaatgctaatggtgtaatcaagaaacctgcaggttcctaaaagatactgtgagagatggaaagttcaaacccatacactataaaagcctgacccctgctggctgatctgttttggcttagctaagtgagaagacaaatacaacaaaaaatgtgatttgatcaatgcttcaaaaattttactcatttctcaaaagaagacatacataaggccaaaaaacatgaaaaaatgctccacatcactaataatcatcagaaaaatgcaaataaaaaccagagtgagataccatctcaccagtcagaagggctattattaaaatgcaaaaaaaaacaacaactgatattggcaaggttgcagagaaaagacaatgcttatacattgttggtggggatgtaaattagttcagccaactgtggaagcagtttgtagatttctcaaagaacttaaaacagaactaccattcaacccagtaatcctattactagctatacacccaaaggaaaataaatagttctaccaaaaagaccacatgcatttgtatgttcatcatagcactattcacaatagcaaagacatggaatcaaccaaggtgtccatcaaaggtggactagataaagaaaatgtggtacatatacaccatggaatactatgtagccacacaaaaaaagaaagaaatcatgtcctttgcagcagcatgggtgcatctggaggccatcatcctaagtgaattacacaggaacagaaaaccaaaaaccgcgtgttctcacatataagtgggatctaatcattgaatacacatagacataaagatgggaaaaacagacactgggaactactagagagagagggagagagggagacaagaatgaaaaaactacctgttgggtgcctggctcactacctgggtgatggaatcattcatactctaaacctcagtttcacacaatataccattgtaacaaacctaaacatgcatcccttgaacctaaaataaaagttgaaattttaaaaatgtactgagaaaaaaaataccctatatagaatacactctgccttcacctgccactccaaaaatcacatgccaaatattcaagaaaggaaaaagaaatcacaagaatgacatgagcagacagaagaagtgacagaaaaagtgaagtgaaaaagtgaatgacataacttgcttgaaaagatagttttcaggtgttgtctttcattaaatataagttttatattattgattcctgaaaaagggaaaagtgtaagtgctggcatgtcacaaaattttacattaatccatggaccttgcaggaaattatcatggtgactagaaagtatctggcactcataacatcccaagatgttacagtaatttctataattatcaaataatctcagctgaagaatatacattaatcttcatatttttaaaatttatttatgtcatttctctctccctctctctctctctctctctctcttaacatacataacccactcaggcacattgaatatcatctttttaagtaaattaaaagttccttattaatttcttggagttataaagataattttttatgtctaaatttgaaatatttcttccatatctaataagtgagacaatgaggaaaataggtaatatatatagatctttacatttttcataatttcctttaattagaatcaatatatatctttgttgagttttaaatgcattattttatacaaagaccttaaagtgaagccccataaagtaagagcaatcagcattgcattacataaacatacctagcaatggcctaaaatctatagcatttgaaaattaaacatattgtgacaattttgtagagacacaatccagaattagtatcaagcaaaaacttgacttgaaagaagttattatatttgcatacaatgtccttttaaaagcactaaaagctacagctattgatcattttaagtcaattattaaaaataaaatttacttttcaaaaagataaaatgcctaatttgaaaaagagaaaatcaattttataaccagataaatgctaggggaaaatcatcagtctgtaaccatctgaaacaccacaaggtggcacgacagctttactatggtgcttaggttgcctaaagcctctggtgccccgctgttaagagtgaatagtgtgaccattatacacagatgaaatcttaaaaagctttgctgctataataatttactaaattgcctattattgagattgtccaacataaagtgacagaagaggtgtaaccccatttgtcagtttttagaacagatatgtagaaaggccaagcccaatggcgcgtatgttggagacagaatgactgaggctgggtgacctggggatgtggtcatcaacctttctgagatggcatctttgtctcatatttatcatctcctttccactcccactaacttggtttaggcccctgttctataataactttatactaataaacatcctacttgtcatctctaacctttctagcctatcctacacacttccaaattatttcctagagaaaagagcagacagaaaaagtgaatatttatcctgaatactttttttcaaaaagactaagctttaaaccaggtaaccttaaagtagcaagtatttctgcttttactgggattagggattagttggaaataattgggaatgttacagaaataaaaagttacatttctgcatatcttgtcagtgtgtaaatgtctctccatacatacatgtaaacgaatggtattatatatatatatatatatatatattactgtagtcaataaaaaacagtgttattattatgctttaatattgatgggtaattttcctttgtaaattccatctaaactctgagacatgtttttctaagaagatagcaaagttgactgcaatacaccatggtagagtaattttttaaatttttaagtggaacataaagctatttattcttataaattcaaactgatcaatggaaattttaaaagtttaatgatttttatacttggtccctctgttctatataaattgaaaagcagatggagaaaaataatctgtggttacatttcttatctgagcctctctggactcctgttttaaaagttttattgctaatgtctttctcggggtagagaaggagaaggaaggaagagagatggaagatttaaccaagaaacaaagtccatgtacttatagctaaatgaactatattacacactctccatccatcaagcaagtaaacatgtgatcaaaaactagcaaaaggaacaaaaattcattaacagacttccacttttggccatgttggagtaactgacactaacttcctgtaaaaaactcaaaattcgacaaaccatatgaaacagctggtttggacattggaaaatagcacagaactatgatccccaaaaggaaggaaacaaataaggtgtttgaatattatgttcatcccagctttctgcctagaagcattctctgaaccagaatgcaggaaagggaatttcgaaacagaaaatgacgatctcaataagttaaggagatgaagaccagagttaagggagtctgaagaagcttacatattcaaggtagactactgcagaggaaaaatttgtataaggatcctctgagtcagtaactaagcaataagccaactatatttagggtaaaatccacaagactgggcaatgaacaactagaagattgtgacctaaacaattcccagagcctgtatagagctagcagacatttgagctcaaactagccagagtggaatgtctctgttgactacacggagtaaacatctattctagactcacgctaacaaggttctttaaagaaataaaaacaacctagtactaattaacagaatgtgcataatgtcctgttgtctatgtctagtcaaaaaattattaaacacatcaacaagtatgtaaatgtgaatctaaactagaagaaaaaatcagtcaatactccaagatcttgaaatgacagagattaaagaattagcagacaaggataactaaaacttaaaaaaacatattattaacaaaacatgcgcaaaacttctatattgaaaaccacaaaaaagtgcttagagaaatgaaagaacagtaaataagtgaagaggcataccatgttcatagattagaagactcaatattgttaaggtatcaattctctcaaattgtctagaaattcagtataatcccaatcaaatcccagcaggtcctttttaaaaatgaaattgacaagttgatttaaatatatgtatgaaaatagaataaacctagactatcaaaataattttgggaaaaaatgacaaagttttggagacctacatttaagacttcctataaaactataataattaaatgtggttttagagtaaggctaaacatatagagcaatgaaacagaatagaaaatccagaaagaaccaatatatggacaaatgattttccaacaaatattccaaagtaattcaatagtaaaaaggtagttttctttcatcaaatggttcttgcacaacttgatatctatatgaaaaacaaagaacgttggatttaccttacactacacacaaaaatgtgttcaaaatggatccacctaaatgtaaaagctaaaactgtgaacttttcagggggaaaacaagagaaagtcttcccttgagtaggcaaagattttttaagcaggatatgaaaagcacaaaacaaaccaaaaaaatgatgaaacaaacttcaataaatacagcttttataaaatgaaagtcaagccacagactgggagaaattgtctgtaaacaggcatccaacagagaacttacatccaaagtataaagaattcttacaactcagtaataagaaaacaagtaattcaatgaacaatgaacaaaaattctaacaaataattaaaaagaaatacacagttgccccttggtatccatgggggactgaggatagcaaaatctgtgatgttcaagacacttatataaaatggtgtagtagttacatataacttatgcacatgctcctagctactttaaattatctccagattacttataatacctaatacaatgtaagtgctatgtagatggttattatgctgtattgttaaggaatgatgacaataaaaatattctgtgcatgttcaatatagatgcaattttttcaaacattttttatctgaagttggttgaatccatggatgcagaatccatgttctgcatctgggaaagcagagggctgactgtatacatacacacacacacacacacacacacacatttatttatacacatgtacatatatatatatatacatacatatatacacatatatacatatatacacacacatgtgtgtgtgtgtgtgtgtgtgtgtgtgtatatatatatatatatatatatatatatatatatatatatatacatatatacataaaaccttaggacaattctctgggtggccctggaccaatccaatccattctcatttttgcttgtagttctcaagaataactatataatgtgctggaaacagaaaatcttgagataggaagggactgactggaatagcccaggttctgttccagtacccccaatagggtttgaatgttcatgtccctccaaaactcatgttgaaatctcatctccactgcagtgtattaagaggtggggccttgaggaggtgattaggtcaagagggttccatgctcatgaatggaattagtacccttacaaaagagacttgagggaaccttccaattgtaccttctacttgtgagaacacagcaagaaggtgccatcttggaagtggagagcaagccctcagaagacactgaaactgctggtgccttgattttggacttccccatcttcacaacaataagcaataattttctgtagtttataaattacccagtctaagctattttgttatcccaccccaagccaactaagagactcccctggaaacagagagtccttcaatgctttagccttgaatctcacattgccctgggatataaaaccaagaatgggctgcttgtcaaggtctttcagctgccatgcaactgggacatgtacagtagaggctccatctattccaggcagatttcctgagccttggaaaactggcttacaataaattctaggattctgttgttttcgctgcctatctgtaagcaataaacccatttaatgtaacttgttgtgtataagtatgatttttcttactggactcagacaacctgcacagcgaacctgctttacaataaccaataaacatgtgaaagaggctcagtatcattagtcacaaggaaaatggaaaataaagccacaagaaaatatcactagatacacattaaaatggataaaatgcaaaatactgaaaatacaaaatactgccaagaatattgagtaacaggagttcttacacatcactggtaagaatgaaaaatatattattttaagaacattttgagagtctatggagtaaacataaacttagccaacagtctctcaactggaatctgcttaagcctaccaaactcccgagggcagggtcgatcagcaccgcagctgcctactgtctaagctgtttgagctccttgggagaggagcagcagccagcactaggactcgcaactgcctaacgtactaagctccctgggcgagggaagggcagcatccatctctatagctccagactgtgcttttcccctgctggagccagagaggctggatggcttggtcacaagacttgttccccacagcccaacacactggctgtggcagtcttccaccagaatgcctcttcaggcttgaccctgacccatccttcctcactgggtggggcttccctggaggaactccaatgactccaactagaggctcagggacagaagctggatctccctagtcctaagcccctaaggggaggggtggctgcagcctctgtggaccagcaggcttcgcctttcctcctggtagctctgaggaatccaggcagcccagatgagtgggttttctcccaacaaggcacacaccctccaccaagggacaaagtgctttgtaaaatgagtcctgttccctatgccagccaaatgggtgagacccttcaataggggttgtacaggaataatcctactagcatcaggttggtgctccttgaggtcagaggtcccagaagaaggagtaggcactcatctttgctgttctctagcctcctggagtgtcatctccaggtgtgggaaataatcagatgaatagggcctgaagtgaacacccagcaaagtgcagcagccctacagaagagggacctgactgttgaaagaaaaacaagcaggaagcaacaacaacagcatcaatgacaacaaaaaaagcactcacaaaaaccccatccaagggtcagcagccttgaataccaaaactggacaaactcatgaagatgagaaagaatcaataaaaatatgctgaaaatccaaaaggtcagagtgcctcttctcctccaaatgattgcaacatcgctccatcaagggtgcagaactagatggaggatcagatggatgaattgacagaagcaggcttcagaagatgggtaataaaaactatgctgggctaaagaagcatgttctaacccaatgcaaagaagctaagaaccttcataaaaggttgaggaactgctaacaagaataatcagtttagagaggaatattaatgacttgatgaagctgaaaaatacagcacgagaatttcatgaagcatacacaaatatcaacagccgaatcaaccaagcagaagaaaagatatcagagtttgaaggccaccttgctgaaataaggcatgcagacaagactagagaaaaaagaatgaaaaggaatgaacaaagcctccaagaaatataggacttcataaaaagacctaacctatgactcattggagtaccagaaggagatggggaaaatggaaacaagctggaaaacatgcttcgggatattatccgggagaacttccccaacctaaaagacaggccaacatgcaaatcaggaaatacagagaacaccattaagatactccacgagaagatcaaccccaagacacataataatcagattctccaaggtcaaaatggaggacaaactgttaagggcagccagagagaaaggccaggtcacctacaaagggaagcccatcagactaacagtggacctctcagcagaaactctacaagccagaagagattgggggccaatattcaacattcttaaagaaaagaattttcaacccagaatttcatatccagcaaaactaagctttttaagtgaaggagaaataaaatccttttcagacaagcaaatgctgagggattttgatactaccaggcctgccctggaagagctcctgaaagaagcactaaatatggaaaggaaaaactcgtaccagccactgcaaaaacataccaaattgtaaagaccaatgacactatgaagaaactgcatcaactagtgtgcaaaatcatcaaatagcagcatgatgacaggatcaaattatcaaattcacacataacaatactaaccttaaatgtaaatgggctaaaggccccaattaaaagacacagattggcaagctggatagagtcaagacccatcagtgtgctatattcaggagacgcatctcacgtgcagagacacacataggctcaaaataaagggatagaagaaaatttaccaagcaaattgaaagaaaaaaaaagcaggggttgcaatcctagtctctgacaaaatagactttagaccaacagagatcaaaaaagacaaagaatggcattacgtaatggtaaggggaaaaattcaacaagaagagctaactattctaaatatatatgcactcaatacaggagcacccagattcataaaacaagttcttagagacctacaaagagacttagactcccacacaataatagtgggagactttaacaccccaatgtcagtattagacagaaaaacaagacagaaaattaacaaggatattcaggacttgaaatcagctctggatcaagtggacctagtagacgtctaccgaactgtctacctgaaatcaacaaaacatacattcttctcagtgccacatggcacttattctaaaatcgaccacataattggaagtaaaacacttctcggcaaatgcaaaagaactgaagtcattaaacaaacagtctctcagaccacagtgcagtcaaattagaactcaggattaacaaactcactcaaaaccatacaattaatggaaatcgaacaacctggtcctgaatgactcctgagtaaataatgaaattaagacagaaatcaagttctttgaaaccaatgagaacaaagagacaacgtaccagaatctctgggacacagctaaagcagtgtcaagaaggaaatttatagcactaaatccccacatcagaaagctagaaagatctcaaatcaacaccttaacatcacagttaaaagagatagagaggcaagagaaaactaatccaaaagctagcagaagacaagaaataactaaaatcagaaaagaattgatggagatagaaacaggaaaaactctcaaaaaaatcaatgaatccaggaagtggttttttgaaaaaaaaaaaataacaaaatagatagatcactagctagaaaataaagaggaaaagagagaagaatcaaatagacacaataaaaaaatgacaaaggggatgtcaccaatggccccacagaaatacaaactaccatcagagaatataaacacctctatgcaaataaactagaaaatctagaagaaatgggtaagttcctggacacatacaccttcccaagactaaaccaggaagaagttgaatccctgaatagaccaataacaagttctgaagttgaggcagtaattaatagcctactaacaaaaagaagcccaggaacagatggattcacagctgaattctaccagaaatacaaagaggaactgttaccattccttctgaaactattccaaataattgaaaaagagggactcctccctaactcattttatgaagccagcatcatcttgataccaaaaccgggaagagacacaacaaaaaaagaaaacttcaggccaatattccttatgaacatcgatgcgaaaatacacaataaaatactggcaaaccaaatccagcagcacatcaaaaaacttatccaccacaatcaagtcggcttcatccctgggatacaaggcaggttcaacccatgcaaatcaataaacataatccatcacataaacagaatcaaagtcaaaaaccacatgattatctcaatagacgcacaaaaggcctttgataaaattcaacatcccttcatgttgaaaactctcaataaacaaggtattgatggaaatatctcaaaataataagagctatttatgtcaatgccacagccagtaccatattgaatgggcaaaagctggaagcattccctttgaaaactggtacaagacaaggatgccctctctcaccactcctgttcaacatagtattggatattttggccagggcaatcaggcaatagaaagaaacaaagagtatttaaataggaagagaggaagtcaaattatctctgtttgcagatgacataattttatatttagaaaaccccatcatctcagccccaagacttcttaaactgataagcatcttcagcaaagtctcaggatacaaaatcaatgtgcaaaaatcacaagcattcctttacaccaacaatagacaagcagagagccaaatcatgaatgaacttccattcacaattgctacaaagagaataaaatacctaggaatacagctaacaagggatgtgaaggacctctttaaggagaactatcaaccactgctcaaggaaataaaagagtacaaaaataaatggaaaaacattccattttcatggataggtagaatcaatatcatgaaaatggtcatactgcccaacgtaatttatagattcaacgctatttccatcaaactaccattgacattctttacagaattagcaacaactattttaaatttcatatggaatcaaagaagactctgtatagctaagacaatcctaagcaaaaagaacaaagctggaggcatcacactacctgacttcaaactatactacaaggctacagtaactaaaacagcatgatactggtgcaaaaacagacatggagcagaacaaagacctcagaaataacaccacacatctacaaccattaacaaacttgacaaaaacaagcaatggggaaaggatctcctattaactaaatggtgctgggaaaactgcttagccataggctgaaaaccaaaactgaaccccttccttacaccttatacacaaattaactcagatggattaaagacttaagtgtaaaactgcaaaccatagaaaccctagaagaaaacctaggcaataccattcaggacataggcatgggcaaagacttcatgacaaaaacgccaaaagcaattgcaacaaatgccaaaattgacaaatgggatctaattaaactaaagaacttctgcacagcaaaagaaactatcatcagatcaaagagacaacctacagaatgggagaaaatttttgtaatctacccatccaacaaagatctaatatccagaacttacaaggaacttaaacaaatttacaagaaaaaaacaatcccattaaaaagtcagcaaaggatatgaacagacacttctcaaaagaagacatttatgtggccaagaaatatgaaaaaactcaacatcactgatcatcggagaaatgcaaaccaaaaccacaaagagataccatctcattccagtcagaatggcaattattaaaaagtcaggtaacaacagatgctggcgagtctgtggagaaataggaatgcttttacactgttggtcggaatgtaaattatttccaccactacggaagacagtatggcaattcttcaaggatctagaaccagaaataccatttgacccagcaatatcccattcttggtatatacccaaaagaatataaatcattctactataaagacacatgcacttgtatgtttattgcagcactatttacaatagcaaagccatggaaccaacccaaatgcccatcagtaatagactggatacagaaaatgtggtacatatacactatggaatactatgatgccacaaaaaggaatgagatcatgtcctttgaagggacatggatgaagatggaagccaatgtcctcagtgaactgacacaggaacagaaaaccaaacaccacatactgtcactcgtaagtgggagttgaacaatgagaacgcacggacacagagaggggagcaacacacaccagggcctgttgggggatggggggtgaagggagggaatatagaagatgggccaataagtgcagcaaaccaccatggcactcgtatacctatgtaacaaagctgcacattctgcacatgtatcccgttttttgtttgtttgtttgtttagaataaataaataaataaaaacactttgtgttccaggaaaacttaattcagatgctcaacactaaagtgtattcaattgaacttatgaatcctacaagtaaaggaaaaattcctccattcgtccagagagatctcccaagggaaagaaatatgaccctaaaatatcatatccagccaaactgctatccaaataaaagagtagaaattcccaaattgaaagaacttgaggcataaggcactcagaagcccttactgattaaacaacttgaagataaaatcctaatgactcaaatttaaaaactcattaatgtagaaatcataaagattagggttatcattgaattgatttatctaatcaagtcatgttaaatattctgggaattatagtttcataattaagtgtaaacattaaaaatcttgaaaatataataattataatataaataataaatacttggtggtttagaaagcagaagtgggaaaaatatgaaagtataaacgtctccatctttcatgacctaaaattgaaacatacagtgaatctaacaacttgatgattttatgatctattttgtcaacattcgagaccctcttcataaaatattatttcttgtgcttaaaacaacaccaacaacatttatttgaacttcaacaaatgttcagttttactttagtttctttctaataagttaaaacaaaattaaaattcaatggtttttcaaaaatagtgcataaattgtaatcttgtaacagtatttaatcaattcattttatataaatatatacatattaagatgtttataataacattcattcaacatgttagcaatgtttatgttgagtagaatttgaggtggttgcttttgccttctttataacaacttgttctgcattacctgaactctttataataagcacgtgtgagttttaaataggaaaaacataaagtgatttttctgcaaagaggaagagaaacagctattgatgcttttttaggaacagaaccaataacacaggaactatccattacttacatctcaccagacctgcatattcagtcttgatttatggtacaacagggaatacacaatttatctaaactcattatctattttgttgtttgatctttgtgagttttttgtttttccttaagacttgccagatctgtaggaggcagacagaaatagcacccccgagaacagacaataaaattgagacaagacatagttgtctcattttttctatcaatccttcctaggattgctatagaatgtttaaaataaaatatagaacctgattaatcattatatgaaaagcacagaatagaagagttttgttcatatgttatatgatattcctttttagtattatatgctgaataccaattggtaatattcttctaagcaaaacagaaaaaaagcacctaagccattttttgttctgatgtttgagccagcaccttgttagtttggccttcactatcacttatgtcactgtggtgatgaactagatttaatgtctaatttaaagtctaaacatgtatttttaaatagaggctcttttgtgctcatatttttgaggaataaatttaaccatgaagttaaatgggttttgtcctttttttttttcttttttcttttttttggcaggggagaatgacatctcaaaactagccttgttctgtaaagcaattctccctgtctttccaaattatgaaaacccaacttgagtatttcctgagggagaccaaaggtatggacactggtggagctcattgggaaacaggagagccgaacatttttagaggcttcataccatttaaacttaaaaaaaaaaaataggccatagaatgcatttaaatcatcttgcaaacatacagcttttaatatccatttgtttttaacattctctcaaattaaccatcgattagaaaatttccattcaatatgtaaaaaatattctaaatgagaaaaagactactcaaggctaagtaaggaacaatataacatcaatatttgaaaaccaagactacatcctagtgtttttaaaatgatattttatgtgatgcttggatttttgttgttttaatttgtttacatatgtaattatttacttgttatatatttatgtatatttatatattggcctatatgtgcatgttgtatggggagaaagagatcagagactagatgcaaaccccaactctcccttttattatgtactatataatgttgaataatttcttaatctcttggtttctatttcctcccctataaaaccgggattgcatgtcttgctctacctgttggaattgtgtaaaaatgaattataaaatcatgcatatgaaaatacttagtaaactataaaccaatttatgtaagcattttgttatttgtattttattagatataggcatttcttctagtggtcattttgctgtttgcaaaaaaattcagtaaaacctatctatgaatcataaatttaattcaaaaagaggagtgggtctcagttcataatttataatcctgtaatatttaggcacaaaaacttgaccatatttctattctccttcatcatctgcattttaccatatcctcactgaatgttttttcactctctccttaaatacatgtctcaaaactctatgtgtggctaggcatggtggttcatgcctgtaatcccagcactttgggaggccgaggcgggtggatcacctgaggtcaggagttcgagaccagcctgcccaacatggagaaaccccgtctctactaaaaatacaaaatattagctgggcgtggtggcgagcgcctgtaatcccagctacttgggaggctgaggcaggagaatcacttgaacccaggaggcagaggttgcagtgagctgagatcgcgtcactgcactccagcctgggtgacaagagcgaaactctgtctcaaaaaaacaaaaacaaaaacaaaaacaaaacctctatgtgtatattttctctaattacataattacgtcagtccctttcattttgaatagtagtgatcattagaaaattcttctctatattaaaacaaattcagccatccccaaatttccaccagccattctaattcttctcactgacatcagtaagaatagatacatcaaccttaatatatccaaaacagaattctcaatatcatcctcagcatgttcccctaacaccattcacaccatcactgagcctttactctgctctatccctcactgcctccatgagatgccattgatcaacaagcctgtgggtgctcctttcaaaaagtaacctgaatggaatgtgtctcatcaacttggtgtcaccaccttggcacaagtgaccttcatccctcaactagacaatcacaatagtttcctgattgatattccttccagtctagccctcctagagtcctttcccagtatagtagccaaattgactttatttatatcctttaattgcttccctttgcacttaaagccccaaggccttatgttgcccataaagtcctaaatcatctggtcccacctgctctcatgtgtcctcacttattctctaccatacttcactcttctgcagccaaatgcactctcttgctgctccacaaacacggtaggttcagactaaccacagggtcattcattacactggctctttcctgtgcagaatttgcatatctctatagctggctccttatcacggaggtcgctgctcagatatcaccaacccagagaggctttctttatcctgttgacaacaactacatacttccttcactgttttgtcttcataacatctattactatttaaaatatctttttttgtttattacctctccctcactccagaatacaatctcaagagggcaaggaaaatatgaatcttgtttattatatcttaaatagctcctataattgtaccgaaagagaacaattatacctaaagagttaacataataggcccacctcagaaaggcctgcttgcaaggataatccttggcaggtgcctggaaacttaaatagtaaacgatttcctatattgacataaactttctctaatgataagagtgactcattgtgcctatactgtgcaaacaatgcagtttatgctgaacaactgctttccatctggaagtatggaattttagtaagtggtaggcagagaccacctatatgactagttcctccaaaaaactctgggcactgaatctgtgatgagcttctccaatagacaacattccatacatgttgtcacaatttgatgatggtgtaatttggtgcattctgtgtgactccactggaagagggctcttggaagcttgcgcctggtttcctctagactttgcttcatgtagcttttccttttgttctttctgctttgcatgctttcaccatattcatgttttccatgaatacaactatttgctgagtactgtaggtactccttgcaaatcacagaacctgagggtggtcttggggactctggacatagtaatcaaaaaggttacttggtctccccagttaaaagtaatcaaatagaacaaacagtgcataaaaatttctataatgtggtaatggatccagtatgacaataaagcccatctttctctgaaatacgttaccccatcataaaatacatttactacttacgtgactggtctgtagatctccttaaccccaatgaactgaagttgttccataatgtctggaatacttgcacatcgagtaagattaattcttgggtaataaagaaggtatgagagacacatttcactcctggtgcttagtcctccctgaaaacagatagtttatttagcaaagtatgtgttctaccaactttgacatttaaagcacacaagtcattaatgtcatacagttccttccaatattaaaatttaatacatcttaaagctgaaaagttaaaaaactggctttttagaaaggtagtgacacaattaaaaattaatagaattatttccactttaaaaatttgcctttcttaaataacctaataaattctgcggatgggatgtaaacttctcaacacagtgaacatttcagagaatcataaggatgtttggttagcataataccaatcaatcaggaatttttgcaggaaatttttctgatttaattgaattttctagaatcttgtcttcatgtgtataaacattagcagctgcatacgacggggagaaagatttcatattttgaatctaggtagttaattatctactaaaatttggaaaaagattaaagaccttcaaaagaacagaatccagagttactacaacatattatctaatatgtctaatttcaaccaaaaattattaagtgggaaaagaaacaggaaattattatctaccttcaatggagaaaagtcagtagaaatggattgtaagattgatgtgctggatttatcagacaatgacttgaaaacagataaaaatatgttcaataaagccgttttacaaagtgttcaaagagttaaagaaaaacatgctcaagtagttaaaggcaaatgtctcaaaaatgagtgaacagaaaaaggaatgacattaggaaagaagaacaattttaaaaatagaaattctagagctgagaggtaccaaaacgaaataaaaacttcacaggataagctcaacagcaagtttcaaatgagcaaggaaaatatcagtgaacttgaagattaatcaatagaaattgtcctattcaaataacagagagataaaagactaaagaaaagtgaaaatacttcagagatctatgggacaacattaaatgttctagcatttatgtctaacatatatgttttcatgtatgttaaatacatgtaactggagttctagaatgagaggaagaagacaaaaaggtagaaaaaatattcaaaggaataatgcctgaaataatccccaatttaatgaaaaacattaacttacagacccaagaagctcaacaaaaaccaaatgtaaatacaaaaagagccatacctagacacatcacagtcatactgctgaaaaccaaagataagaaaaaatcttgaaaggagcaagagaaaaatgacacatcatatataggtgaacaagaatacaattgacagctgacatttcatcataaatgatggaaataacaaaaagatattgaattatatattcacaagtgttgcaaaggaaacaaagcaactgccaaccaagaattctgtatccagcaaaatccagctttcgaaaacaaaggtgaaaaacttaatattgtttatattctaaattaacctaggggctaatatacaatgattttactaattgcaaaaacatgatgttttgcacttgatgagcaaggcaggattaggcaaaggaagatgctgatgtgcaaatgaagttgcatttgatgcctcagtaaatattgtatttaatttatccttaagttaggatggctgttcagagttgtaccaaattgtagaaggaaagctgggcctttgcagcatcttatcaactagtcattgactgctggctctcctactgtagggagtaaaattttaagaagttattttctaataccaaggggaatgtccagtgaggtacacagctgtgagctatcatattatcatctgacattcccagtggctgaggtttggttgtgttggccctgaagagggtatcaagacagtgcaccaaaatacccactataataataactcatttattatgtctttagtaaaataatatttcaacaacaaaaattatacataaggcatgagaaaaaaataaaaccaacaccagtacattgactactccatgtgtgtccagcttctatccctcttcttcccatttcaaccaaaggtgattactatcttaatattttatctttctgttgtttttcattacactttacattcagtatattgaagtatgtatccctaaacaatatattgtttaattttcctgaactttacatacataatatcacactatatatattctgctacaagcttgctcttttcaatcaacattatttgttcttcagatacactcaagttaatataggcagctttcattcattaattttcataactttacactgtttcattaaataataccacatttatttgttctccttttgatgggtatttgagagatttccagaattttttctttcctatattattatatgttactatgaatagtttacatatttctctcctgaaacacattctgcaaaagtaattccaaggttaaatctacataggaatggaattgagtagagtatatatgaatctctaattttactagataatgccatacttttccccaagatggttttacaaatttaagtcactactaacagtgtataagtgttccagtttcagcataacggaaatgctatttaaaattttgccaaactggttagttcaaaacatctcactctggtttatatttggttttaaacaaaattgagcatcttttcatatatttatagtatctattatatgggttgttatttctttgaaatgcttttgtcttatcctcttttattgtatgcttctcttctgttactgacttatggactttgttttataagctagatactaatgtcctgttaatctatgtattgcaaatatttttcccagtttaaaactcttcttagtttcttcatagtgttttattttggtaagcaaaagctttgacgtagtcaaatttgttaatctttaatttacagtttgtgcttttatgctttgcttaaaaaattcttaactactccaaagtcatgaagatatattcaggtattttttcttccagcggttttaaatttttgctgttcacatttaaatatttaatacatctggcattgatttttatgcattgtgtgaaattaagactcagttttatttatgtcatatggatagccattagtgccagcatcctttaataaaaagtttatccttttccatttatctaaatgctatgtctatcataaaccaagtttccatctgtagaatttgtaggtctgtttctgagatgcctcttctgctccaagtcttctaacttgggactcaaagcatattgtattaatcgccagttttaaaataagccttcttatctagtagattgttttctatcttgttcttttcagttttgtcctgcctatttttaaccttttgctcttctgtgtaaattttagaatcaacttgctccatgtgaaagctaaaacagcaaaatgtttatataaattaaaaaatacatgaaaatatttgcagccttggtctggtgaagatttcttagctagaataccaaaacctcaaatcgtaaaatttctctgaaatttttttactagaataatatcaaatttatgagccaatatgaatagaagtattttctttattttactgagcctttctatccatgaacacggtatctcttactgtctttaggcattcttttaatgtttcccaataaagatttataattttttcacagagatcaaacacatctagtgttagattttatttctgtttaatttttattttaaattgtattttcttgagataatttcttatatactcaaatgcaattaattttagatagtatcaatttggaggagggtttgatgcagaaaattacagtatctgtgagtaatgtgttttgcttcttcacttctttctttctgatccttatatctcattttcatttcttttccagtacaatgttgaatacaagtagtgataacaaatacccttatattcttcctaacttgaaaaaaaaaacggtatttcatttaatttaatatttgctatagctttttcatagctaacttctacctagttaagacaattccctgttattccaggcttgctaaatgtctcccctgtcaacaataaacttgaatttaatgaatgctttctctacctctgttgaggtgattatatatctttttctttcaataaatatattttctaatttaaatcaattttatattccttagctaaactcaagttggtcttatcattagatttgtatataaaaaaggatttggtttgtcaaactcttgtccaagttatttccatcaggtgcatactactggccccttttatactatccttgtgaagttttagttttaagattatgttaactacattttatgacttggtgggaggtgttccctcttttagtgttcctgaaagagattgagtaagacatgaattatctatttcttgaatgcttggtggaattcccccagtaaatctgttgggaccagatttctctttgagtcagaggcctcaaggtcatgaaattcattcttcatttggaagtctgtatttatctaagccagactcaagcagacagtcaattaatgaccacagttcttttaaaaatattagatgagaaaaattaaaagactaaggatagcttttcatgaaggagtcaattaattacactccaagtattatttaatactataatatcattagttaatttgaagtcttagaaaatgctaaaaacatctctgatgtcacttttatgatacttgatactcaagatttttagaacttttctttctaaatggaaatggtttttacctttttcttctaaaatcaagtttatttctttctctccataaatgaactttaataataataaaagttttcttacccaagtcatctcagctctatctttcgtgttgtagcgacactcagtaattaggttatctccctgaaacataaaagcaaaagctttcagattgaagttttatgctggcttatttatcaaatacatttgtacgtcaacagttaatatttgctgtatgaatggatgcgccaagtaatttcattcagcagaagacccctgatctgtttaattctaggtttgctgatataacaagcaagcaaataaataggactctctgtgtttccaccagactccacaacattctagctggatgaactacatataacccaggcacaatttgttcatttaaaacctaaagataaaaattgttcttatttttggccctggcacggtggctcacgcctgtaatcccagcactttgggagggcaaggcaggtggatcacgaggtcaggagttcaagaccagcctggccaagatggtgaaaccgcgtctctactaaaaatacaaaaattagccaggcgtggttgcgggcacctttaattccagcttctcaggaagctgaggcagagaattgcttgaacccaggaggtggaggttgcagtgagccgagatcgcaccactgtactccagccggggtgacagagtgagactccatctcaaaaaaaaaaagtccttatttttttcacagctgttacgaggagattaaatgacataacacataggcattagcaacaaatgaacatttaataaacctcagacatagatagtagttattgtgatcacctcttcatttacattattttctttaaaggtctctagtcatgcctttatttccttacaatagaatcgtgaggcaaattaatagaagtttattgttctagtgttttccatccttttgtacattacaatacatatggaaaatgataacatttttatgtttcccctttaaggtaagcagatgaagctattcatagacctgaggccgtaatctctgggcttttgctcttaaatttgacctccctgcacgccactcagagggcccagagaacagtatctcatcgcacttatgccataatcatggtgcgtcagttaggaaactctgagataacactgtttggaaaaccccagagacatcataataaaatagagtgtagtccttaagaaccttgacaagatcaccatttctcaaacttctttctactctccggatgtatcaaagaatttctaagatccaaagctatggatttaagggatagctattagtaaaaagaagatccctttcctctttatcactttcttctgttttttcagctttccttttacatcctattgtgccatgtcttctccctgacagttcatcccatctaaaaaccctgtctccagcatcacgtagaaaagatattgccattactctcatttcgtaaatggtatagggatctgacttttaaaagtaaaataagggtagaaaattatactacaagtgagcttgatggtcatggaataaaaatttgagaaaacaaagcattataacctttttaaagccttcattctcttctctccttcaccataaccccaagtattatgtcaagctggatcacacagcatagtttaattagctatattcacatagctttatcagataaaagaattatccttacattcctttttactaaaatgaaacttctaaaaatatcctatctcttcaacatagcataaagacacctctattttaccactgcaggaattgcaacccaaagaatcactaactggaatgtcaagtataaaaaaagagtaatgtttagtcctcagaacctgagatttttgtttggggttgtttttatttttcagtcaacaacttgaattgctcctgggaattataagaaaaatgagtttcaattttggaaaacagatcaaacacattccatctgggttgtacaacacccacagtgggtggtgttaagaatacagatgcaaggaaaaattcatttcactagtagaaaccttgccacatctcagcagatatgtctcatgactttcataacagtcaatgaaaaagaacaaaaacatgcatactggtaagattgtttgttcttcctttagatactgaaactcctggaaattgaagtcaaaatcatcatcataggcaagtaatttcatttccttcccttttcgaaaatgacgcagcctgatgcctctgccagccaggtgagcatggagaagaacagcaaacacatgaattccacttggcttttcggcttccagagcctacaggagacaccgaggaagacccgattagcccacattaatgcatgttcagacagtttacattcaaacacacttggagggacaactgagataaaaagctaaagcaatttaaatgaatgcttgaactgaaaaagagtttgaattcggattgttcagtgttctccttgtgaagcaacatttgccgggagaaaagtaggggagctgatgcttataaggggcctcccagaccatttctacatgttatcctcctttttccttcttttaggaggataagaggcaataaacattcttagcaaaaagattccagtatgttagtaacctgaaaacccaaattcttaaaaggaaatattattcccacttttccagataagaaagcgaaagtgggtcaatggaattaaatgaatcgcccatggtcctacagcttgtaaatgaggtcatggcaatttgaattatgaactatggcctaaataactcagaagagcataatctttccacttcaccagtctgccatactgtcctcaaccacaatatcatataattcataaagagtatgatccatgttgaaatattttcattaaaaaacttgaagtgaaaattgtcattactaaatatacttttcttctatcctatatatttttttatattagttatttttgctctgtggtgaagaaagggaaggaaactataaggcagagaaaaatgaaaataaatgatggaaaaatcaatatggataaaaggtaaactagagaaaagaaaaagactacacaaacaaaggttgaaattgtaaaagatgatatacagcatgcaacatgcaacaaacaaaaaaggtaggagtaagaagaaaaacaccctgccaactacttctgtctttagagttctactcctgtagcttcaagatttaaaaaagcagtcaaaagtcctactaaaattgcgataagggtttcacagtgtgtcaacaagaaaggaatcgataataaacatgtgcggaatttttcacaccacagtttctaagagcattgatgaatctgcagagagcagctcagactcagatgctgcatacctcttccaggcactccaaagtgcagtgaccctcagactggaactcaggcatccctggagggatggtatggaagaggctcacccagaggccagcctcaatcaccccagcatcatatttccttatatccattgtgtaaaataacctcagtccagaattatctattaagcctagaacaaaagcacataattaaagtgatttttggttcttaaaatgttttcattcccaagaaaattcttggtttgaattttttaaagttttcatattctgttgaaataggtttatttattttccataaactgtcatgagggaaagggattcaagcagagattagtggcagacaacattcagtttcacaaacaagagttaaaagatgagtagccatattgcctgcaacctttgtggactcacacagcatactacaagagaaatgtttccgttatctggctgttatattccacaattatctaacatgaagacagaatgaagattctaaagtcattcattagaatatagaataaataacttaataaaacttttattttatattgtttcgagatgaagttcaataacatttactttgaggtaaaacctccttagtttagaaaccatctgctgaagaaaaaaactactaaagattcactttatttctttaaagtttgtcaccattttcttcttcattcaacagccattcaatcaacacacagtcattaagaatccattatgtaaatggcactccattaggcattgtggggatgagagatgaataagacacacttgtcgttatgaaatattcattacagggagggagagtatgagccccaaacatttcataaattcatttcattaacttggaaattaattgacttccttctgcagtaactaacagattgattccttcccctcagtttcctttcttgtctcatttaaatcaatcagcttaatctatttctagtcaatcatttttaaacacaaggtctctatatcaaatattcctcattgcatgttatatacccttcactcacaaacacacacacacacacacacacacacacacacatacttagaagatatccattacttttaatttttttcagatgtaataagttgttaaaattaagtatttcaataattatcccaggaaattcttacctctcaacctccctaacagccttggaaaaaaatccaagctttactttcctgcttcatgagtttgtaattgtgaacataaaatatttgctatgtgtttgttgactccagcttcttcagatattcagggtcatcacaaggaagcactgtgatgtgacaattaaggacactgactctggagctgaccaacctggatgcaaatcccagctctgctgcatatgagttatgtcacctggggcaaatgctatggttaaatgtctatctcctccaaaaagtaggtttgaatgttgttgaaaattaatggccattgtgatgatattgaatggtgagagctttaagaggtgtctaggtcatgagggcttggcccctgtgaatcgattaatgccattatttcagaagtggctttgttctctcttgctgtctttacccttccaccatgtgaagcctactgccatgttatgacccgtaagaaggccctcatcagatgccagtaccttgtacttgtacttctcagcatccagaactgtgaggaataaatttctgttcattataaattacccagtctgtggtattctcttatagcagcacagaacagatgaagacataaagttacctaatctgtgcttcagttttccagtatggaaaatggccataatagtagcactactacctcataagtgtgatgtgtggcttaaacaccaagttctaagaacagtgtttggcacaaatgaggtgctcaataaatggcagctagtcacacgtacagtggtcacacatctaccagggtttcaatcaattgttaaacaaataaatcataaaaatcaattctccttttgtgttattatcagtgcagatacaaataagcatgataatgtagaatatctatactgaccttagaattttctctggacatatcttgcaaaattttgttttgtattttatatttttggcatctacttccttataagtttgacagggaaaaaatataagtagaaattccagttgcattttgtatagttaggttcattagttgcattagctgtttggagcattaatagataatctagtaaataaagtaataatttcttaagcacatataaaatgattattaaaaaacttttctggaaacaaattcgtattatgttatatttataaaaataaaattactataatctaaaatttggtctaattatgtacatgaataaaaatagaaagtactaaaaatcctgagttctctattaacctgttaggaaaataagcttatgtttcatttttacattgaaactatgagaaagtcaacttaattgacaacagagaaggcaaataaattaagccttctacttttgtaataaagactaaaaggaagaagtagttcacatagaatttccaattggagaagtattatacattgtatagaatatttattctattaataatttaaaatcaaaaatgtaaaaaatttttaaaagttgcaatataagacatattcaataattaatcccattgttattgtgatgacaatttttatgttttatagtcacatatgatttcacggaaaatctaacttttagaatttattaataggttattttgcttggtttatgaaagttttaaacttttaacatagattcatggttcagagtatgggatataattggtgggtggaaattaaagtgaattcagagagaaactatttcctattaattactttagggtaaaaaaagatactttattggcttgctcacaaatagaatagcttgacacctacttttatagaaacatcactctttaaatatcataccacgtgtcctctcttcaaaatctattattcatgctgctgcagccagagtggtcttttcaaaatacagatctcaatatttgactccactgtatcaaactcttcaattgcttctcattgtcttcagggtaaaaatccttaatgggtcctacaagatcttagatggtctgcttcagccttcctctgcaggttcatcagcatctttcttcactgcaccctaacccttcagcatctccagtcacccagatgaacagtttgattctttaatgaagactttttagcccatccccaccaatacacactcctggctggattaggtcaccaattaaatactctcatagtgttaggtatcttctttggaccaattggcatacatataatttcatatgattgctatgaaaaattgattgtttctttttcacattgggctataatttctgtaagggtgagaacagcatctgtttttcactcactctatatcctcaagcacagatctggcacatagttggagctcagtatttgctgaaaaattgcatgagtcaatataaaataataacttggagttacttctgttgataatttcgtgttaaatctatcaatgttaggatttggaatatcatacaaatgatttcagaaacaaaatgtacatccttacatttctttacttcaatatcatattacacggtgtcactgcataagtactttttgagtacatctatggtttgcttaccacacaacaaaatgcttacactttttagtataataaatggtaactttttcttacgtgcagttagaaagaaaatgttccataaacaccatgtattgggactaatctacatcacaaaggaaaagtctattattctacttcctggtaggtagcatgcaagtgttttttttgtaagattagtgactgcgtgtgctcatttacctggtttggtgctggttaatgcctgctgttacagtataattataaatagtacccactttcactttaaaaagtatcctaatttgaatgacaaatatataggttaattccttctaacactggctgctattttgtttcaactctgttaaagacttacaaggtacaaaactttttataaaaatcataggtaaaacatatgaataataaactcaccttcctcataagtgggattatcataatggacttctaggagcacataatgcggatctaatggagtgccaagggataatccaacatgaggtggataagaaaagccctaaatatggaaaatgccatgagacaatgtcctatgaaagtccctgagagctctattccactcaaaaaccagccatcttcaaggatatttcaaccctctggaaccccattcatctacaattgatgaaataaaataaaaatgacttaaagaaagaatcccttcctacgaaaatggagttaagccaccttcatatcaaaagtagcgttaaagctttacttctaagtattaattagaatcatatttgtggcgggaaatatgatcagttaattgtgttacatctcagtaatcattagccccacctctccaccaatagcccaggcaaaaatcacagtttcacaggtgaggaatgcatcgggcatgttggggtgatagcactcgtggccggactccagaacgctgtcgttaaagttgttgctgcactgatagagcaggatgtggtgcaccagactctcatggcctctctgtatcactggctcaacctacacgaacataaatgagagggaggacacaataaataagaccaccctacaacatcccacaacaaacgtgaaactagcataaattactgtcagtttctcaaagggatattcttctcaattatgtcaaggttgtgtagttcaagtctaatttgttctggagacagtgacaatggtaaagatatgatgatgacaacggcaacaacaaagatgagataaccatttaatccaagaaacaggactttactaatcggctttttttttggttgttaattcactgtcctgtcctttgcccattctgcagagcaattgttttgaaaattgcttgcttttttccaggtttgctcttcctcctcctgcctctcacttttttttaaatttttattattatactttaagttctagggtacatgtgcacaacgtggaggtttgttacatatgtatacatgtgccatgttggtttgctgcacccattaactcgtcatttacatgaggtatatctcctaatgctatccctccccactctccccaccccacgacaggccctggtgtgtgatgttctccaccctgtgtccaagtgttctcattgttcaattcccacctatgagtgagaacatgcggtgtttggttttctgtccttggcgatagtttgctgagaatgttggtttccagcttcatccatgtccctacaaaggacacgaacacgaactcatccgtttttatggctgcatagtattccatggtgtatatgtgccacattttcttaatccagtctatcactgatggacatttgggtttgttccaagtctttgctattgtgaacagtgccggaataaacatacatgtgcatgtgtctttatagcatttttttttcacatagaaaaaaagaagtcaaggctgtgggcacaaacgctcttagtctccctctcttccacctcaaaatgttatctttacccatccctaccagtggtgagaggtgagatctcatttatctctataaatgcatggtgctgagaagaaggctagggctcaatcatttttactggtgattttatcatcaatgaaattcaagaagaattaaattgtaatctgacctccagattacaaattgagggtatagcctaaaatatgaggatttcctaagaaaaaaaatccacccatgaaacaacaaggaaacttactgcaagtttccttgcacattttatttttattttaatgattaagatcaaaagccaataacaattttattattagaatttggaagagaaaaaaaacattgttagctatgtgcgcttgtgacactgctcaaattaaaagaggaaaactagaaacaagtagaatgggcagtgaaattggtcctaatgtggaaagcgtgatccacatgaatgtggtccttccactgtttgctctgttagttcccttcataacacttgcccactttagtccaagaacctaggaatcaactcagaatgagtgaagcacaccctagcatcccagagattctatatgcagaccaaatggagccttgtacttggtgtaggtgggctgtaggtgttgcatcagttagagcaggggtccccaatccagtactggtccgtggcctgttaggaactaggccgcacagcaggaggtgagcagtgggcaagtgagcaaagcttcatctgtatttatggctgctccccaacactcacattacctcctgagatccacctcctgtcagatcagcagtggcattaggttctcataggagtgcgaatcttattatgaactaactgtgcatgtgagagatctaggctgcgtgctctttatgagattctaactaatgcctgatgatctgaggtggaacagtttcatctcaaaaccatctcccccatcctccagtccgtggaaaaactgtcttccatgaaaccagttccctgttaccaaaaaggctggagaccgctgagttacagggttcttttttctttcccctcagagttcttggaatctttgttcagctgataaagtagccctggcgtgttgctaaatatccaagagtttagccttagagttcatcaacacttctgtgtttagtcctaactactcaaattcaggcaccgcattttaaaatccttgcttgctctctactttcagcatgcacatttacatgaagtgttttcagctcttttctcctatggctttgttttccattttctccacagtttttctcttttctgtagggaaatctaagcaaggggggaaatggtatgtagtgggtcgtgtctgaatgggcagccaagaaattccagtttttaaatccagttttcttctgtgttacatagcgagtcatgccacacctaagcctcaggtacattttcaacatcacattcatggaaaaaacattgcacacggttttgtttgcacttgttttgtctctaaaaggtcgtgtggcctgaaggcagaaacttttctattttgcttgaaaagggtagttatcgttcaagcatggttgcatagtaacaatgattgcacagaagtaaaacccagaatttctataagaatttcatttttatgtctagtttgagcttctgtctgagacttgacgtttttgggttcctcggtcctccaagggggacagggcactgctaagatgtcaacagtaaaatattcaggcacatgtgagatttttgctaaatacctcataaattcaggcagaaccttaaggttgtactgagctctgtaaggtagatcttgggaagaagccattagggcaaaggagagttggttactgtcacgacagtttcagaaactagtggccttcattgaagtagaggaagagggagtgaagggtgtgtgatgctgggtggtgcttgactttggggagcttcaaataaacagcttgaaagaaacttttaagagcaagtgcttttttttttgtcttcataggaagtgctaaaactaacaccaaactgcaaagctaccaatttatccctggaataataataacatctgtcttttatttagacctactatctactagccacatatgaatcattctatgtatttcatttaatatttacaacaaatctataagaaagatgttataatccttatcttacagatttactgaaactcagagattagacaacaagcccaaagtaccacagctgggaaagggtgatgggattttaaaccaggctagtgtgaccccaaagtctgtactttcctacggctacacattattgtaggaagcgtgttggagatgcatcaaggaccctggaagttgctgccggtgggagggaggatgaaaggcttcagtaaggcaagttgccgacagctgtcatcaacaagggtgatgacctcaggagccaatgccagaaggtacttctggaagccactagcagggaccaccacatgcagatgccctcagaggtgcagtgccagactgggagtcttacacctggggagggggctcatggcctccctgccactccagtcccagtgccccttggcctctaggatgagaagacagacccatggcctttcaaggtgttccttcttacaaagggcaaataacaaggcttctctttgaaacttgatgagggcttcaagaagaattaaactgtaatctgaccttcagattacagattgagggtgcagcctaaaacatgaggatttcctaagcaaaaacaccaacccataaaacaacaaggaaccttgctgcaaacttgggtactgatcacgggaggagaggataaaaaggcttggaagaagcaagcccttggcaaaatagaaaggatgtgagcaaagacagggaaaaaaagaaagaaaaagaagtgcttggaaatgacatgtaaggataaatataaattaagaaactgataatatgggagaaaaaattacctgactatcaaactcctgaaaaatagaagaataatttctagagaggaaattttcagaccaccatggggatattaagtgagacaccaagaatgttccttaaggatggacataacttgtttagtggagggtacaacttgaggaaatgggagtactttgatcagtgcaggacagggccattggctcaaatgcttagcacaggataggatttcccacaatgcttcacgccatgcttacaaagcctgatcaagccagggcactgctaccaatcccctgatggaggctgctcgttattttctgctcccacaacaagttctacaaacattttaagcagtcaacaaacttgtgttttaaactatgttatgctattcttctttagccaaggcaccatctgaggaagcagagtgaggcacacacagagctccatgccccttcctgcttgttggctgaatgctgcattaacccgactttctgatgtgctgggtaactgtccacggaaaagacaagacttttgtttttgcattattatattacttgtaatgatgacagagttatacattttttaattaaaaatactgaggctgggccgggcgctgtggctcacgcctgtaatcccagcactttgggaggccgaggcgggcagatcacaaggtcaggagatcgagaccatcctggctaacaaggtgaaaccccgtctctactaaaaatacaaaaaattagccaggcgtggtagcgggcacctgtagtcccagctactcgggagactgaggcaggagaatggcgtgaacccgggaggcagagctggcagtgagctgagatcgccccactgcactccagcctgggctacagagtgagactccgtctcaaaaaaaaaaaaaaaaaaaaatactgaccctgtaatgtatcagagtagcatttaaaaagtgttccttattctggttacttcacacattcacattattatcacaatcacagggggaatgccaagagttgcctctattcaaaaatattaaaattgtacgaattattaaagaaagtcatgaccatagaaagtatacgaatatagatatattggtattcctgacactggaatgaacatttaatttaatcttgcttgtagcctggctgtatgatggcagaagaaataaataaaaagaaatacaaagcagtgcatatggaagtggaggcaagacacaaacatggaaattcccctgatgacatcaaactatgttattgatcccacattcttgtacaaaggtggggtgtacagacccagaatggtgacaggcccgtgagcttaccttctgatggcaaaacagaccaggcaaggagggcctggcagccgtgggttatttattaactactgtgtgtattaaaggaacagcccagaaaccagaacacagacagaaagggaaagacttcaacctgaaagaggaaaacagtctcttccattagatcaagtaacgggagctttcagatacacttgagatatcttagcaagaaaagcagagaacaacaataaacagttgctcaagagtagccaaaaccaaggtggaaattaacactgaccataaagctgaccttgacaacgaccgtttttcctaatctcatcatctcttcttacgcactttatccaggtcaaatatgcctcacatagcccctgcagcacaaagagtgcttaataactatttattgaattgaaataaaatgaatactaccctttccatgaagccaacatcaatgaggctgaatcattaaattcatttgcctcttagtttcttgattatctccactatactgcatcccacttcagctactgaatcccattgtcacaccctgcccatgagtacactacctctgaaattctctttctgtgcctctttcctttcctgttagctctttcacacttttccagttgctcagccagccattttctcctggaaggtcactgaactcatcactcaccagcactcacaactgacccaaatgctcaaatggtgaatcactcctgtcatctgctccttctcatcctccactaaggacactggagataaactttatacaagtattcgcatgagacttcaaagttcataactcacacttttgcctcagaacgtcaatctttctttggttttgctctgcattctgttcagctccctgaagtggctatcctaaaacctttcccaatttatgcacacctcctaatcagctctcagcaaatgtcttcattattttgatgagagaggaaagcgtttctatccactctgtagctgcctgagggcagagctggggggatagaatttgatgcaaaggacacaatatgattgaaaaaatcttaaatatcaggaacccattttatatattcattttttacaatgtagaaagtaatgaaacgattcaaagaatctacacttggtggcatcttattctacttaacttgagctatacagagtgggatgagacatagagaacctaagaccaagtgactgggtacagagataataccaaaaaattctatgtgttgcagaattccctagaacttagaacgaagaaaatgtttcagaatttgaggcaagaaaatcttaggggaaatgtatatttcccttcagtgactgaaagaatgagatctttgacaaaactgtgcctacctgctgatctctcttcaccagcacctaccctgaaaacagattcagttcaaaaagggctttttgtgaaagacaccgagtattggaaaaaaaaaaatccgtatggttttggaggcttcaaatagccaattacctaaacaataatgctggctgaaagaaacatattttttttttttgctttatttccctgtgctgggttgaacagcgtctcctgaaaattcatgtttaccttgaacctcagaaggggaccttatttgaaaatagggtttttgcagatgtaattggttgagaggagatcatactggattaaggtgggatctaaatccaatgacatgtgtctttatgagagaaaggagagagagattcagacatagatacatacagagagaagatggaggcatgaagatggaggcagagattggagtgatgctgccacaagcccaggaatgccagaagctaccagaagctggaagaggcaaggaaggggagtttttggaaggaacctggccctgcctatatcttgatttcagactcctgatctccagagctgtgagagaataaatttctgctgtttgaagctatccagcttgcagtcatttattacagcagccctaggaaattcatacatcctcaattttctaccacaaactaaaaatttggagatttgtacatttctacctaggtcatgattgtccctgtcattgtttgtgacacgaactcatcaactcatcacaaatacacatttctcatacatgactgaagctaaataggtttttttatttatagctaaatatatgtgtgtcatgctttagctattaattttgggggtaaagcgggagaaagtacctttcttgtcttgtctgattatactcagcaatatgtgagaaacacagggaggttactagcgcccttttgaacaattttcctgtactcattcttccaactctacccatttaacctgtggctccttgcttgttaaaacatgagaggacgagtggaacacagctcttcaaaaacaacttgcaactcgataaattcaaaactaaaacaaaaggagagaggcgatgggtgtaatctgtaatgagctggaaattttgtaaattcccatcacttttcttcctgcctgttcttgttcctggcacccagctttacatacccacctgaggcacaagttgctgcccacataaaagcccgtaatccatctctggaaaaagttatcaagaggtcagctagctcctaaagtgatgctgcctatgggaacatttcagccagaactaaccatgtagatggatgagcatatgatcatgctgacatgctcatgtgacaatgggagcacagaggtatctgcccctctctctccatgtctcctgccgtatcctcatccctaacaggaacggctcttttagcctgacaatgtatcccaggtatgagagacaaccagaattaacaaggaaatggcatctttgcaccacagacactccactctgaagaaggtaagggtgcaatgcaaatcctgacttgctgatgtggtgtcaaggggccacagtcaaggggccacagcatgaatggacctgtcagctaaagcacatgaggtgatggcaagaagagatgaagtgggaaagagatgaagaaaaggaaggaaaaagagaagaaatgagggcgaggaggcttctgggaaataactcaccccttactgtaatcccgaattctcatgcgtctaccatcttcaaacacaaccttgccctgccagccacaattggtaagttcagggaagggtgcccagcctatcttggaacttttcaaacgacgaaaaagaattcaaccccctctagaagctgaatatgagctgtgaggttcagcaacctccagggatgatgtttctcagcacatgaaagaagccagcattcagtgagataccatcaagcaagcacacagagaggtaccagagacaagataagacaggtttggcagagttcgaacacttcactgaagctgttcctgaaaccagttgcatctctaccaactgtggtttatttactcaagttttcctcttaataaatgaatcgatacattcctttctttttctgaaactagttcagcttgggtttctattacttgcaaataaaagtcctgattaataatcaaacacaaataagtataaatcatcaattcattaatatgtatgtgcaatcatgcatgtgctacctgaaatttttttcttcacattggaacattgccacataaaatactttgcttttgttttactcttccagtttatttactattcttaattggacctgcgtaagttaaaaatagttacttcagtaaatgcccttgaagagtaatatgttgggagagaatcacttcctctactacatacctctactacataccaatatctttctcccttgcttattgatttctgaatttccacctaggcacttaggattaaggctatttgacttgatgaaagaggtaacatgttatgatttacagtcatttatttttaaatatgaatgaattaggtcctttggccaaacacttcaagaatataaaaacaaacaaaacagaacattacttttaagacagtttataacacagcatgcttagtgtatatattgttgtttgaatttttaatagattactcatgaactgtaaggtaccttctgtacctatattagcatatatagtaattatcaattacttgagatattcaatacagcagagatcacctagaactttatgaaaatttgaaattaacatatctatggccaacaagaagtagttaattttaaattcatacgtatatggccagcaagaagtaggagtgtcccagaggtcccatcttggctgtgcgactaaccagctgtgggacatgccataagtaagtcacatgataatagctctgcttccaatccagctctagtctatgtacagactagatgaatatatatattcatttaatcctcaaagcaaccttatgtgtttaggtaaaagaattattccacattttacagatacagaagatgaagcacatataagttaagaaacttgcccaagtgtcacagcgcagatttgactctggcggtctggatcaagaatgtgctcctgaccaccacgtgatatactcgtatctttattagcagggtcacggatgggacagcatcagtgctctaccaagaacacttcagatccctggagccttttcagtgcacctaccacctggttctgttctaggttcctcatttctaatcacttgtatctgcaactttcctcggaggactaccttgcagagaactagtgccacaaaatatacattcccctggggcaggtgaaaggtatggagatggggatgtccagcaaccttgcccagatgggacatgttctccatgggtttgggttgaggctggaactgcaacagaatcacactcttgctcagcttcttcttcccttgccttactctccccaccagccaacccccgacccagtgttttctcctggcacttccttagtaaatcaattgcacataaatccatgtctcaaggggatacatttcaaataagacaagcagcataatggtggaacatttttttggaacacattttattgggtttgattcttgctttattattttctatctctatttctttgtttaacttctcaccaactcggttcctttagcagtaaattagtgataatgaggcttacttataagattatttaagcattcaatggctggtccatgtgaagcaacaaataccttgtaggtgctcaaacaatagtactagtattactatcttaagttggatcctgagtttttaaatgcaattttaacattttacactcacagacaacaagtaagtctatacaagtaatccattcacaagttccaatatttcaaaatctaattttaaggcttgtatgtcacaaatattcaggcaaaaatatttccataaatattaatgatattgcaaactatgtaatcatgaaatatatatttgtgagtgccatctcaatatattaaggatttgattttctaatttttatgtataagacttagctatattttctctacagagatctttttctgaaatatggcatccctcttttatcaaaggcaacttatttacattcacttgtgtatgtttatatatagttttaagtataaattttccttatcactttgatttaaaaatgttttcgttcaagagatgttcctatgaatgaatgttcattcttggactcaaatgacaactccccacccaccaacaaaagccccacctatatctacatactatgtgctcttcgttaggtgctgagggaggaaataatgatgcatcacacatgaatctgacagtcttatggatcaaattctagaacagtagagaagctaaagctatataataatcattttctgttgctttccagcatcaattccccaatattttcctatcaggaatcctgaacttccgagctacatcttttggctaagaatgatccccaacttccttgggtggcctaagcccacttatgtaatcccatccttgatatgagctgaaattgatccaatcacaaggaatctgtagacttttacatggtagctaaaagctatcctctcctttcccctggatgtgaaagagaaactgtgctacatcagaagtctgtgctgccatttctctaccatgaggcaaaatagcctaaggatgaagataatacaatgttaagggcaagctcaaaatgaagctacagctcttttttttttttttttttctgtgatggagtctcactccgtcacccaggctagagtgcagtggtatgatctcagctcactgcaacctttgcctccccggttcaagtaattctcctggctcagcctaccgaatagctgggattacaggcatgcaccaccacacctggataatttttgtatttttagtagagacggggtttcaccgtgttggccaggctggtctcaaactggctggtctcaaactcctgaccttgtgatccgcctgcctcagcctctcaaagtgttgggattacaggtgcgagccaccgcgcctggccaaagctacagctcttgaaatatcatgaacctctaggctaagggatttgcttcaaataaatccaagcaacattcagttgaaataaaaatgggtttgatgatgataataactgtcaatgacaattattttcttcaatcaccctttatttgtttcttcccgtcttcagacaagcaacgaaggctgaggtgactactcaaatctggattaacccatttcttgtttgctctgagaaatgagcactggcagcaagcaacactttctttttttttttttttttttttctaaatgggaaataggttaaggtggaaattttaattcggctatctggaaaaatatacatataaaacaaagcattcccaaaataactaatagctaagcctggttctataatgtgcttgaaaaacacttttttaagagaacaatgagtatttacaacatgctaaaacaacaagactcattttttttttttttttttttttttttgagccggagtctcgctctgtcacccaggctggagtgcagtggcgcgatctctgctcactgcaagctccgcctcccgggttcacgccattctcctgcttcagcctctggagtagctgggactacaggcgcccgccaccgcgcccggctaattttttgtatttttagtagagacggggtttcatcgtgttagccagaatggtctcgatctcctgacctcgtgatccgcccgcctcggcctcccaacgtgctgggattacaggcgtgagccactgcgcccggcaagactcatcttatttcccatttttcatcttcaaagtgtcctctaagttgctttttagtcatagctatcatcctaatccacatctctcattaatcctataggagttataacaatagtcatctacttatcttcttggatgttgctattggtctgaatgtgtcccccaaaaattctcatgttgaaatttaatcatcaatgtgatggtattaagaggtagggtctttaagaggtgattacatggatgggattaaggctattacaaaagggtttgaaagactgggttcattctcatgcccttctactttgtaccatgtgaggacacagcaacaaggtgccatcttggaatcggacaatagctttcaccagacagcagacaccaatgacagtgccttgaccttgaacttcccagcctccagaactgtaagaaatacgtttgtgttctttatacattgcccagtctaaagtattttgttatagcaacacagactaagacatgtttagtaacttgccttttggagaacactctatttcccaagcagatgatcttcccaaatcgcacttttcaccttgttaatctgaccaatcatattcaatggctccacactgcccgtcctgtagctgataaagtcagtacttctttttctgacattcagggctcactgtcattagctgcatgttacccccatggtcccatatgcatgaattccagtcatagaaatcccttccctttatgcactatgttcattcttacacttacgatttcattcgtgctgttttccccatccaataagtcccccttatgcaactttgcttatttaaatcctattcatttttgaaagctcaagttttgttttccctggatgcttatgtgattattttggctcacatttgccctgttgctcagaacttctttcaggaggcagtactatgtggtagcttaaagccaaagacttggtttggaatccaaggtctgccccttactagttgtgtgacctgaggcaaattacttaaccttactgaaactcagttactttagttataaaatagaaatacaaatcagctttttttttttctttgagatggagtctcgctctgttgcccaagctggagttcagaggtgtgatctcggctcactgcaaactccacctcccggattcaagcaattctcctgcctcagcctctcaagtagctgggattagaggcatgtgccacaacacccagctaattttgtatttttagtagagatggggtttcaccatgttggccaggctggtctcaaactcctgacctcatgatctgcctgcctcagcctcccaaagtgccaggattacaggcgtgagccaccacgcctggcccaaatcaacttttaatctattacaaaaactaaaggagaaatgtgtctagcacataatttgttgtaaacattagtttaaaactatactcagttctgtacaatttatcacatatgtaacttttttactgaatgcaattatttcatatgcaaattttttctccttagttggagtaacagttcattgttttactacttgctgccaattcattacatggggctgactttttttaaagcctttgttatttgtgtatgagtgtctgtgtgtgtgtaattaagaaaacacaacatgaagattagatcttgctattctttgacatgctattgcatacatctctataggtatgagctgtttttaaatgatacatgaattgttttttagtttaacctgtatttcaaattccagcatttcacagagtcaaatgcacatacagttcatacagagtagatatatataattttgctttttcatgctgcagaaaaaatgattcagagaacttttccaatagttttttggtggtttcgtttgtttctttcagtcaatacatgcgcttcaattcagcaatacatcaaaggggtgagtatatctgaatttctgccagtcctatgcaggatagatagatgcacatgtactaacatgttttatggaggatgaaaaactgcagaaatgggcaatatacaggaacataactccacatcacagaacgacaaaggagacagaactatgcactaaaaaaatgcttgagtactacaactttattttatgtgacccatcctcctatcctggggaagtaaagattaacagaagaaattcaaagcaacattaaactaaggaaagataagtaaacattaaattaccaaaataatggagaaattatttgcaacacttatatcaaacaaaaggcttaattcccttaatataaaaagttctgataaaacaagtcaaaaaacaaaatggtgaaaatgggcaaaatacatgaatcaaaacttcatggaagtctgggcacagtggctcatgcctgtaatcccatcactttgggagactgaggtgggcggaccaccagaggttgggagttcaagaccagcctggctaacatggtgaaaccccgtttctactaaaaatacaaaaattagctgggcatggtggtgcacacctgtaatatcagctactcaggaggctgaggcaggagagtcacttgaacccagaaggcagaggttgcagtgagccgaaattgcaccactgcactccagcctggtcaacagagtgagaccctgtatcaaaaaaaaaaagtccatggaaaagagatccacatggttacaaacagagaaaaaggtgttaaataaatatattgaattcaatatactgaaatgaaaacaacaatgacatacctatcagattggcaatattcacctatcagtttggcaacatttaaaaagtctgtcaataggcgatttgaatagaaagaatataatagcataaaaccggaaataatttaatattgttatttaaattatattaaattcagatattcatacaataataaaatggatctatacatactgaaggggaacatttttcaaaaggtactgtcaaatattaaaagcaagtgtcaaaatacatagtgttatcctatcaggatctaaaagttaaaacaagaaagtcatatatacatataagatatatgaagttttttctatatctattaagagaaaggaatgaaaatataaacagaaatagacataaaggtattgatttcatatgtatagacaatttcagaaaaatacaagaaaacatttatgatggctttataagcagtgacacttgagtagtattaatagaagttagggcattttacttttcactttacaatcttttatatttgagtttttacagtaagcaaatattaattttacagtgtatttttaaaaattctggtttcattgcttactaactgaatggcccatgacaacttgacaacttaattaactgtatgagtctctgtttcctaccacacaaggtgatcatgaggattgcatgagataaaaaatcccacacaggagaagaaagtcttctcagtaaatgacctgaggtcagctggttattcatatggggggaaaaaaatcaatcttgactctgatagcggcaggaggcagacaaattcctaggcagataggggcgggtccctggtgaaacctgaccttcaaactaaagacaatttaaagcctgaaaaccaagccacaagtcttggataaatccacagactggattgagaacctctgttcccatttggcgcacattcctttgattgatccccacccttcacctatttaacacatatctacccttccctaattggtgttttacgctgttgtaccacctttgagtggtgtctttattttagccttttttgcatactcacaaaccaatccacacacattctcctattctgaactcatgaaagtcccagactcagccacactgggggactgaccacctttgagttgagagcactacccaactttgggtaaataggctgcccaactcgtgtctcactctctgctgaaagctgtttcatcactcagtaaaactctccaccctgctgactcttcagttgtccaagtaatctcattcttcttggacatgggacaagaacccaggacccgccaaacagcaggtgcaaaaggagctatgtgacaggaaccagctgccctatgtgacaggaaccagcagcagagccaggccaacccaggggccacggtccagagtggggcaatgggaacaaatgagcagaggttccatcggccacagaattttctggcttgcaaagtggcatcgaaaaacatcttgtgtcatttcctaccccacactataaactataaaatgtcaattccaggtaaattttaggtttaaatgtaaaagcctaaaataatatttgtagcagataacatagaaaaatactatcatgttgttggattcagtgttatagtgtttttgagaatttctgtgtctacatttatgaggaataatggtctgtaggttcttttttgtgatgattttgtctatctatattatctgcttaatgctggcctcacagaataaattggtaagtttttcttcctcttctaaaaaaaaagaatagaaaagaaaagaattccatacagtgcagggtatatataaagcatttatcctattagttctcaaaatgttagttctcataatctccatccattatctgtctataatatttccttgaaaactacattcattttatatttgtggtaagctatcatacttaattagataatagtctccaaaagcctttgaaaatatttacttccctattactgagtcaatgcaacataatttatctcctcttattttttaatgtaaaatttgtatttagagtaataactgactaggaaggattttgagctgtgtttctagaacaacggagttttcttctgtaaacccaattatatcctctgagtttttaggcctttagaataactaaaggagtcttttttttttctttaacctaaatctgctgtcaagattgacagaccaaatgacagatgccagtacatgtggctttacctccaaccagttacatctcctgatggggggatcccagcaaagacaccaagacccttctttggttctgtatcaaacattttctgtttctctggattacattttgcttttttggtctcctttgaagttatagttgtgggtctgtttttttgttgttgtgttgttgttgtgggggatggggggattttttttaatgatttcaaggcctaataattctatccaagaaagggcagaacttaattactaacacatgattctcatgataaaataccagagcccaaattagaagaaagaaaaaaacttaggtttttacttagtaaaatataacttacatataaaaataaccaatttaaatatgcatgtctttaaactaacttccttttaataaaagttttcatatcctgaaacttctagtacctgtgtttatatgtaatttgtcatggttttggcaattttaaataaagtatattattttagcacttattcatcataatttaaggattttatttaatgaaaaaatgtaataaatggcccatcttttttttctagcagcaggggaataacatcaatgacattttttatttctctgagcatagtctaaaggctaaatctaattgtaggcaatacaaattaataatattgcttcatgcagaattctatgttggtttttatccaaaggtctagaattcactggccttttaaatgcctgcaaagtaagttctgttctatctggtaatgaaagcaggagaaatttatgataagtggtctctaaggtacaaaataaatttgctttagaaccgataataagtccaggtctttaaatcatatttttttgccccttccatgtacgatctgcaagtagcacagcagagctgttttttgattaactagatgcataatccacagtgccacccattcaaaatgcatttgtcccaggaacaaaataaattttttgaacattgtttacaactccccattattggcttgagtctagatttgagtctctcatccaacaagcatttactaaacgctataagaaactgtacccaaggctgcagatctaagccacaattggatcaattgtcaaggagttaaagttttatgatcacgtaaaagataaattccactaaaaaaggtgctaatatacaataatagctatcgtttgtgagtgtttatatgtaccaaggacattacacaagttatcacatttaatctttatacgacactgagactggtattactgtcttcattttgcaaccaagaaaattgaggcacaattaagtaaactgaagaaattaacacgtattcttagtggcaggcttagatttgcaccctggtccaactggttcaagtttcattctccgggtgactgattgtctacctttcttatctgtacaggatacagtggagatacaagggagggagctatggtcagaaaaggaattaaaataaggttcaaaataattttgtactttaattttgtaggactgtttcaaaatgtcatttgggctgggtgtagtggctcacatctgtaatcccagcactttgggaggccgaggcagacagatcacttgaggtcagaagttagagaccagcctggccaacatagtgaaaccccatctctaccaaaaatacaaaaattagccaggtgtgttggtgggtgcctgtaatcccagctacttgagaggctgaggcaggagaatcgcttgaactccgaaggtggaggttgtagtgagccaagattgtaccactgcactccagcctgtgcgacagagtgtgatcctgtctcaaaaaaaaaaaattatttgatttattttatggagtgttgccctctagttggaaaagggatagcaaaaatatttaaaagactatgcttaacttcttgcagaatttgtggtgaaccattgctacaatgaagaaatacagtcttttataagtcatgaaagttaaacaaataaatgaataggagtggatgacttttttagttctcactcttctctcttttttttttcttattctccatgtgtttgaacatgaggcccccatttaaaaagttctcatttatagaacagttccatgaaaaagagaaaacaaactaaactcaggctatggctgcattaaataaacactggccttcatgtccgtgggtgaatctccatcctaggtagatacccccgactccaggaagtctgtttatcttagtaaagaggttcacactgaactcactttttcaaaggtcctaaatctcctgttgctttccagatactgcataagaaagtattttcctatagatgtaggtttcttgagaggaaggcaactgtcttattaatctttgggtttatttgattgtttgcattttatttaatttgcaaagttaacagaaaaaataatgtaacatcattcatataacaaccacccaggattctgtaatttttactttgctatttatcttcaccctaacttaatccagtacatttcagtgcacttcagtgttcccactgggtactcaaatgttgaagtgacctgccaaactcaaagatcaaggtgggtcccaaggacaaacgcaagggtcattagtcttacaagtctgatttgtttttttccctaaacttgtcaacatctcctttaagttaagcctaaaataacttttgcaattaatactttttgtcagagtttaaatattctcaggtatgcagccataaaaactacattaaaatggatgtacatatgaagaaaacatataaaaaacacgggtgatttattccatattgtataaaaaccacacttaatctaaatgttgtaattcacaacctgcataagttttcaaagaaaaatttacagtttcaggaatgtggccaatctcttttcttggcagataaaggaagaaatctaacaaaagagcatataaatcaagttatgataatggttccaaaaaagactgcattgtcttcactccccgctaaaccagcatttctttttggatttttactaaagtcctaacccctaacatcaaagaaggtgccaagtctttcatcttctacctgcacagtaacccttgtgtgtattctctccttatttatttttattttattttattttttatttttccaagggttacgggggcacaggtagtatttggttacataagtaagttctttggtggtgatttgtgagactttggtgcacccatcacctgagcagtatacactgcaccttatttgtagtctttttatcccttgcccacccccaccctttcccccaagtccccaaagtccattgtatcattcttatgcctttgcgtcctcatagcttagctcctatatatcagtgagaacatacaatatttggtcttccattcctgagttacttgacttagaataatagtctccagtctcatccaggttgctacaagtgctgataattcattccttttcatggcttagtagtattccatcatatatatagatatattccatcatatatatatatacatgtatatatatatacacatatatatacatatatatatatatacatatatatatatacatatatatatatatacatatatatatatacatatatatatatatacatatatatatataccacagtttctttatccactcattgattgatgggcatttgggttggatccatgattttgcaattgcgaaatgtgccgctataaacattcgtgggcaagtatctttttcatataatgacttactttcctctgggtagatacccagtagtgagaccaccagatcaaatggtagttctacttttagttctttaaggaatctccacactgtttgccatagtggccttactagtttacattcccaccagcagtgtagaagtgttccctgatcaccgcatccacaccaacatctcctgttttttgattttttgattatggccattcttgcaggagtaaggtggtattgcactgtggttttgatttgcacttccctgatcattagtgatgttgagcgttttttcaaatgcttgttggctatttgtatatcttcctttgagaattgtctattcatgtccttagcctactttttgatgggattgtttgtttgttttcttactgatttgtttgagtttgttgtcaattctggatattagtcctttgtcagacgtatagattgtgaaaattttcccccactctgtgggttgtctgtttactctgctgactattccttttgaggtgcaaaagctctttagtttaattaggtcccaactatttatctttgtttttattgcatttgcttttgggttcttggtcatgaaatccttgcctaagccaatgtctagaaaagtttttccaatgttatcttctagaatttttatagcttcaggtcttagatttaagtccttaatccatcttgaattaatttttgtataaggtgagagatgaggatccagtttcactctcctacatgtggctagcttattatctcagcaccatttgttgaaaagggtgtcatttacccactttatgtctttgtttgctttgtcgaagaacagttggctgtaagtatttgggtttatttctgtgttctctattctgttccattggtctatgtgcctatttttataccagtaccatgctgttttggtgactatggtcttatagtttgaaatcaagtggtgtgatgcctccagatttgttctttttgcttagtcttgctttggctatgcaggctcttttttggttccatatgaattttagaattgttttttctaattctgtgaagaaagaatgatggtggtattttgacggggactgaattgaatttgtagattgcttttgacagtacagtcattttcacaatattgattctacccatccataagcatgggatgtgtttccatttgtttgtgtcatctgtgatttctttcagcagtgttttgtagctttccttgtagaggtccttggcctctttggttaggtatatttctaagttttttgtttttgtttttgtttgtttgtttgtttgcagctattgtaaaaggggttgaattcttgatttgattctctgcttggtcactgttgaagtatagaagagctactgatttctataccttaatattgtatccagaaactttgccaaattcttctatcagttctaggagctttctggagtcgtctttggggttttcaaggtaaatgatatcaacagcaaacagggacagtttgactttctctttactgatttggatgccctttatttctttctcttgtctgattgctctggctaggacttccagtactatgctgaagaggggtggtgagattgggcatccttgtcttgttccagttctcagagggaatgcttgcaacttttcctcattcattattatgctggttgtgggtttgtcgtagatggcttttattatattgaggtatgttccttgtatgccgactttgctaagagttttaatcgtaaagggatgccagattttgttggatgctttttctgcatctattgagatgatcaggtgatttttgtttttaattctgtttatgtgctgtatcacatttactgacttgcctatgcttaaccattcctgcatccctggtatgaaacccacttgatcatggtagattatctttttgatatgttgttggatttggctagctagcattttattagggattttagcatctaagttcattggttatatcggtcagtagttttctcttttggttatgccctttcctggtttgggtattagggtgatgctggtttcatagaatgaattagggagggttctccctttctctatcttgtggaataatgtcaaaaagattggtaccaattcttctttgaatgcctgctgtgaatccgtctggccccggacttttttattgttggtaattttttaattatcctttcaatctcactgcttgctattggtctgttcaaggtatctaatttttcctgatttaagctaggagagttgtatttttccagaaatttatccatctcttctaggttttctagtttatgtgtataaaggtgttcaaagtagccttgaatgatcttttgtgtttcagttatcagttgcaatatctcccattttgtttcttaatgaggttatttggattttctctcttctaggttaatcttgttaatggtctatcaactttatttatcttttcaaagaatcagctttttgtttcattaatgttttgtattgttttttgtttgtttgtttccatttcttttagttcaggtctgatccgggttatttcctttcttctgctgggtttcggtttagtttgttcttgtttctctagttccttgaagtgtgaccttagaatgtcagtttgtgctctttcagtccttttgatgtaggcatttagggccgtgaactttcctcttaacaccacctttgctgtatcccacagattttgataggttgtgtcattattgtcattcagttcaaagaatttttaaatttctatcttgatttcatttttgacccaatgctcactcaggagcaggttatttaatttccatgtatttgcatagttttgaaggttctgtttagagttgatttctagttttattccactgtggtctgagaaagtgcttgatataatttcaattttcttaaatttattgaggcttgttttatggcctatcacgtgtcctgtcttggagaaggttccatgcactgttgaaaagaatgtgcattctgcagttgttggatgaaatgttctgtatatatctgttaagtccatttgttccatggtatagttttaatccattgtttctttgttgactttgtcttgatgacctgtctagtgctgtcagtggagtattgaagtccctcattattattgtgttgctgtctatctcaattcttagttctattagtaactgttttacaattttgagagctccaatgttacgtgcatgtatgtttaggattgtgatattttcctgctggacaaggccttttaacattatttaatatccctctttttctcttttaactgctgttgcttgttgctttaaagtctgttttgtctgatgtaagaatagctacccctgcttgcttttgacgtccatttgcatgaaatgcctttctccacccctttactttaagtttatgtgagtccttacgtgttaggtgagtctcctgaaggcagcagatagttgattggtaagttcttatccattctgcagttctatatcttttaagtggagcacttaggcgatttacattcaatgtagtattgagatgtaaggtatcattgcattcattgtgctatttgttgcctgtgtaccttggattttttgttttttgtttttgctttttaaattgtatttttgttttataggtcctatgtgatttatgctttcaagaggttctgttttgatgtgtttctggatttgtttcaagatttagagctccttatagcagctcttgtggtgcttccttaatagtggcgaattctctcagcatttgtttgtctaaaaaagactatatctttccttcatatatgatgctcagtttcactggatacaaaattcttggctgataattgttttgtttgaggattctgaagataaagcctcaattccttctcgcttgtagggtttctgctgagaaatctgctgttaatctcataggttttcctttataagttaactggtgcttttgtctcgtaggtcttacacttctttccttcatcttaacttcatcataacctgatgatgatgtgcctaggtgattatctttctgtgatgaatttcccagatcttctttgtgcttcttgtatttggatgtcgaggtctctagctaggccaaggaaattttccttgattatctccccaaatatgtttccaaacttttagattccttttcttcctcaggaatacctcttccttattcttaggtttggtcatttaccataattccagacttcttggaggccttgtttatattttcttattttttctttgtctttgttggattgggttaatttgaagaccttgtctttgagctccgaatttctttcttctacttgttcaattctattgctgagactttccagaacattttgcatttctataagagtgtccaaggtttcctgaagttttgattgtttgttctttaacaatctatttccttaaatatttcttccttcacttcttgtattgttttttggattttcttgcctttcgctggtgtctccctgattagcttaataagtaacctcctgaattcttcttcaggttaatcagggatttcttcttggtttggatcgattgctggtgagctagtgtgattttttgggggtgttaaagagccttgttttgtcatatcaccagagttggttttctggttccttctcatttgggtaggctctgtcagaggaaaagtctacgggtgaaggctactgttcagattattttgtcccaggggatgttcccttaatatagtactctccccttttttctatggatgtggcttcctgtgagataagctgcagtgattgttatatctcttctgggtgtagccacccagcaagtctaccaggctccaggctggtactggggtttgtctgcacagagccctgtgatgtgaactgtctatgggcctctcagccattgataccagcacctgttccagtggaggtggcagggagatgaaatgggctctgtgagggttcttacctttggtgatttaaagttctatttttgtgctggttggcgtcctgccaggaggtggcactttccagagagcatcagctgtggtggtacgaagaggaagtggtggtgggcggggccctagaactcccaagagtatatagcgtttgtcttcagctaccagggtgggtagggaaggcccatcaggtgggggcagggctaggtgtgtctgagctcagactctccttggaagggtcttgctgcagctgctgtggggaatgggggtgaggttcccaggtcaatggagtcatctacctaggaggatcatggctgcttctgctgagtcatgcaggttgccagggaagtaggggaaaaccaacagtcacaggcctcactcagctcccacacaatctgaagggctggtctccctcccatcatgcccctcccccaacatcctgtttccaggcagtagatgagcacggcttgagaacttgccccagactagccacttcccaggtgcagaagaaaaaggatttggttcttccctcacccgtggagtctgcacaccagattcgtgcccttccccaggttctggccaggaggcttcttgctggattcaaattgttacaaagttcagctggggacttccttctccctgtggcattttaccctgtgcctctggtcaccctcccaaaagatccctgtggtaccaagcagggatggcatgcttagggacccagtgagctcccaggtcctttcccactgcttcctctatccctgtattttgctcagctctctaaattgactcaactccaggtaaggtcagaaagttctcccacaaactagaccttcaggggttggagtctatcaccattctccggtatgtaggctgggcctgcttcttatggcaggagcaatggcgtgctaatcccaaaccaagcctcaagtggccttacagtttctactctctcttttggaactgtgccatcaccatttgaacaagcccagtctagacttctagagaacaagatactataaaggagagcccacttgttcagctgaggcctcctagacctgcttacaaccagctgactcccaacaagaagagagagcccaggcactattagaaagctgcatacccaacccaagctggttacatacctgtttgtagcccagctacaaacagaagaaccaccaagctgacttgtaaactataacatgtgcttcttcatttaaagcttatttaaagttgttgaactttgggttggtttggttcacagaaatagctaaccaataaaaatgaataaaaaattctggtatgttcagaaaatgaaattcaaagatgaaaatgaacacattattttctacaaacaacatggccaacttgcacatcccgttcggcaaaaaaagccagacacagaagagcactagcgtttctgtctacctacaaaaaattcacaacaggcaaaattagtaaagagtgatttaagtcagcaaactggtgacctctggggacagacagtacctgggaggggacgcaaaggacgcttctgagttgatactctattcttgatcttgattctggtttcatgagtcagttcaccttatgaaaattcaatgagttttatactgtttgtgcacttttatctaggcaattcaataaaagaatgttttaaaaagaaatcggtaaagggttgaacagcaaactgacagaagagagcataaaaagagcataagcctcactagtagtctaaggaaagcaagccaaagcaatcagaaatattagttttcatccattaacaggcaataaatttaaaagactaaaatatccagtgctcaagaagggatgagaaaatattcacatacagctagtgtgtgaattttataaagtaatctgacaaatatattaaagtttgaaatacatgtaatcttgattcaatccatttagcaatctagcgtataggaatgaaaccaccaatacataacgatatacttacaagaacatttactgaagcaatgtttatggtagcaaaaagcttacaacatcttgaatgtgcatcaaaagtgtatggctgcaaaaattatggtttatacataataggagattaaattatgtaaacattaaaaataatgtgttataatattttgtccagtaatgatgagggcattaatttgaaaagcaaaattcaaagtaatagatatagagtgatcctaatttgtttacaaataaaagagattaacccaaaaaaatcctatataaatgttgtaaatgttttcttcagcataaagttttagaaaaatacaaataaatctgttagcattagtcacctcaggaaagtagaatttggagaaagagggcactactactttttattttatatattttttacttttttacttattatgagaagtatatattacactggaaatgaaacaaatacacgttagaaaatattctcatattagaaaataaagtgttctctagagaaaaaaactccttaatctttcaaatgatgagagataaaaactcaacagttgtgacctctttgcaagattgttaaaagccagtccagaagcacatcatatcacatatgaattttatctgattattaattcaagctgaagaagaaataaattatcccataaaatatctcttagcacttggagtaaatatagtttgaaaaaaatgtgactgaactaacaatcttttggaaaattctatttgctatatgagtggaaaatattactcagagtactgacatttcctgtttaccactgaaaaaagaacttagttctctaaccttgtaaatgtaattcaactgtgaatcttacaaacacttacaataagagtttgccttactaaacaaatcaggttcatctggcagtccagttcttaaaggaactaaactttatcttaaaaggaagtatagaaataaaaaggaaagatagtaaaagtaatgaattccaagttataaaggaactaatataccatataaaaatctagttaaatataaatatttcaatttttccctcttttaaatgtctcagaaaagtcaatgaaatcaaagtgagtgtccagctgttctaaattactggataataatatccaagtaatttagagctttttgaaaagctttaaaaattatttaattatagatagttaagagatgataaaatggagatataaatcttaggtgtattttttgctttgaaattgttttatatttcatattttgaaggagagatagagataagtaataaaaatttatgacctaaatttcaatctcaatttcaattaattaactggatgagaaaggcagttttttcctctggacttcattttctgcaaccatgaaataaaatgttgacaaaagcaaacagaaggtttagactgttagaggaaagaaggattactataaaatgacaatatttcacatctattgtgcctcaggtgttccataaacattttccaaataactttacagtagtattgtgataggtcatatctccattttgccaatgggaaaacggattcagaaaagttctgtaaattactcaaggtcatataagtggtaaatggtagagcccggatttgaaatcaggtctatgtgaccagaaagacaggaagggcccttcaagcttaggttcatataggttaaataaagtgttaaagctccccctactagactaaataaatggtgttcataatacacgtactaataacacctatgtgtgtagcacatttgcactgaaaagagttcaacacagtaattcagatctcaggcattagaattaaacaaggctaggttcccactctatgtttaccacatctcgctccatgacattagagatgacattacatttttctgagcctgttttctcatctagaaaatggcagaggtagtaagtaaagcacagtgtttggtacatgatgagcaatccataaatacttgtcttctaaaattcaatattttaaaagcattttcaaagtaatcttgagaagatatgaattgttatttttatgttatatatgggtatatactaacaccaaaatcataaaagttaagggaaaagtaaaggggcatattcaaaaaccctgtgtttagtttccatcctaaaggaccaattttacattgaaggtatgaggctaaaatcagctattatggagaaaatacccaattttattaataaaggtaattttataaagactatggaagattgtgatgactaagagaaacaaacatacatctttggaggatgaccttaaagcagtattttttcaaagcttggtaaataaataaataattccttgagaactttctttaggcccatgcttcagtaaaatagaaagcaaaatgagacaaaccttttctataaaaaaacccacatatatcacatacatttaaattattaagaaaacacagctgacattagcgatggaaatggacatggctctaacaaactccactgtgaagtcactggctctagggaagaccttgtcatttccacaagaactgaaaggccatcgtcctcttaggaactgcctgcagctttccttttttttttttttctgaggcaggatcttgctctgtctcccagactggagtgcagtggtgagaaaacggctcactgcagccccaaactcctgggctcaagtgatcctctcatttcggcctcccaactagctggtaccagctaaattttttaaatttttctttagagacaagaactccctccattacccagggtggtctcgaattctcctcccaagatgctgggatgacaggtgaaagccactgcatctgcctagcttcactttaaagaactaaatggttacatgcacatgtgtgcaattaagaggctggttttatttctattttagagaatatgatacaaattgccagagttttttttttctttttcttttttttttttttttgagacggagtctcgctctgtcgcccaggctggagtgcagtggcgcgatctcggctcactgcaagctccgcctcccgggttcacaccattctcctgcctcagcctcccgagtagctgggactacaggcgcccgccacgaagcccggctaattttttgtatttttagtagaggcggggtttcactgtgttagccaggatggtctccatctcctgacctcataatccgcccgcctctgcctcccaaagtgctgggattacaggcgtgagccaccgcgcccggcccagagttttaacaataaataaaatttgttaaagccacacaggagtaatactcaagataaaattagtgaccccatttaggtattaaaggcctcagacttcagtcctcccttcaatattacaaaatggggactttggtatggttaaggtattctctgatcaaaaaatccatttatcctgacaacaagtaactgcagggattctgcattctaatttgatgtattagactatgggtttaaagtttagccagcagctgttagctggctttagtatgggcagatgttggttgtatcaagtattctttgccacatgtgggaccaagtggagcttcctcagggaccaatgtgtaatacttcagaatgttaatgttgaagtcagcgtcctatttttttagtcaatgaatgctgttttctgtagacctaacagtcacgtttggaggctaaaccagcaaaagtgtttatgtctgtttactttttaaatagatcatcttccccagcaatgggcaaattacttaacctttctgggcgtcagtttcctcatctgtaaaatgaagatagtaacactgcctacatcataggttgtttatgaggactgacaatccccaaattggacagttctctcaataaatgttggttcttatcatctaattttatcttgatgcttaagcacatcaacagaggttgcctctgtttatgcctctgcagtcatgctcaccacaccactacttccacctacctaaaattcatctactctgtgctttccccaaattattctttccatatggcatgggactgtgcccaaacaatcactgctttctcctttcttcttctcctttactgccactatcacatagcttgacatgaatgttcattcggcagctttgggggctctctaatatttatgtgtacatctcttcctcccatccagactgtgaggtctttgggctgaaaaactacgtgttatattgctctatatacaagacatagcactgaatgctgtccaaagcagacactcactagatactctgattcttcctcacgatttacaggtgtagtgtgaaggaatgtttccagctgattaaaatatatagtgggcatatcgagtatacatctgatttctgaaacataccataaaccaaagtgtctctcctatattttcaacatttcctcaggacaagctaaagaccaagaggctatgggagcattattaacagttacttacatggtcttgccttcactaatttttataattccacacagagcaattcagtgagatttcagtggtgcaaagatctctctttattggtaatgagatgcattttaaagtcagtgaggtggttttcagtgtatggttcctaaaatggacccattacattataaacatgaatgtatagcattaacctccatgtatatatttcactagagcataaatcttttttctgtcttagaagaaattaccccttctatctgaattagttcataaaactcagctgtggttacaggaaacagctggtgtttttgcctctccattttcaccaaaaaaaaaaaaacagcaagcaatgcatcaaggaataaactatctcaaaaccataaactgcttaactcttcttcatgtgcatgcaactaacatagtatatttcgatagacattcaatatgtgttcaccctttacaatatttgttgaataaaatactttattactataataagatgtattactgctacttaatatgaagggcattttactaggtgccataaaatgtaacttgacaaatgcaatctcctgggaaattttaatatatataaaacagttattttcaaacagagggtttatatcagagtcacttggggaacttttcccaaaacacagcaacaaccactatcatcacaaaagcctggactccctccctaaagattctgattctaacatgcaccctaggttatgaatcaagaaaaatacaataatagctcaatgaagcaaatctcaactataacatttttgatatgttagtgtagtatttttcttcataaaagagatatactattaagctcttatatataatctgaatttttgatgcacaaatacattcatgttaaatgacccaaagaaagtcttgataccttaaagaaggtattgataactcagtaaaggtgtgaaaaagtatcctctgatttatgagttttataaacttgaatataaaatatctcacttatcaaaagtgagtttccacatataatttttcctgctaatcactaaaagctccatttataaaaactattaaaaatttcattgttgtatcatagggcaacagatatcttcctgttttgataagtatacaattgtttccattgaaaatagaaaacaaaaaaataaaattgacctgtgatatcctatggcaacacacaaaaattatctgaattcctttcaaaattttaagaaaatcttttattataattttattcgtatatatttatacacttattctataaatttccaactttgtcaattccaataatacaatgaaagaagtcacagaattttaagggttaaagatcacttagaacaacttctcagttatacagatttatagtctttgagttgttattaacatgaatttggtctcttgagaggcattgtggtgcagtcacattaattttcagctgaccaaaggttaaagtaagattagaacccagactgtcagtctggttcttaggtcttttctgagatgccaacacttctagttttctctccaacaacatatatctcttcgtgttttagagcactttaggtattttgtcataaatttaactgccaagtgaaaaatgttagtatttcttctcatgagtagctttttacagatcgttatagcaaaggggaatcaaacagtccattaccattaatttcacttaactccaaagaagatcttagctcagcttaaacagaaagcttttggcttgcttccagcaatctttatgctacaagacgtgtccaataagattagcagtctcactaacttctttccacggaaattatttccaattcctttctccctaatatcatctccaagatttaacatgaagcctttttgcagccataatctttagcctaatcatcttactctaatcttactttaaagacttcctaaatcacaaatgaaacttcgtatgtgtcatccattgttaatgagcatttgtaatccccaagggtgaaatcacccagtctctgtgtactcatatgtgactagatctaagtcactttccaggatctctggactgatgtctctggaagattctggtggggtctgctcacacagtcctgtgtcctgtgtctatgcattaattccgtaggactcaaaagtagtccagcagaatatagtattttgcacttccaaatttgttgagtgtagatctcatgtcaaatgttcttaccacaataaaaaacaaaaaaaaaaaaccaaagagactcaaggaaacaagggaggtgatgaatatgtctattaccttggttggtgatgtcactataagtgtctgcatatttccaagctcatcaaatggtacacactataactgtgcagttctttgtatatctgttatacctcaacaaagctgtcaaaaaataaaaagtagctcaggttctgacaagtttacttaaagaactcatggctggatataagctatcagacttcttccacgcaaattatttttcattgtaacttatgcatcttgaaaaaaataataaggcctggatagatatttagaagtagaaggctagcaaaattgtatggaaaaagccccattagtattgctcagaagatctgcattcaagtcttggctctacttcacctaatttgtgtaatgttgagcaagctacataagcttgctgtgtctcagtgtgttcatatggaaagtggtggttattcaacttactttgtgggaggctgtgaaaacctagtgaaataatgtatttaaagtatcaaaaaaacaagaaagtattttacctacatacttccttgcatgtaagtaaaagtcattcataatttaatgttaccacacctcttaatcccattgtgctatcaacatctagaattcaacataaatatcttagtattctttcaataaagtgctgttaattaaattatttactaatttttataatgaataattaccaagaaatgtgctagtgctattcaattttctcatctaaacttttgtactacctgaaaaagatatacaaggttggagtagacttggttggtagaagaaaaattaaaaaataaaaaaaaattgtttcatgtcagttgaaaatggcattattttaaggccatagaatggaagactaatgggtgacttaagaatgtcaaagattatttcccagaggatagtcaccagttggtttttatccttacttagacaagaacaggaggaaattagcttaaatttcatttgggttagagtaatggaagcaagctatgaaatctaattcccagggaatcttttcttcaaaataaaatagagacttactgcctaccattgtttcagtgcagccctgactccaagaatgagaaaacactagatgaagttttagtcattcatctctataattcccttcaagggaagaaaacaagcaatgacgagcctattatgcaacaggtgttttcacttgttttcatttcatctttgctgaaaattattttcctcactttgcaagtcaagatgcaagctatgagcatttagtcttcccaaggttatccagtgaatgagaaagagagtttgaacacaactgctaactacctccagagccaattcttgtacactgcaccaacttatctcagtaaagtcttgctcaccctggcactcctaatttttatctttattttaaaatgacattatctctgtgacttaagaggtatctgaaaactgaagcaaattgggaatatagccagtacttattgagctatctaatacattgccaaacatataagcactctacagatactgccttcatttgatgacagctaacatacgaggcaaatacggttatcagccctatgtacagacggaacctaaggctcaaggaagttaaattgcttgccctggattccacactagtaggctgaggagccaagattcaaaccagttgctctgaccctgtaggccatggtacaaccactagataatacggatattataaagatttgtggtttcagaatttgatttgttgtgaatactttacatttgcagcctttctgtgtttagaaccagctgttcccaaaacttaatagccattaaataatatcagtaacaagtttagttaagtgcatgggaatttaaagataaaaaagtgagtgttgtatagcccagaaataagaaagtctatgagcctctttttaaaaaatcaagtatttctgtcaacagaccaagcagccacacatgtctctagacattctggattctcctggggattctggggcactttggcatgctctagaaaggactaagatgcctccaaacttatcctccaagtccatgctcgaggtgctaaagaaaggggccttttaacttcaagggaggcagtggcgtactcagtattttcacctcagcatgccctgtgactgaaaagcatgcatgtcaggaactcagaccacagagcagcagccaaaccccagcacagacttttctttttgttttcgtcaaatcacagatatttagaagtagaaagagcctattgaggtcatctggtccaatccctttatcttacagacaaggaatttgaggaccaggcaaggttaagtactttctctagggtcagaaagctaattagtgacagagttagcaataaatcacttccatgaaaagacatgctttcaaagcaaatttaattaccttgtactctcaagtgactaataagaacacccatgtagctagacgatctccagtgtttccatgaagtagatgtaactcaagaggatcttgaatgaactttacaacattgaacaatctaagtcagcagtctttcaaatgcactaatttgagtcaaatcattacttttaggggaagtgttcctaccaactttttttctgtacaaagttacagtttcagccacagtaaatgccccagtattttcatctcttgtctagtagataaaaaatagataaaacttacaatacacttagaaatgaggaataatttttggcatccataaacattgtaacacaaattattaaaggaaaagattcttgatttttatagcataactttttctctagaagatcaagaatcatctattttatcaattgatgacaaaacccagaggtgcaggggtaatccattggtgttaataatttaataaccaaatagagtgttgcaaaatatttaagagaaatggaaagtattttcacgtaagatagattatgaaagttaatttatttcaacatgaatctagctaaaaatccaaagatttgcctttagaaaataaatagagttaaataagaaaagatagaagggaaacatcaataagtaagaagaaaaaattctagagttggaatggatatgggttaaaaacacaaataaccattaagtcagtagttaacagcaaacacctagtctcccatatgaaaaagtgaaacagaaggtgaacacataaaaaaacaatgagaactagacggggcagtctgtgcaaatgcaggctgacaacaaaccaaaatgctgtttccatcgggggaaaaactgcatcaattaaaatatgtcttgaaatattatttcaggaaagaaggaaagagatatactgtcagagaagagctaattctgacagccataaaagcatgtagtttgacattgagaatgcttaaattcccacagtttactaaatttaaccccaaagacttacacattctcagaaaatagaaaccctctatcgcacttaacatttcagaaacgtgttaatgataaggttttccatttgactgtgtctttttaagtgagcacagtagaaaaacaggcagcaatgtccatttgacatgttgtattaagcctaacgttcatgttaggtgcctactataggaaaatcaattttcgagtggctatttcatggctctacagtaatctggcttcaaggacattccatggctattcaatgtcaattattcttaaattttcatgttctaggaaacactccccaaatgaaatcattgagatttatgagtgctaccaatagaagagaacagaagcatggatatttcatgggagaaaaaagatgttctgttcagtatcaagtaataaagcatagcatttctcttcctgtagcaattgatgatgaagaggatgatgacagtgttttacctcaacttcacatttctccaaagctgaaaattttcaaggtgacctccctaaatgaagtgatggacaaactaggttttctttggaactctgactgcctagaaagggttgacttgtttgggatccctctgtaatccagaaacctaacaagatgatcaacagattagcaattgagtgttgctagtgatctacaaaattttattgaatttacttaccttgtttaacagaaattatgttcccagcactgttataaatactttataaatattaaactcatttgattcacttaatactcatagcaatcttgttaggtaagaactattattatcaccattttccagaggaggaaactgaggcacagagaggtaaattgatttgcctaaggtcacacaactagtaagtataatcctctcttaaaacccagcaatggtcagcctttaagcctgatactgcatccttttccgggccttctcactaaatgggagttttcaatgaaaagtcattcagggagcaacattgaaaataaatagttgcctgatcataatagttgagtttattaatagttttgtaagtgtcagatactgtgctaagtgcttaaaaaacaacaactcctgtttgatccttaatgtaagcaattccattaggaggcaccatttccatttaaatgaaaatactgaactgtgtgtggctaacaacttttctgtaagttacatgactaataaatggaaagaaggaattcaaacctgaactatccatccagtcacggaacccacctaccgtagtatgaggtgtactgcctccctatttagggagctagtcctttaaggagagaggactaagggatgatgattttggctggctgtttttctttttttctcccctttgccataataggccatcagcaaattttctattaaatggaatgagacacatcacatttaaacagatatattaggagtgtagttcatctatgagaattccaggacaataaaagcacctcaaaaaaagcagcgtgttaagccaattcaataacccccatttctagcaaagtatatccaaccacgactaatagtcatggcaatgccattactgttgactaaagagagtggtagaatcaaccgtctttaaaaaattttaaatttacggtaaagtcacatctaaaataaagcttaaaaagagtcatgctgaaatatggagaggtgggctgcagagtggtctcgagtacctgacaaagagatgacctcacatgagaagtacagtttaaatataaattaccaagaatattcttttctacaatttccatattcacctgcaatgtgatatgctgtcatctgataatacccacattttcaagccacaattttcaacattttgttaagaatcaaaatacaaatcaataaattgagatcacaaacgagtttcaacagccaataattgtattataatcctatcttttctagagataaaatcatttatgtttattttatattttagtcattttagagattatttaccttattttataattttagaagcaaataatttttacatggttaaaatttaaattttaaatgtaataaatatttttaaatttagtcattcttatcaaactactgatatattttctttgcttagtcttatagttattataagtatgaaatgtatgcagtagtcttccctcatctgaggggaaaacattgcaaaatccccagtggatggcagaaactacaaactctacacatactatgcttcttcctatacatgcattaaagcttaatttataaattaggagatttccaaatactttcttgtaagagcttaataacaataactaataataaagcaaaacaattataacaatatgctgtaattaaagttacgtgaatgtggtctctctctctctcaaaatatcttatcatactgtactcacccttcctgtgatgcgagatgatacaatccctacataatgagatggagcataatgaataacgtaggtattgtgacatagtattaggctactactgatcagaatctatattcctgaatctctgcaactattccccacttgcagtaaatggcttggtgtcactcatttcaggcaatcccttgttgaagtctttgtataggctcaatgctttctagtgcggcacgttgctgtcaatcggaaaacgtttctgttcatgtcttctacccacagatttaatgccttttccatttcaactaagcacttatcatgcactgtggccataacttttgcagtctgaagtgagacagcaaaattggcatgaatttctttttccttcttcacaatttcacagagagaagattcattcttagcataggtcttaacaaccttatcattttttttttatgaagttgagagctttctccttttcacttacagaagcacttgatggcttctcccgggcatatctgaattgctagctagcatcattactcttgtgctttggggtgcattgttaaagaaaataagggtgacttcaacacaagaactctgataccatgacaatctgataactgcaagagtaagtctaataactgagatggctactaagtgactaacggatgggcagcgtttccagtgtgaatatgctggacaaaggaatgattcacgtcccagctggaatgaagcaggacagtgcaagatttcatcaagctactcaaaatggcatgcaacttaaaatttatgaattgtttatttctggaatcttccatttaatattttcagatcacagttgaccatgggcaacttaacccatggaaccacagataagtgggtctaggcactatcaacatttaaactgcaaatacaaacaaattctttgtgcgaattagacaccagaaaatgaaactgacttctcacaattcaactgtgatcgatattcttaaaactcactgcaaatgacacaccacacaatatgatataaaatcaatcttctcatttctgtgaaagtactttttgtttgcagaagaaaaggactgaggctttttgatacagtgatttatggaacataaaatgaaaaataaggagaagctcttaactgatggcttttcaaaacataggagtctttgattttatggaaagaatatacacttttcttaaattattagaaatcctctctactagaaaaaagagcatggaaatcagacaacttaaggcaagtcctagatttatgaattctacatcattaaaattttgttgaaatcttgaataagttgcaaatgaaaactggttttgaaaggctgccttaaaaccacttacatattactaaatattttgaatttattttttcagtagagttttctttattttttgaataatatcctattttagttaattttcaaggaaaatgtttcataatacttaataaactttaaaatattttaaggtttagcaagataaggaatctatcctataagtggtattctcacataataataggattttaaattctagccaccaaacctctgtcccctgtaacaacaaaagtttgtatgagcactcccttatgacctactgtccttccctcaaatcccttttgctcaaggtaaataacttttgttgtctagaagacctccaaacattgcaaaaaatgctccaatgcctttcatgttaatgcaaatgtctagtgaagacagctatgtattcccaaaagtacttaattctaagttcatgtgtctgagaattacttgatacgcttcttataggaaagtttatctgagtatcatttaatatgcttcatataggaaagttagtgaagaaagatgaggtaccaagcaaatatcctacatagagggttgaaacatacactgacctccctgaaacatacataattattttatttcattcaactcaattattagcattaacaatggcaagaataaaaatgcattcacagtaagtggttaagaaatttacaattaatgtttgccagaaagtggataaaggaccggttgtttgaaacatttgtttctatttctgaatctacagttttacatttgcctcttaagcctggttccagttaaatttactgcaaatgacatacagtacatataaatgaaacattctctttcctgaggaatacttttcattggtacaagggaaggacttgggcatggtattaattatacaaaattagaatttgcattccccttttccatacacaaagtagaaaataacttattgcacagaggtaaatgattcacctgcagtcacagtctcctgtttgcaaaaataacctataaatatttaggactacatattaactcaataacattccctaaagccactccctttgcctctgtatgtagttatgaatcattttgtaaaccaaaggcagaactgtaaacaaaaatatttgtaaacaaaagaaaactagggaaatatattagaaattaacaaattttagccacgaataaacttatagaatgtgctcagtgtttctatctctgctaaaatgtcttgaggttgataggaaaagtgttatggctgtccatcttttacagatgagaaaacctaaggctacagcattaccccagagtgacttacctgagagcacatagtttaattaaagggtggacttatgattctcaaacccatgtatttccctctagattccagagtctggcaattcattccttatccacatcgcttcattacatagtctgggaactgacagaaaggcagcaacatctggccttctgaatgtttacagtattctgtatgcactatttaattctatcttattctttcttgtgtcttggccatgtctccccaatctcactgtaagttctttgagagcatggatcatacctttggcctctgtggaattaacaattactagcacggagccaaggacttgtaactttttaaaaatatttgttcattcgctaagtagatgcaaaagttctgggaggcccattccagaagggtggaaaataattgtattgcacaggcaaattgggtttatttactacccaattctgtatttctttatttctgtagaaattcactaattttcttttttctattttcaaaaaattattataactgtttttttatgacaatatccagtgttttcaatgaagcagatgttctcaaacactattggtgaggaatgtaaccttcatgggtataatttatcaatacgtaaacatactattttaaattgcaattccagtaattccaattgtagaaatgttgcctaaaataataattagcggtgttcatgtgcataccaaaacttgtacctttgacatgtaaaattaggagataaccaaaatattagatataatccaagctttcagactcttgaaaaagtatgcaggtcagccaagccagttcttttttctctaaaaaactttcaaataattgaaaaacatttctatacttttactgttttcattatattaacatcaatttatttttccactcatgaaaattaattttagcctatgaatgagtcacatacctttattacatgatgcttttcttggaacacaggaatcttaaacatttggcaccaatatgttgtatctttgtttgggatggggacctgtcttaataaaaaggggaggaagacacaaagtcaccttctcttaacatgctcctgaatacaataatgtaagcaaaaatgctcgtatacactttcaataagcccatccctacaatcataaaacctgaaaacacttacgtcctgatttaccagatcaaagtatggtaaggctgtagatagcacactagttttctcaggattcaataaccgcaaactcttggtgcccctattggagtcatggtacttgggaccagcttctcctgcatcttcatggtggtaggcccagatcactctcacagtgctatcctggggatcagacatgggcatgattaggtctcatgagagcactttccttaccactgagttgagtttaaagaactctattgtaaacaagatatagaagtgaagaaaagacaataatgacatttggagttatcaacatggtctctaatattaattgcacaaatttgattaagtcattaaggatccaaatatatgagttactttttggaaggaatcatctctcagcatgcaagattatgtgttccaaaacatactgaaggacaattgactcagtaattacactttgaagtatatgacaacaataaatcattgtcacgccaaaactttaaccttgcaactggtagcttctaaacaaatattcttgttcagcagcagagactttggaaaattaaatgccatggaagattttagggaaaaattaatacaataaaaattaaaattacctaatacttttccttttacagtagatgttttcctaggcactagcctagtcacacgtatacatttacagaaaatataaatatagaaggatttctgattctgagtttttaaatcatactacagttaatctacagtcattttatgaatcctgggaatttcctagggactggtttaccacaactatggaaagtactgtcagatgaaatcggtttccattgagcaaccaggagagattgcccaaagggctatgggttggggagggtttgctggggtgtaaagaaattgttcaatcctctcacagataaaggtgtttttgccagatctttgtaataagaactttgaaaataaataataacgcaaaagtattttaaatgttctctttgctatattctttcttaataagtcaaatgactataattattattccaattaaagtataattgcactgtatattgcattaaaaagtaatccctctctttgcatgcattttttctgcctcgttcactctttatgctgaatgttaatcagaactgcttcatattttttacattcccatttttgaagctttgatttacaaaataaaaaggtaatcgtattggtctacacaaaataaaattaatccaaacaattcatggaaatttctgaagtattacatatcttctaaatatttaatttgaatgcacataaagatattaatttttgcatgaagtctgaaaataagaaatctcatttaatataccaataggcaattataatcagccacctattcatcttgattttagaaatttacaaagatgagtccattacaaatcagatgaattatatcctaatattcagattcataattctttcttgtgtaatacatttcttcaaacatttatctgttgtgtattttcaaactttatggagaagaaagtaaaatgtatttatggctaaatcatacaaattttaaagggatcttcaaaatgttaaactcacacaaaaatggattttattgaaatttttggtcttacacatttttggcttctaaaaaagtaaaaaagaaaaaactaaaaaaaaaactaaaaaaaatcaaaaaagatttcaaaaatattagaaaaaagactatatgacttgtttctcttattctttaaagtgcttcacaagtgtaaatatacaatttgttcatgcatgcattcactcatagatgccttaccgttatactcttgtcatttatgtcacatgtatgcagctctctggtaaattcaattattgtgtgtgtgctattttccatggcatattctagatggtaatcttgctgagcatcttttttcaactctctatttgcatttgtaaaataatcctgtggaaaatatggaaaagaaaaatcaggatacctaaatacagagagaaaagaattcataggacctttaaagacaaagtcttgttgtctagagttattttataaatcccgggaatttccaaggggctggagtattccaactggggaatcaggtccctgggaaactagtccatctttgaacttctggcctttcaggaaagcatagtgtagactgataatatcgtagagcatcaagagatggaatgaatgaacatttgataccattgtgtgcctttccttccttggaaaaattaaaagagggactatagcactatgaaatgtcttaccgcaaagtttgcatttatacaaaaaaagtttgataactagttagcagcaaagccagaatcagccctaaggtcatcactctttccattacaactcctggtggagccccacttcaccattcataaaagcaaagagatccgtgggcaagtgcggattataggttgtttcaatatgacttttaatggcatatccttattaaaataaaatgcaatgggaaatatgcaaagaaacaaaactagttgaattacacgatattgaaaaactagggaagttttgttttgggggattagccataatttttgtactaaatttgttcaacggtgtacctatcacttctttttgagacggaatctggctctgtcgcccaggctggagtgcaatggcatgacctctgctcactacaagctccacctcccagggttcacgccattctcctgcctcagcctcccgagtacctgggaccacaggtgcccaccgccacgcctggctaatgcatttttagtagagatggggtttcaccatgttagccaggatggtctcgatctcctgacctcgtgatctgcccatctcggcctcccaaagtgctgggattacaggtgtgagccaccgcgcccagccagtgtacctatcacttctgggaggcagaccagtgcagtggagagaacatgggctttggaagaaaatgactaggatgtgactcccagctgtactcctaaacagccttgaagaattgttgaagtaaaactctgaaagcttaagttttaacattactaaaatggggataatacatacctattttatagattttgaaaaataaacaaatgagatggtttgggcggggtcataactgcctacatggttagcgcccattcgatacatattttcttttttgcaccatagtttggttttatccccaaaatatcttcttatgccttttaccattcgcctactctgttgagtcatccaaatcaaagtattaatttttgtcacttataaaagacacaaaatttgccttaattactgcctttctggtttttcagtacctgatgatattttatttttgagaagttgtacagttgatttagaatatacatgctgaaacataattataattacttttgctaacagtaaaattgtatttgaagaatttatagctatgtttgactgagaaaatgtaatatataagataaaacctcccattgtctataaaagtcatactcaaatagatggcatttggcatttttattccaagcatctttgtatggtaattataagtgtgcatatgtttcccatccagggtaccacatctagattttctttagtatgttaaaaccccaaattgttggcaatgcagagtctaactcacctttcttgacaatggtaacaataactacagcttcttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccaactacagcttcttatatgcaccaggccctgtttacacctgttacatgtattaactaaactaatcttcaaatcacatctatcagataaaactatttttccattttacagatgaagacatcaaagaacaaagaggctaagcgacttgcccaggatttacagctagtaaaccgaaaggcaggattcaaaccttggcactctggccccagagtctggatcctttttcactcttctacagtgtagtggccactgctgggataggatgggtacgcttatttttgtttatttttttctgtctccagaaattagctatgtcagtttttcacataaaatgttacttttcttctgccaaagttgaggtttgtcaaaattcttattttgagaactgggttgcaattgtgaaagcaatttaaatgaaatactcctgtgagtctgtgattttcccatttttcatcacatagattttcaatatgtaaatgaaataacaatgtctgtagacaatgagagatttagatcagttaactgtgccttttcactgaactcatatttcattacatgatccaagcagtttttgcaatacaatacaaactgtaatcagttcaaagagtagaataattatccgagtcttgcaaatatgtttccaaaaccattatttccacaaaatatccagctggtttgccaattttccactcattctatttccactcaacaataccaactccttccagctattccacctttttctggcttttcagataacttagttattagaaaatgagagaaacttcactcaacttatgttgatgaccccttgcgccatctgccctatgtaaccaagtgagtgcttaatatttagaaaagacagctgccaattatttcaaagttctgaactcccggaaaaaagaagcagttgtctaaaagaagctcatatcttcaaccttactgaaggaaaatatggttggatcttatttgaaataaaatttaaatatgaactaacctaaccaccatggtaattccactataatttttttcacaggctgggcgcagtggctcatgcctgtaatcccagcaatttaggaggccaaggggggtggatcacctgaggttaggagtttgagaccagcctggccaacatggtgaaaccccgtctctactaaaaatacaaaaactagccgcgcgtggtggcaggtgcctgtaatcccaactacacgggaggctgagctgaggcaggagaattgcttgaacctgggaggcggaggttgcagtgaaccaagtttgcgccattgcactccagcctgagtgacaagagagaaactccatctcaaaaaaaaaatttttttttcatattttccaactttgaggtcctattttggaggcagatcttcagatttgactataatacaccttagctatccaaataatattattatttaacatgtttacttcagctgggccctcactaatggctggaaatccatgttaatctcttgctattttctgaagacacctcccaaaacaaatagtctaaaccttctctatgcaagattccgaaatttccccaccctcagcttatgatcacacatctcagtttattgagagaatttcagttatgatgcatgagagctcccattttcattctttctatcctaaaaaatatctactttatggaatcaaaataaaaatactgattgtaaaagaaagcagaaaaagattaaaaaaagcaaagatggaataaatagaaaatagatgtaaatgaaatggagaaacatcacaatagatcctacagacactaaaaggttaataatattatgcttaccttgaagccaaataattggatcctttagatgagaaacaaagtccttacaagacaaaaaccagccaaagtcattcagaaaaacagaggtactctgaatagctttataatctactcatgggtaaaaaccttcctaagaaaattctaggccaagatgctttcacttggaattttaccaaatatttaaggaagaggtaataccaactgttcacaatttcttctggaaaatgaaagaggacagaacacttcctctttttttttttttttttttttttttttttttttttttttgcgacagagtttcactcttgttgcccaggctggagtgcaatggcatgatgtcagcttggtgcgatctcagtttactgcaacctccgcctcctgggttcctaattcctttttttataccagcattactttgttaccaaaattaaagacactaccaaaaaaactacacaccatcaacactcatggacctagatgggtatttccttaaaaatagaaatagaaatatttcttagcaaatagaagccagcaacataaaaaaagaataatatagcatgatcatgcagagttgtcttaacattagaaaatcaatcaatatgatttagcacatcaaaagtctaaaaaagaaaaaccatatgatgaacccaataaatgaagaaaaaaacagtttataacattcattcactgcagaatccctcagtaaactagcaatagaagggcacttcttcaaccctttaaagggcacctataaaaaacctacagctaacatacttaatgataaaagactgaattcttccccctaagtttaggaacaagtccgggaaacaaagcaaggcacattctccacgtggaaagccctacaggtgattgtccaccttgaacagtttatttctgttattccctgactctattttcacctcccattctctaactaaggacttcaaagttctgtccttaaaattatatttctgtcttcatatttcaccatttgggaatctcatctgctccaatagttacaaattatcacctttattcagtatcacatattcaaaagtatttttcacttggaagtcttattgtcatttcaaatgcaatggatccaaaattgtattcatattttacttgagttcctgaatttctttaattacactactattctcctagctatctaaattcaaaactgtagtctttatttttcttttcttttttgagacagggtctcactttgtcatccaggctagagtacagtggtggaatcacagctcactgcagcctcatcctcctgggttcaattttatttcttgtagagatgagttttcaccacgttgcccaggctggtctcaaactcttgagctcaagtgatctgcctgcctcagcctcccacagttctgggatcacaggtgtaagccaccatgcccggcctgtagttttctttaacttctttcctgtgactcacatctccacacatagcccctgcttctatcaagtcttcctttgaaaacaaacctaccttttagttctatttcattttcactgttcctatctcccacactccacgtttacatactctgtcatagtcttccttgaaaaatcaccctcagtgtgtcattgcattttattcaacagtatatagtacaaagtctataatttagagtccaggtttcctcacattgagcctaacctggctttccaggttacctattatcaatctcaccacgggacctgtactaattgctcccttcaattactctgccttttcccagctctttgcttttgttcacattcttcttccctatccccctactctcttcattcaactaagatatcttctccactaactccacctactgaatctctttttcctgctaaggctcatgattctatttcccctatgaagttttctttgatcattccaaccagaagtgatcattccctctctgaattcctattcctctatttacattcccatgtagcatgcaatctattttaggcattgccttatcttttcaaccatgtgataattgcctagaattcaaaagttaatcttagtatttcagttataaatttgtgcctttagaatacttatttacattgtcaatggaacaaaaaaaggggggaagacaattattttcccatttgctcttaattatatttacacatggttaagaccggatatggattgtgtttaaccagatgctagaatgagtttgggtctgcatgatctgtcatacagacacatctggcactgaaatctgggaatgttgttgtgaccttttagcccctacacgcacatgaatcttaggagaccgacattagtattcagaaaaaaaagggtttatacatgcaacaactattttaaatccttttacacaaggagataatcccctacctattttaaataaataagaaaaaaatagatctaagagggagaagtcatgtttcagaaggttttctgatgttaatttatatcctcagtacctaacaaagtgactggcatattgaagatgctcatgaaatacatgcatatatttgaaaaggagcatcctgcttttctttctgttaaatctaaataaggagataattttgaaaataaaagataaaacacaagaacctatcatctgatattcacagctttgtggtatagaaatagtttaacttaatgagaccaaagtattccccagtagtaccttatttcttctgtctgtattaagaaaatacatggactgtaatcaaacacagccttaatgctgtcaatattatacaacagaagtggcatattggccaatcttaaaagcacaattaaatgaagtaaaagaagagaaaaaggcaaaaaaaaattgggatcctaaacttcatagcattcaactattcttgcctagaggatgaaaagccgaaaagaaaagagggaaatagaaggagaaaaaaaaagcaagccactgaaagcacagtcagcaataaaaccatcagtcttgagattcagattggttaaactgaaaaaaagtgttaaatgaatttaagtctcctgacagtctgacaaagggataaatgttattcaagtggataatcaatggataggttattgtgttactatcatcctctaggaaaaatactagagaatgaaacagacacagtaaaacattgaccaattaagagtttgaatacaggtaaagtcacttagaagttgacattcacaaaaccatactgtatagtacttaacagatacttaagaaaacttcctacatcattttcactacatctgatttcacctttagaattagaaccaaatgacatcctcacccactcctcattttatttagcaaatagaatcaaatgcagctctattatgcactcatggtaaaggccattcctcagctatcttcctatggtgctttatattccaggatttgaaaaataaaaatagaaatattgatcactgtgcactctcgttgtcatggcctgatatcacagtcattataaaaatgtaattgtataatatacgtatttaacatatcatatacacatatcataaatatacaatattgataaaagtcactccaattaagaatcattaaaattagactttatgtgggtaagaaggatagagaggattcagagaatcatgattctgtataaattttgtaagaatttaaggaaaaaagtagatgttttttaaaatgtaaatataaaagctgatatacagaagtcattctcacatttatacagtattaatgatctgcaaagtgaaatatacttgaggtaatgttattctatataaatggctttatgtggctctcagtcatattctaattcaaacactttgatttagatcagtttcaatatgaatcatcactgaggtatgatttttttggttttgtggattatattgattatgtatttagcttgtttatacatttttagataaaaattacttgttacacctgaaaatgagttaataattcaattccaataataaagctagttttcagttgtaccgtagactattactcctgaaacatgttgtcacaagatattttttcttttgaacacttcgtgctttgaaaaatgtatgaaatatatacttgaggtttcaaaatgctatgtagcaacaataacagaaattgccattagaagctgatagtaagttgacatctgttatttagcatgatagcctcagtacttgctgtcactttcaaactgagataacatataccaaaaaaaccttgctatgacctcttgtttaaaagcatgatgacacagatgttaaattggttctcactcattgtcagtctatttttctctcaaataaaatctttgactggtgctgtgttacacaggaggaagtaaaaactcttacgggtataataaaagatatgaatagaccttggttgagcttggaaaactgaatgtaagcacagctgcagggagattcttgagaaaaatgttaccatctgtcatcattttcttcaacaggtgcttgtagtttttctttttctaaatctcaaaagcctcgttacttcaaacatttgtttataatatcaatttctacaataagtgttatggtggtttaataatattgatagtataataataaatattttgtgttaaagggaatctttgatcctaaaaaatcacagagctgtacaaacaaattatataaacacaatcttcagagttcaatataagctgatcttaataagttatttcttcagtaatcttagaaatttaagtggaatgtcaaaatagaaggcacttaccttttagaaaccacttcagataaagctgaaactgtctatgtctaataagggatctgttaaatacctactaaaatgccaaaatatgaaccctgtagctagtgttccaatgagaaagaggcccacctgagcaacctgtttgttctttaagtgtcaccttctaaaaatgaacatcctgaattttctcccatgccaactgtctcatttcagttgtcacgtaggataatgtaataccttgctataattatagaatcatgaaagatacagcataaaatcaaaattttgactctttatttggaataatatatttcagtggaaaaaacaatttcagactacaccatctgaataagatactactttgccttcatcctatcccatcaccttaatttttaaaaaatttggatgatggctgggtgcagtggctcgcacctgtaattccagcactttgggaggccaaggcgggcagatcacctgaggttaggagtttgaggcaagcctggccaaaatagtgaaaccccatctctactaaaaatacaaaaattagccggttgtggtggctggcgcctgtaatcccagctactcgggaggctgaggctggagaatcacttgaacccgggaggtggaggttgcagtgagccgagatcatccactgcagtccagcctgggcggcagagcaagattctgtctcaaaaaaaaatgaattatcttaactggttatgtctattttttgcaaggaataaattttgaagttaaaactagttctttcctttatccttccctccctttcttcctctctcccttcctctcttccttcctccctccctctcttccttccttcctccttccttcctccctccctctcttccttccttccttccttccttccttccttccttccttccttccttcctccttccttcctccctccctccctttcattcttccttttttcctccttcttccctctcctttctttccccagcatatactttattgagttactattcttcagaccttatgtagggttgaggatacatgactatactggacagtagacaatggaacttatagtttagttgggggggacagacaatttctaaagaaacttaaacaataaaatatccaacaatttttagataaatacttacagaaaaataaaacagagataacagggggatcagaaggctatttcagggtgagtgatcagaaaagtcaccactgaggcaatgatacttaggctaagaagtaaaccacaattaggaaccatccatgcaatgtgtggagaaagtagtttccaggaagagattagctattgaaaagggcctggacaggaggttgggttatccagtgggatgaagcaaataaaagccagtgggactgaattacagtgcccaaagaggtccctgaggtcagcagagatcagatgaggccctaaacactgtgataacttacatgccattgtagggagctataagcagcaagtggcataatgtgtatctgtatctgtatctctgtatttctgtggcttccatgtgaggaatgaggagaagaaggaataggaatggtagttggaagacactcaggagcctggcagtggtcctgcaggttcaagcttgagtggtagtatcactggagagaggtgggcaggtgttagatttagtttcgaggaagagtcaatagaacttgacgatgggttttatatattgggtgaaggaaggagcagaaagaaggatggcttctaatttttgactggagctaaagctaacaagaagtgccatttgtagagatggggaagcctgggaaggaaacaggttggagtttagtcaggttaagtttaagatgcctacccagaaggaaggccaggaggcagagaacatgtagactgttcttaggtcaaagtaatgtaccaccaggggaggggctcaggacctcagaaacttcacgctcagctttgcttttgaagccctccaccttcttttgagtatataccagtcagaaaacattcttttccctcttttaattattttttcagatttcaaaacttatacataacaactatagagaattcaaaatatactgaaattattattattattattattattattattattattattagagacacagtttcactccattacccaggctgaagttcagtggcacaatcttggctccctgcaatctccatctcctgggttcaagcgattctcatgcctcagcctcccaagtaactgggattacaggtgcctgccaccatgcctggctaatttttgtattattagtagaggcagggtttcaccatgttggccaggctggtctcgaactctggaactcctgacctcaagcgatctgcctgccttggcctcccaaagtgctgggattacaggcgtgagccactgagcccaaccaatatactgaaattaaaaacaggaaaagaggccgggcgaggtggctcacgcctgtaaatcccagccctctgggaggctgaggcgggcggatcacgaggtcaggagatcgagaccatcctggctaacacggttaaaccctatctctactaaaagtacaaaaaattagctgggcgtggtggcgggcgcctgtagtcccagctactcgggaggctgcggcaggagaatggcgtgaacccaggaggcgtagcttgcagtgagccgagatcgcgccactgcactccagcctgggcgacagggcaagactgcgtctcaaaaaaaaaaaaagaaaaggccaggcgcggtggctcacgcctgtaatcccagcgctttgggaggccgaggcgggcggatcacgaggtcaggaaatcaagaccatcctggctaacacggtgaaaccccgtctctactaaaaatacaaaaaattagccgggcttcgtggcgggcgcctgtagtcccagctacttgggaggctgaggcaggagaatggcgtgaacccgggaggcggagcttgcagtgagccgagatcgcgccactgcacttcagcctgggcgacagagcgagactccgtctcaaaaaacaaaacaaaacaaaacaaaacaaaacaaaaaaaaaaaacaaaaaaaaaacgggaaaagagatgaaataatctcataaccattgtgatgataatgattcaatgcatatctatccagagaccaggcaaacttcttgaggcaggtgaaaaagcaatatagacagttttatagttgctaatgtcttcccttccattcatttcttgaataacctgaaagtgtaaatgcaaagtaattttagcatcacacgtaagttggaagacaggctgaaggaaacctaatcccagctcccaccaaaggagaatttgtctcaaaaatgttttaagaaatgatcacacagtatttaatacttccagtgacaatgctcatgatctcacaatcttacaaggcaatctactcaattttaatatctctgcttgtcagaaatgtattccttatagtaagctaaattcttctactctttcattatatttattgggtcttctcttctttcttctggggcttaataagtaggcactaatccacctttcctgagcaagactgtacactacaacgccaaagacaatgatcatgtctttctcattgttctttctccaggcaaaatattgccagctgtttttttttcctcaggtactcagatttcccaaggtttcaaccatccttgtaattctttgatatgctccagtttatccatatgtccattaaaagctatttccagaaggagtcctctggtgtggtcagcctaagatagggtgctatgtcaatattacttcctttgatatgaacagtagaattttaggctaatgttgcatttatctgtttggcagccacattgtattgagctaatacaatatagctaatacgtagagctttttcctatgaattccagttaagtacaattttatactgtgtacatgcacagatcattttttaacagagttgttgaactttacttgtattcccaatgaatttttaacttttagtttccttttattatttaagaatatcgctatcttttaagtcctcattatgtaacctaatgtagccagtctattaataatgagtttggggtggagcacggtagctcacacctgtaatttcaccactttgggaggccgaggcaggtggatcgcttgaggtcaggagtttgagaccagcctggccaacaaggtgaaactccatctctactaaaaatacaaaaattagccgggtatggtggtgcacgcctgtaatcctagctactccggaggctgaggcaggagaatcattttaacctggggaacggaggttgtagtgagccaagatcgcgccactgcactccagtctggcaaaaaagtgaaactccatctaaaaaaaaaaaaaaaaaaaaaaaagagtttgggtataggtttaaaatatttaggattataactaattcaactttattagtgcatcctctacaaggatatagtgagaaaccctgcaaaataccttactattactcagatgcacttatatttaataccctaatctacaggtccagcaaatcaaatgcaaaagaaaatgcagtcttgtataatttgtgtactgaaaccatactggtctctagtcattaatgattacaaggtgttcacaaaccaattacttcaagtttgacttcgaagttttttcaaaaattactataatctctcccacctatatatttagtggagacctttcccctaagttcaaaagctggaatatttgtcttcatgtggtcttctgaccatcgtctcattacactaagcgattgattcattatatcttgtatttattaagtgttttcagtgtgtcacatactctcctaagaattttacatgcctatttcatttaatcctcacaaaagcccatgcattaaatatgatctcccttcttcacagaaagaaactgtcacttaggttaaggagtttgccaagggccacacaatgaataagcagcaagcagtgctgggattcacaccccgtctagaagatttcctgctctttaccgctcagcagatatttattgaatatctgccaagcacatggaatcattcctggtacctctagaagatttggcagcattgacacagtcatcaacttgcaaatgttccttccatactctaataagatactaattatccaccactgctgttactcttcctcctcctcccttctgcaactatagcttgagggcatttcactgcttattagtaaccttggagaatggagaggaaagggaagggaagggatatctatttacataactggaaagacgctggagaatttttcagaataaaaagggggtccattttgttactgttaattctaataaaagactttggagaagaatacttctcttggcttaaatacaagcctagaattacctaggactttcatttactaatgaaatgaaataacattgctttgacgccctgtgaccacacacaactgttaaattttaaactctgtgtgtgcagttattcgtgttgcttagaaatacagcagctggtaccggttgacaaaaggtgtgtaggaatgggagagggctatgaggatgaaagaaaggctcctagttcagaaaattttgaaacacacctctaccctcagttcaacgattgctgtgtcagtccataaattattattattattatttgggggacagagtcttgctctgttgcccaggctggagtgcagtggtgcaatcatagctcactacagcctcaaactcctggcttcaagtgatcctcctgcctcaacctcctgagtagctaggattataagcatgagccactgtgcccagccctcactatataaattagagaaaatacttactcattaagcttatcccagaagggtttccatgccaggaaaaccaagcttattttcctatcttaaaaaataatcttaaatgtgcaagcacatgctagcccttgtttaaaacatcagatggtcactctgaatggctgtgtatggaatcttgctttgtatccccatgtcctatgtctgcaattttccatgcttctgcaggttgaattgcctgattcctatcaaacaacctaaccatataaggtcagtagttactcaacttggcccacattggaatcaatggagaaacttgaaaaatatattaatgcctgtgtccacctcccaaggattgtgctttgactggtgggggatggggttgcctgggcactggaattattaaaacatctccaagtgattctaatgtgcagatgaacttgaaattttgacataggaataaaaagtatctttcccagttctcacttctctattaacttggcctgctcatgactggactgcaatctgccatagcatgaactcatcttggccctatccaaaaggatctgggtctgccaagtaccaggaggcctagtgtctacctggttacatctgtcatgagtttccttttataagtgaggtttcaatgtataaacttcatagaaaaaaaaggcagacatttagtttttcctaagaaacttgagatttcaaagttttagtttaaaaattgcatgaaagatggaaatcttcctcaggcatacatttttgttgatctgtcttctcaaaggcctttagctctctaatattattgaagatgagaaagaatacagaatataagagaaatacatcaacgcctagtattaagaaagaaacttctataaaatcaccaagtctctagatcaaagcttgaaagactctagctgagcttactaaacatctgtgtaacaatgccacagaaatagaaaagagagctcatgcggttcagacacatttgaaaaaaacattaattatattttccccaggtaggtagtttcctgtattcaaggtctactgagttctttgatgcctatgccagatcatcttcttcatagtacataatgctttgaattgtacacactatggttaacgtcgaaagacaaccttcaaaacttgggacacttgttttctttcatgttttgagtatcagcatcctgatctcaaatagccacacagacacactgcttatcacatcactccgttttaattatctgcacagcacttagcacttagtactttctgatgtttctcttgcttatttatttgtttaatgctacccccaccaccacaatacgggctccgtgataccaatggttttatctcattcaatgttgtgtccccagcatctcgaagtgttcaataaacattcagtgaatattcagtaaatgaacattccaacattctgagtactttcctgaaacagtcatatgacagccacagacaatttccatgctttgtgacatgaaggcccacatttatacacctacaaaatgagagtaataagatattgacctcacaggactatcacgagaattgcatgagaacacactgtaaggacttatcacaaggtatggcatatgatgaatgaaaaatcataaaaatcatattatggaaatgtgtcagtgtgccatttatagtggaataaaagcagtaagagaaatgccatgatttcattttatcaatttgtttaaaatgtatctgattatacatgttctttcactatttaggaggaaaattaacatatgtttttatgtaagctacagtttgctttcaggagaagaagagtaccaaactgggactcagaggaataaatccaggctgctgatctgtatggcccaatacgccatttaatagttacctaaggtttagttttctcacctgaaacattgaggggagaggcaaggaagagtaggaggtttgaggggaatcaaccgaaatatgagctcttaagaggcagcgagtaaatatgcaaaaatcaatatttagctcataaaagaaagaatggcgtcaagattttctcacaatgtttggctaaattagatgaataagatagaccttcataataaattaaatctgatctatacattatttgtatgatactcagatatacaatccctagcttacagttaataaaaattatccatttgaaattatttttgcagacatttttgcgtatatgctatatggtgtccttatgaacagctttttttttctactgaaatttaacaagttaaaaagaaatagatttagaagaagcttcctggagaaatgtttttcctgtttaaaagttctttaccagttttttttaagttacaataaaaagcattgtgagtcatccatacgcagtttttttgtattacgtatggatcaaatacttccagaaacatgacaatgtgtaatgaattcatccccttcaccagtaactttattttaatatggctctattacaaatgaaaaatcaataaaccaccattcagtttctttgaagtagactcttgcctctccttccaacactctagaaatatgccattggttgcctaaagccttgaacttcgtttgtcaattcaggtgcattgtttccttggctgttaggtctgcctgtttcctcaggctaattatgaaatcatctgctccgccaggaagaagcacacagctgaagagcatcatcctgtgttccagcattactgtggagcatgtgtccttattactaatgcacaaagcacgacacttggagaagtctcttcgttgcctggaaattggggggcataatctgaagacttataaatatctcttaacaaagcaccagctgagctgtgtcagggttgcacactctcttcatctctcccttacagcctttcaatttgctttccaaacatttctttgtcgccgttggctggggtgtgcttaaaagaagcacatcgttaaccacaaagaatgctcactgttttctgtgatttcaaatcagttccaagcacttcctcagcaagtggcccggcagcaattaccctgctgctgaagacacttcgcatcacaggcctcagtttttgagacaagcaagcaaggctgtaagaaatgataacatatgtttcagcctccattcaccagcgatttatacccccataagaagggtgaatcaattttcatgcaaattcaacaggcatattcaacaacgttgctctcttctctaattcacacaaactcagcattcatcggctgcattacttgcctcaaatgggcactcacagttgctaaatgattcgggcgggggtggagttgctctgtgtcaaaaaggggcaaagaacaaggaaaggacatgaatccatcagggcaatgagagctgaactgattcactgagacaaaatagtgaggttttgaaaagccagtgcaaaaggagatggcttcccacctcaccctgacacttctgtgaaagatggtgtagaaactgacctcggcagcattcaagggaaatgtttccacaagcatgagctgctccagaacaatttatccaatagattatgttgagataggcttcactttacaaccacatttctctcttttctttcccatcttgatcatacctgttaatatcctctttgcggaaatatctccagaaggagtcaaaaaggttaaaatgggcagcgcaaatttccatatgccaggtccctggatatagttttaaagggcctgtggccttaagtaaaatctgatttcttaactccacaggtctgcaggtaaatgtcacactgccctctggaggtagtctcattggatctaaccctgaattaatgattgccagctactgaaaaatatatggttgctgaatttcagaagtctttttctagggtggagagggtatagaataggaggacagttgaaaaattaccaactgcttccaactccttgtgagtggagtgagtgtgtgtgtgtgtgtgtcagacagagaagggggtgggaaaaggaaaggagaataagtaaagattgcccccaatttcagtagtgccaacagagaaaggatgcatgtagacaggaagcttcaagatggctgactaaatgcatctggtactcaccttttccagagagaggagctaaaatagcaattagataatcacattttgaatagatcatctgagagagaatactggaattcaacagagaagtgatgggaagcactgaaagcaaggaaggagagggaagcaaggaagccagcttagctgggatcagctgggagcccggagaggctccttaatgtgaggaaagggtaagtgagagacaccaagtggtccacattcctgccacagaattctacaatgctagccataggagagcccctggactctcatgggccctgagactcacagagaactgcctagagatcacataatggcattgttctagacagggagctcatgctgagtcctacaaacccccaagtcctaagcagctgcagcactgtgccattatgaaagccccgcccctgccagaatgtgttctgcctgggggcccaagagcccctgcacctccatatccctggagcccaactgacactcatcacccacagacaccactgttgggctgaggcaggagccactggaagtgaccttgccaccccaacaaaaaggcagctatacattttcatgtgccatctgcaggactgaggaccagcttgcccagttcatcatggacatcaccaacaccagcactgaccacttgggttccagaaagttgtcccaccacagctactgccattgccacagcatacctgctacccagaagcatgataacctgcccatcctcctgacccaccatgatattcccagcacctggagaggctaatgctcaacccactgctgccaccactgaggcccaaagactggcccacctaatgtcctagttcccagcaaaacttcaccacaacctccactaataatcacaccctaaaccactgaggaaatcacagacaccactgacactgtttacagctggaaaaattacacagagactatacaaccacccacacctagagtcaaggccaaagtgccctacccagccaacaccgtagataaatcttcaagaaatgtcatcccctatgaaagcaaattcaaaaaactggagcaactgttatatcagatgcacaaatgatcaatgtaaggacacaagaagcatgaaaaaataaggaaatatggtatctccaaaggcacaccataattatccagcaacagattctcatcaaaaagaaatttaagaaataccccccaaaaaagaattcaaaatattgattttaaagaagctcagtaagacacaacagaatactgaaaaataatgcaaagaaaccagaaaagcaattcaggaaataaatgagaaatttaccaaagagatagatgtcataaaaaaagagaccaaacagaaattctacaactgaagaattcattgaattaaataaaaaatacattctaaagtttcaacaacagactagatgaagcaaaagaatctcagaacttgaagagaggtattttgaaataactcagacaaaaataaattaaaaggataaaaaaagaatgagcaaagcctatataacatcataaagtgaccaagtatttgaatttaggatctgagaaggtgaagagaaaatgaaggagttagaaaacctatttaacaaaacaatagataaaaacttcccaagtcttgcaaaaaactttagatatccagaaacaagaggctcaaagttctccatatagatacaattcaaaaagttcttctgctcagcacattatagtcaaaatatcagaggtgaaagacacagagaaaactcaaaaaagcaagagaaaagcatcaagtcacttataaaggtacgtctgtcagactagactaacagcagaaaccttatagactaggaaagaatgggctgatatattcaagatgctgaaaggaaaaaaaactgccaaccaaggataccatacccagaaaagttattctttataaaatgaaagagaaatgaagtctttcccagacaagcaaaagctgagggaatttatcaccactagaccagatctataagaaatgccaagggagtcctacacccaaaagtgaaagaacaatatctaatatcattaaaacacatgaaatataaaaactactagagcaaacatacaaagaaggaaaagactagaaggttaccactacagaaaaaccacaaaaccacaataataaaaaataagagagtaagaaaggaacagaggatacacaaaacaactagaaatcagttaataaaataagaagaataagctctcacatatcaataataacccggaatgtaaacaaattaaaactttcacttaaaaatacagactggctgaatgggttaaaaaacatgacctgactatacactgcttaccatactcatctcacctgtaaagccatatactaactgaaattaaaggatgggaaaagaacttccatgcaaacaaaaatcaaaagtgagcatgagtggctatgcttatatcaggtgaaacataccttaagtataaaacactaaaaagtgacaaagaatgtcattatgtaataataaagggatcaactcagcaagagctgcatatatatttagaaatacaacaattctaaatacatatgcactcaacaccaaaacacccagatctataaagcaattattattagatctaaagggagtgatagactccaacacagtaataggaacgttaatagcccactctcagcattagacaggtcatctaaacagaaaattaacaaagaaacattggatttaaattacacattagactaaatggacctaacagacatttacagaacatttcatccaacagctacagaatatacattcctctcatcagcacatgaaacattccttaggacagcccatatgtgaggacacaaaacaagtctcaacaaattttaaaaaatcgaaatcatatcaagtatcttctcagaccacaatgaaataaaactggaaaccaataacaagaggaactttggaaactgcacaaatacatgaaaattaaacaacatactcctgaatgaccaatgggtcaagaaagaaattaaagaggaaaaaaaaattctgaaataaaatggaaacataacatatcaaaacctatagggtacagtaaaagcagtgctaacaggaaagtttatagcaacaaacacctacatcaaaaagtagaaagatttcaaataaatgatctaataattcacctaaaaaaaactagaagaacaagaaaaaccacacccaaaattagtaggagaaaagaaataataaagatcagagcaacactaaacaaaacagagacaaaaaaaatacaaaggatcaataaaaggaagttagttttttgaaaagattaacaaacttgataaacaacttgctagaataaccaagaaaaaaagagaatacccacataaaatcaaaaatgaaaaaatagacaagtataactgatatcaaagaaatgcaacagattatcagggactattatgaacaacaatacactcacaaactagaaaacctagaggaaatagataaattccttgactcatacaacctaccaagactgaatcaagaagaactaaaaaacctgaatagaccaacaatcagtaatgagattgaatcagtaataaaaagtctcccccaacatagaaagtccaagacttggggcttcactgctgaattcccatgtgactgtcttcttacgtgatgttcagatagagtctacattccctcttgaatctagtgggcttgtgaccacagtgaaagactaagtcataaaaggctgtacagttgccacctggcctcttggttccctcttgggacctgccaccatgctgtgacaaagtcaagcagccacacagagaggctatgatcctaccacagcaccaggcaaggtccctgccaagagccaacatcaactgccagccataacttcaaggaaacaaggcttcatattcttccaaccacccactttggagttgtccccaccaaatttcagacttgtgagcaaaagaaatttgtcattgcgttaagctactctgtatggagatggtttgttaccaagaatagacagccagaacaatgggcaaagcccccaatactggacccatttcctggcatagaatagaactggcctaaaaagaaatgggacttgcttctctgcctttcatgaattttcattatttgggttgattctttattaacattagactttctctctgagtcccagattaggctgtctataagatatatcccagctgaaattgtgtgtgagtgtgtgtgaatgcacactatatgatggttgaattgttgccagtatttagtaattagatttttatttaaacacacacacacacactcacagagagagagagagagagagagacagaaagaaagaaagaaagaaagaaagaaagaaagaaagaaagaaagaaagaaagaaagaaagaaaaagaaagagtaaagagaatctaaattttgtcttctctcaaaataaaagaacaaacagaagatctggcaatactgaatttacattcctttttaacagtaattcactcacaaaacccccagttccctcagtgccatctcctctctgttgcattacatcctgcctgttccattcaagctctcatcactcttttttctcattttttaatttatataaatgtatgcgttacaagtgcagattctttacacacagagattgcatagtggtgaagtcagggcttttagtgtatccataacccaaataacatacattgtaacaaataagtaatttctattcctccacaccttcccactccttcacccttttgagtctctattgtctatcattccacactccacatccttgtgtacacattatttatctcccacttataagtgagaacatgcagtatttatctttctgcatctagcttgtttcacttaagttaatggcctccagtcactcttagatttatttcctgacatctatagacatttggacttgtgacatctattaagccaatgattctctacctgatcgataaaaatttacacttacatagttctcaaggagttaacacccttttgaaagaagagtttaatataattaggaaaataaaagtcagaaaaatttttaaaaactaaagttttagtttaaaattaaatttaaaaggataaaataaaatacatgccaaaaagccacatgatgaggtgactaggatagcaacttaggttattatcatacaccctggtgtaattgtccaactcttagtggctgctgtgcatttattgatgccccgggagccaatgttttttgtgtcattgttctatataaatgttgttctcgccgggagcaaaattacacaaaacatgaagtctactaatagaatcaaatatgctacatttaagaatcctatttatggcctggcgtggtggctcacgcctgtaatcccagcactttaggaggccgaggcaggtggatcacctgaggtcaggagtttgagaccagcctggccagcctggtgaaacccggtccctactaaaatacaaaaatcagcctggcatggtgacaggcgcctgtaatcccagctactcgggaggctgaggcacgagaatcacttgaacctgagaggtgaggttgcagtgagccgagattgcaccagtgcaatctagcctgggcaataaagagagactttgtcaaaaaaaaaaaaaaaaaaaagagaatcctattcactttttggtatagttgctgaaaatactcttctcacactagtgtatgaagaaccttaaataaatagtttctagagaggagactgaatttcgagcgttggagaatggaatcattcagcctgaataataaaactgaaattgatacatttatttcatttatattatttggtgtatttcatcttattaaacagattttaagttaactgtctttccatttaattgaatagcataattttaatgcattttatatgtcctaaaatgagtagaatgtttatggaaatggaaggtaaaatatgtcagccaagtaagaaaacgatcatcctttacatgtaaaaatgattttatttccttaggaataaaaatggacgggaagtcctatttattgctcattaaatgtattgagaatgcagccagtcataatttatctcatagtgatgtgtattcactaattactttaagaaaatttctatgtttcaaaatcaatctaaagagtacttaactaagtcctatgcaatctctatgaagaaccacaaacagggtgaaaacactgtagtttaaccaagtttatctttgtggtgggcctattatggcatgttgaatcagaattctactcacggcttttcatttgacatacaattggctgggctttctagaaatgctactctttgagggaaaataatatggagttaacattcaaagtatgtcccattttataatattagcatagtaagagttatgctcccttttgtagaacatgcaaggatagttaaggggcatactatactcctctccctaaacggtaaaatttcttttttaaaaaacgttaaataggtatttaaataaggtattgtctactttatattacaggagaatgagtcattcccctagtgaggcctgcatttgtggtcaaatacttggttcataaagttaatgtctgagatgctgcaggaggagaatatttatacatcagtgacttcagcagaatgcaatcctcataaaactttattttattggagttgtaaagttacttatttgggggaagaaacgattaatttatgaaaaaatagataatagagtggttttgaactttttattgttgtcactttatttccttccagagttaacagctcagtgccagaatcagcgttcaagtttgatggcatatttcagtcgaaaagaacctggggataaaattactaagaagcgcactctaaatccacggagaacactgatttaaatactatcaaagccttaatgcaatgccagaacaattcggagttttcatctggatcaagacttttagcaaagggcagtatgttcggatgaatttttataataacaaagcgtgtacgttcaccgccatccaaacgttggtcacgatcaagcaaggatgtccaggaaacctagccacctaatcattctggtcatctcacaatcttcttcttcctttttttttttctttctatttagtaaagcacccatgaacaggcaaggtggttacttaggctccttcaaagtaaatcagcagcggtcaaattaactttattggttattaaagtaagccaaagttttgtcacttcataggatattttgcctggggaccttcgattttggtctctaaatgtggcttcctgaacagctctcggaataggaaagtccctaagcgattcttaggggcccttcattcttctggagaatggtgtagctgacatcagccccgcgcctggaggctcccaaatagccacgatttgggaagttctgagatttccactcctagacagcaagtccgcgacgtactaaagcgctctgtcccttccctcctctgagagctgtcccattaggtccccaaagccaaagcctaggtccttctcccttcccatcagggatgaagcggggtgtattgcaggtgtgtaggcgggggggcgtctattaagtggggcgctggggacaggaaagtgttcaaagaaggaaacctgcctggggtcatccgtgctcggcttccctaccgcgcgccttctggggctccgggagagcaggcgctgcccgcggaggcgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggacc

SEQ ID NO: 1209 - DNA, 967552 bp, Homo sapiens
cctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgcgcggggtcgcgggccgggggcgtcgcctcggggcgcggaggcgcgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctgccagctagcatcgttttcttttgaagtttgctggtctttaaaccaaaacacccccctcaacccagaaataactattttaatacgtcctttggtaacgtctttaaaacacattagtgaactggttttgctgatggtagttttaggaaaattaacttagttgtattccaagatacagctaacgaacaatcatggtaaggaactcgatattctgagattggcgaagatgagagcattaaacttaaattagctgtgttctgtgtcctgtgaagatgatttatgtgtagtaacatgacttaaatgttgtaacattttaaaggtctgagctcaaaactatcatccaatagcttaacaacgaactcatacttttttttattgatgcttatgtaacgttatctaaattgtgcccctccacccccctccagctttcataaatgctccctcttatgttttactacatgaaaacaaattgccatatttctggttaatttaactcctccattacttggaaaattttcatttcacttatttgtgctttttgcttaatgacttactctggaagaaaagcatttattaagtcattttgtacagtgggatctgtagattgttagagcaaccaggttcaagtgaagaaatctaaatcacttaggatgacctttaaaataatgtgtttattaagttttctttttttaaacagtgacttgcattttgcactaagacctgtacgttcatacatttgaagattggtgcacagactgaaatggtggggaaaaaatctgccagtggctttgttttgaagtatattacatagatttcaagtttttatcagttgcactttgaaggttgtgtaaagcattgcattttaacaactgaaatgttaatgaaaatacattttaaaaatatattaaggcaacaaccgaactttgttaggaatattttattcctttttggcagtaaaaacattggtacctgttttacatttatatggcttatgaaagtgtacagatcttttagtgtaaaatttcagataggttgtcacaaattttaagttcattgacgggtttctgttctctttgctctgtgaaatgtgtaatatatccatctttttttatatcgtattgaaaattcatattacagaggagatgtcaccatttgacaaaagctcatgtatcttgaaaatgaaaattctggtgctgttataagagatttctgatgggatgatgagttggtcatatgtgcaggagtgcattctcttgaatcttatcagatgtaacattctaaatggaatagttaccactacgttggagcgcctcctaagtaccatattattacattgtagctaggtgaagctatgactaatttctctgcacctcatgtaagtaggctaggtcgtgtattttgagaaaaaacgtgcgacattgatcagtaaaagttacatttttataacctaggttacagaccctctatgtaactgatcatgatgggaaccgccaggttcaggtcttccaaatgtaactttaatatgccctggagtttcttctttctatgcggtgatgagaatttctgagttgtatgctctgcttattgctgtgtgtttaattgcttgtgactttcccggattcctaaaaagccaagtctttaattctggaaggcaggtggcaacacatgctttctttatgccatccaccaaggagccagctgtgagtggtttggaaggatgacttctgaggctaaagatgtataagcagtcttatgtgtgaagtccgtggtgcctttagctttactgctggactctttacaggcttactgattctggcagtgttcagtagacctcctagattcagcttgcattcctcaggcctagaaaggataggaatgttcttgtccatggggctgtttgttcatagtcctcagtttctcatttgaaattgtctccacttggacctatggttctccagctttggtatgtgttagaatcacctggggaatttgatgaagctgtagagtacctactcttcctcttccatgagccacatttgctttccatgtgattataatacacattggaattcgagaactactcacttattaccttgtgtttccccctattccagacacctgctgacttcctggaaactctctagcccagtgtttctcaaacttggttgcacattggaatcacctggagctttaaacttctgatgcctggatgtcactcctagaattggttttaataaacttgaggtttgatctgggcatcaggatgctgagacaccccctcctccctccaggtgattctcatgtttagccaagtttgagaaccactgctctaatggttttacgtgaggccacatggcttgatttccctttcatgccttcctgggcttattgtcctcccccaacaattgcagtgacttttatggaccttgggcctgtgttcacttacacctgttccaggttcatgatttgaaactcaacagagtacactagcttttcacttatgtatcgtttattcctactgaaactgttgagcccctgctttgtgctgcctgaggtgtacatcggaatcactggtgaaaatttaaaatacagttatctggactccacctcagaccagttggttctcagaagcatgcatttaaaaactcctcaagtgattcttgtatgtttgtgttactttttttattttttatttttaatcctcgtgttggttaatcccataatgtcactcaatttctctgtcatccttagcctgatttttctgtggtctgggtcacttttctcaggccaattcccagccttggacagggtgtactaattaggcatttctgccacttgtttgctagagtgttgagttcactacaaatctagcttccttttgggcccatgttgctttccattaatccagaagtactttgcttcccctcctcctaacctactccctttacaactttgtaatttgagtttcaactggaacttgagttctagactcccttacttgaatatcatcttaataaagagtcttgcttagtgagtgctcagatagttaattaaattttattaggccactgggtatttaacagacaactggtctcttggttggttactgtcttccaaatccaacaataagcagttattaccctctatgcagtctgcatagccacctgtagctgtcctttattgaacctttacgtgccaagcactaagtgctcatttattcttcacagcagctcctgagaggtagacagcatttttgttctcatcttacctatgggaaaactgaggcattcagatgttaactaactttcctgaggtcccaggaccaggagtggtgatgccagaatgaaaagtctgatccagagtctgaacataacttgagttcataacccctgggctggagcgtttcccatgtagcctctgcctttataaggagagggaaaaatgggcagcaatcagatctgtaccaaagggaaagacggtggttgatattttctaaaaacagtattgagtaatctgacctcaagttttagataaaccttatttacgattatgattgcaaaataaaaattacataatttggaaaatagagatgagggatgtatgtaaccccttccatctacacattcgtctcctctaagaaaatgactatcaccattttgatgtattcccctaccccaatttttctttcataacataacatgaattccagcttcatgatggtctgttggcagagattagaccaccccagaatggactactgggagtgcaccaactatttatttgaggaacatttggaaaattcttttatctgcactgaagtgtatgaatttgagtcctttaactaaaggaggtggagtttgtaaggtactgatcttttattagtttgccttagcacacattttatgtaaacagttaagtttaggctatactggggtttatacctaaccagaagtttcctgggccctcaaatactgagataaaacaacgtggaaggctgcaagttaagtgggtaattaagtgatatcaggtaagactgtgtagtttaattctccctaccagttgcctttatgttatttccatcctcagagcccctgtattgcttgtattggaatacataggatttggcgtctaaggtggcagaggtgtgtggcatgtagtgtctttctgcctgcctgccttacggtgtcccagagatcagagactggtaatgtcagctgactgaaactagagaatggaatggacacaaagtgaggattctgattaggtcacggcttaaatttctctaagaagtaaagaaagtggtagttatgagagtagacctccaggtccaaatgcgttgaaagttgaattaagctcaaggtggggaatgaaaatcacattgaaaggtgtagtataaagaaaaattaaggtttatttacaaaagaaagctattgatgttttgttatttgattaaatactcctggtacccaattatacatttaacccaaagtaaccgagcattttaatttgcatagtttctaaaattttatttgacttcatttctgtaaggcattatcttaaatttccccctaagtatgtacacctcttttttttaaaaaaagggcataaacgttcgtagccataatcctgagggaggacatattttgtcagttgggacagcaaatatggcacctcctgccatcctatggtagcaagtagaaagaagctataggttcttcagtgaatccctgaaatgcaaaagtctgtcacagttagatacctacctgccagttattgatcctatacctgagatctgttctggagaggttactactcttagagcttcattatgtgaacagtgttgccactaaatccaaatacaaaaatcatgattattatgggagcattgctgtagggaacccttgtttatgtatgtgcaattctagtgtttaggtggttggcttcctgacagaaagctccaaagccagaaactcattccatcagcctgataccaatctcctgtgggtattgtgggaatgaaagcagtttttataaagctttcctagaaacatggatatagtaaatggaaaagacattgggctaagtatcagtaggcctcgtttatacttcattctgtaactactgtgcaatatgaggaagtctattagtctctctgagtctgttttctcacctataaaaggagggattagactagatgttcagaattgttctactctgattctctgatcttctatatgttgtcttcctttctgcccttcactagagtctgcatgtgtctcctgtctggggattctgtaactccatatgtcttagcttagaacctaattttcttcattttacttttctcagagtatttacaatgttgaagacaactaagatgcaatgtagtatttctccttaggtgctgccgtctaacacatgatatatttactctagcctaaaaatggttcatgttcaaaattttaggttctgtaaaacaaattggtgccataatttatcagtataagcctgaaatttggagaaataaattttcttaaaatgtgagatgcttatttatatacatggctggaagaaggggcaaggctaacaaatctggaggtaattaatgcagtgagaaacttaaaaagatatgagaaaatggcgatggatgagaatgtttatatttactgtacagtgaccatcagtaatgaaagagattagtagatgtctgtttttgtgcttaacataatgttatgttggtttaattgtcttcattaggggcttttagtaaaacaaagggtctttaaaattaacacagtaatttttcactttaacaggcttaactggcactttattgatatacagacaatgtctagtgaagataacagctatcaattaaatagtccaatttcttgaaaacagatagtcaggtaaatctatttctgatttttggagattaggtagatgaacatgggtaagactatagtttctgcagtgtttttggctttggttcattttcaaaaaaattttttttaaatggataaggctaggctttagagttgtgggttcaaagaatgggctagaccctggggtccatattattacgtagaattagtctttgtgcagtgtttggttgccttttctcctttctataactctccatggtattctagacctaattctttaccttgagggggttggaagctctcaagtgtgtaagcttaattttacaacgatgaatagtctttccaatgagaaaaaaatagagggagataaccacgtaatgactatggtgatttggggaggaatatggaaacttggggagctctggtagttgcctttattaagaatagttggtagcaggaattttagcaacccaagcaggctaattagaatatatttcagttttagagtaaggagggattttgtatcataaaggtataacctatcatacttaactaagggtgctgatttccacaggtggtagtatttgtgagtccctctctctggtgtgatccttaatttattttgtgtgtttgtgagcctgttttcaaagtgaaggtcagttttgtcttctctctaggtgttaggcgcgatgcaaaaagaatgaaagagattttgatagggtatgaccaagcccttctatacaatggatgtcagtgttgatttttatacacaaaccaccagatggcaacagaaaaagtgttcatataggatataatctgtggtttccacagccaagttttttttttttttccttccatgattcaccactttttagtatgcttaggtaacatgtacaatttctggctaagagcaaggcgagtttataatacccagctatgtgaaatcaaaaccaggtaatagaatagtggcagagtgtcactagaaaaagattttttttttttttttttacatgagtgtataaactgttcccaaagggagcaagtttccagggatgcaactttgatttatattattgtatagtcatgcttttacttctgattttttttattcagcatttattcagctcttacagtaagctgtaatgatttgcagaacataaaagaaaacatggctgttaccctaaagcattttatgtaacacctttaaaaggaagagatacatgagttcacaaacattaagcatatttatgtatttgccggccaaaggtatttttactctatgtagaatttgttttatttttgccttgtaggcatattccctttttctaagcgtgctgtcttggctcttctaaaatggttgtcttagctaaaactcctggttgcaagctagaaactcagtctgaactacttaagaaaaaaaggattttattgtaggagtcctggggtatcacagtataattaggagaatttctttacatttggcaagtttagtattcacttccacctagggaataactagagccacatgctcaaaagctcccgggtactgtccttttggccatcatctctcagtttgcttctgtgtctgtgctggcatcattctggattcactggaaattgctttctttttgtggctgaaacccagctgtcaccactctttgcattcctattgcttcagaccctcaaagatagacttaaagctttggtgctgagtccaaaatctgtgaaatgatcagatttgtattttaaagtcatcttgagtggggggaataaaccattatttttgttgcaaaattgagaatgggttggaagaaaccagaatgaatgactgtagatgtgttggactgtaacaacaattgaggtgagagaaagtagcagcttgggctaggtggtggtgctggagatggagagaggtagatgcactagagagggatttaagaggcaaaaaatacatgggatttggtcatgggttgggtatggaaggtgaatgagaaaacatcaaaggtgacgtccaggtttctggcttgcatgactagttggctagtataaccattcactgaggttggaccacctctgggcagcatgatcattagtttggttttgaatttattaatgtgagggacctttgaggcatctagacagagctgttaagttgtgtggatagatgaattttgcaaccagaggagggtctgggcttttggtataaatatttgtggagacagtatagcatactgtttaagaggataggcttggcataaaataaaacaaagttaaccacttgctagctttgcatccttgggttggctacttaatcttcattaatcttgacttttcttatccctgaagaattgtgtaatgattctgcctgcttcctgtagttgttgtgagggctgattgatatgattgtaggtaaggtgtttttatcgcattaccaagtacatagcatgcatccagtaagtgttaggtggtgttatttattcttttgtgtagaggaatcctgccttatttatcttttcttttcctgtaatattagggagtgatgagtcacggtagtagagtggggagtatggacagttgacataactggagaggtattatactaatattagcctggctgggatacaacctggataaattgcagggcgatgggcctggggggagagtagagtgatggagatgagttagggaatggttatgataatatagaaataatatttgaactgcagtagtattgggatggaaaaaatggaatggtcagtcttgcttagagaggtaaatagatgagaacaaaaggccattggatttgttgattacatgggtaatggtgatctttttgagctcaatctcactggagttctaggagtataaagtagattgaagttcattatggaatgaatgggtagggagaaaagagtcaaccggtatgttcttgttctattgaaattctcaaggaaagagaactatggaggcatttgaaatgcatagtgacaaaaatgatcttaaaataccttgggaatattttttccaaatttgaaatctattattgaggctgggaaaaaaaattgtcatttggcagaatggtaagtaattatcacaattctctgaagtgatcatttctgtttcatatgttgcgactcgtggaggcttctagcaacattgtcaccaaagctgaatgtggaggactcccttcaccaccctgctataaacacacagaaactgtggacaaaatataacaagaacaaacaagcgtttctgaagtttaaaataccagggaatccctaggtgccagctatgaacagaaaattcagagctagggcgttaatcaggagctcaaggcctgtggtggtttctgatctgaatacacgccccaatggcttagtcctgagggtctcatggaggagtaggaggcatggccttgggtctgcatagacttggaaggtggagtaaaggttctctagcatcaaaccttgaagggcttttccatctgtgaaaagagaactagaaaaactttgcctactggtttgggaaagtgtaggaaacttgctgtcctcctggggttgtgatcattaggaataaaaaagggacatctaaactccaagattgcacctcataattggggtggattcaaatttaacatttcttatagtgcaactaaccttcaagctgagacaaattagcataaaatctggtctagaactatggaaatgaatagagccctcaggtctgaaactgacctgcagagcaaattaaaaatctaagactcttgcagaagaaacaagtcatgctatagatgagcttgcaatacaaaaattgcccagctacacaaggaaatgaatcaccgtgaaggagagttagcagatgaatagtattccaggagattgagatgataggatatatgaaagagattaattgcttaaaattatgagagatgaaaggggtaagatcataatgaaagagcacagattagaaaaataacatggagttggaaaagaacccagtaggacttctagaaatgaaaataatggtcattaagtgtttttttttaaaaaaaataacctcaatggacaggttaaagagccaggtagatataattgaagataaaaactgtattgaaaaatcaatagatttttaaaggagatctgaggaaatttcttcgaatacagtaataagggataaagaaatggaaaatgagtggttacaattcatgaactttagaatgaggaagtctcatattaccttctgtgagcttccagaaagaggaaatagagtaggagagacactattagaagatagaatggctgagaagttttcataatcaatacaagttctgcctgagctcttagtttcaagaaccgtagtaaaccccacacaggataaataaaaataaattcatacctagacatattgtagatgaagccttagaaaataagaggaaagcagtctgaggaaagttgatgtctagactggcaggcattttgttcatagcagaagatgattgaataataacatcaaaggctggaagtggaaatccactaccaacctagaattccatgtccatataaagtattatgatactcaagagtaaatgaaatggctgggtgtggtggctcatgcctgtaatcccagcactttgggaggccaaggtgggcagatcacgaggtcaagagatcgagaccatcctgaccaacatggtgaaatgccatctttactaaaaatacaaaaattagctgggcacagtggcatgcacctgcagtcccagctacttgggaggctgaagcaggacaattgcttgaaccctggaggcggagattggagtgagctgaggttgcgccattgtattccagcctggcgacggagcgagactccatctcaaaagtaagtgaaataaaggttgtagataaaaaacaaagttgatgattagtagttggaactactaaaaaatgcacttcaaaaagaaagaaattgaacccaggagtgaggtacagattgtaaagtgctaaatgataggaagcattgttgcaatgtgccccttaaatttatatgtaattgctttgcagtttgagaaaagtgtcagcagtttccactacaagtactcatactgcagattaacggattagcgagagtgtaagcagtagggacgggtttgggagatgttggtcaaaggatacaaaatttcatttagaaggaataaattcaagagatctgttgtacaacatggtgactataattaatgataacttgttttattcttgagttgctaaaagtaaattttaagtattcctaccacaaaaaagtatgtgaagtaatacatataattagctctatttagccatttcacaatatatatgtgtcaaaacatgtcgtacacaataaatatatacaaatttttgtcaaaattttaaaaatgtatgtgagcaggagttaattcatctaatgcctcagtgaataaagtgctgtgttaaaggtatagtgatcaataacagttgcttccttcagagagcttatagtttattagggcatacacaccaaaaaatacagcgccaatgtgcagatgaccctggagagccctttaagccatacaggggattcagcatctggtagataagtgttaaataggaccctagcagggatacatataggcaagccatgttggaatctggggactcagattggcacgtggaaatacaaagatgaaggattcaggtggaaagctgctgatcaacaggagtgaggaacccaacacctagatcagaacaggattcttgccaaaggaccaaacatcaagaccttcatatttagccagtacattccaagtgacctttacattctgaattagggtcttattgtcatagctgtaggaaatgtggacttggatcttggccagcagagagttagattaaatgtgcagggtgaagcactgttcagagctgagataaagcatacacaaagaggcaagtggttgagatggagcagctcagtggatgagagttagttacagatgagattgtagccatttgcatttttgtggcaacttgatatgattggttgatgctcatcaattcctgaattttgaaaattacttatatctgtatcatggaatgttatagttggaaagacagaggccatctgcatctctaactttgctgtcttctgtggaatgaaaagcatgaaatataagttgtgttatgcttttatatagatgaatacttcatagcaattaaaatattataatctagtgttttattagatgtagagatgccttaagaggttttattttaaacccacaattgctttacttcaaaaattgctctttcttgggtgaataacgtgaatttcatcatacatcctattggcaacaaaaacttttttttttttaaaactaaacctcatttggcctgtgaattgtcccaaatcagccagtgaggaaacattgggagtcctaacccactctgactttttccttactttagggagcaagctgggttggctagagtcctccatccctatctgtgttcgtcaacagcaggtgaccttcacaaatgatgaggacctgaatgcttctggtggctttcacagtggctgatgtggcacatgagaagactacaatgttagtattaaaaaggatgtttagaagtagctctaattgacatggaaggatttctgaatatattaggtgaaaaatgaggttagagttctttgtagagtgtactagcttgtttttacggagtgcttttcttggcatcaggcattgtgctaaggccttcaagttatacagtatcatacatccttacaaccctattttatagttgaggaaattgaggtccagagaagttaaggtcactcacttcataagtggtggaactgatctttgagtgcacccctgtctctggagcccctgttcctagtcctctccacatgaacagcccttcctgggagtctccaagtaccagctttctctgacatagggtcacgcatgcacatgcaagtagaaaagggtgtggaagtcgcatattataaaacaggtaagaaattactgttttataatatgatgcagtgagtatgattaagaaatagaccagcctacttaatgtgcttatctctgttatagggatttctctttttttcctgaatgttctaagttttcaaacattcagcatttataactttttaaaaattatgaaagcaattagaattatttaccataatgtattattactggattttaggaagaatatggtactaaagttgtttagtggttcagactgagagtgcattaatgggaacctgggattttgtttgtttgtttcctatttgagggaacttgaattattgttttgggccttattttgttcatctgttggaaaaaagcatgccatattttaagttacaggctcattataagaataaaaaactcctttgaaagatggattgataaacacatttgtaccatcgatttctggttagtgctgtttaatctttatgattctagtgtcaaattctccccacaactctaatatagagtcaattcatacattcaagttaatggtagatggtagatagtatgcataaaaaatttgaggcatgaagttgtaaatgaaaattaggactaaatttaaatttaaatatacataaattttgtatttaaaactttcagtacagccatgtaccctataatgacattttggtaagtgacagactgcatatataagggtcctgaaagattataattctgtatgtttatggtaccttgtctcagttcagatttgtttagacacataaatacttgtggtatagttggctcctgtgttcagtacagtaacatgctgcacaggtttgtagcctgggagcaataggctatatatcatataacctaggtgtgtaggaggccataacatctaggtttgtgtaagtgatgtctgtgatgttcgcacaatgacagaattgcctaatagtgcatttcttagagcttatccccatcattaagtgatgcatgacctgtatattcaatataatataaatgtaaattggagcattatgtatatatgctgtagtgtagtaggcaacaattgggtagtgcttggatcacagaaatgtgccactttctgagaatgccctagtagatgtacacagcaggggcctcactggccatttttctgccatgtcatctcttggcccttttttatggagctctacaaatcactgcagcgtggaactggttcttgcccatcccgaggtttggatgttcagtttctcctgaagtctacagtatttgttttcaattgtatcccccttttttgcttaaactagacagaattggtgtttttgggcaaacactatttaaaccttttaaaaagggtctgggggtctgggtactgtggctcatgcctataattttggcattttgggaggctgaggtgggcagatctcttgaggccaggagtttgagaccagcctgggcaacatggcaataccctgtctctacacaacgtacaaaaacttagctgagtgtggtggtgtgcacttgtcgtcccagctacttgaggggctgaggtgggagaatcacttgagcctgggaggtcaagtctgcagtgagccatgaccgcaccactgcattccaacctgggcaacagagtgagactctgtctcaaaaaaaaaaaaaaaaaaaaaaaaaaaaggctatcatgggagtgcttaataaacattgctagcaatttcgaatcctattttacataaaagattatagtaatttttaaagtaaggtttttaaggcaagcaaaggaacatgtattgatttctgagtatattgcacatttaattacaacaaatgaaactggtcatcttgtgtttttatttttgttttcatctatctgctttccagactaattggggagcaagaattccttttcctttccctgtttcctttagatgattctgccccttcatcttcgctcctcatttctgtagcttgactttgttctgtagctgtgtgctgttccctgggtgcctgccaggagggcgcttccttctgcctattcctctctccattcattgactatctttaagtggcgttttttccttccctacctgtattaagattttctacttgcagactcttctcccatgttcacaggagctggtttttccttgttgtgcatggaagcacctttggttcatgtttaggatatgagcattgttgacaggcactgttaacaggtgaaaacatctcaaaaggatgcttgattaaaataagtattttgttgttcataagcctctttatttggctttggtaaactaggagcctaaggtaacctttcattccagttttttaagtttttgtggttatattatgcagtttttattatgcagtgcttatttcttatgacaaaatatgagtaggttaaattcataccatatcaaaatgtagtagtgaaagtctctacttttctgatcctcagccccctagttccccctgcttgaggctatcactgtttccagtttcatgagtatttgttcgctgatattttatgcatatacaactatatatgtctttccttgcaaccctttgacattatacagatggtagcatactcttagcttggaggctagtcccagcgcatttttcgcctatattgtgtcttagagatcatttcatattagcacacatgggtataccttgttacaaacatgcacacacagaaaataagctttaaagccgtctgctgtagtgcattggcattataacatagtgtcatgagtcgtagagctggattcaaatcctgaccctgccatttaagagcttgtgaccttgggcaagttgaatcacttgtctgtgtttcaggtgctcatttgtaaagcagagttaatctctctctcacaaggtttttgtaaggattagaggagataatgtatgtaaagtatttagcacagtgtcttgcttaataaatcatagctattattgtactcattaatttatcagatcaaatgaacccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaagaaacacaggttaggtttgtctcaggtatcttgtctattaaatgctaggaatctgtaaggctgtggttcagtaactgtcatcagctacgttgttaacatacagtttacaggctattcagatgtaaaacaacagcatttatgttccattcaccccttaaaaagctacataaatatgagtttcatccacggaggagaccacccttagattttaggttatgtctctgactttgaagggagagagtctggagcagtgcgaagtcttacagcttcctgaccttttgggaggttgggaaatatttatgtgtgtcctgtgactggtagttagcagaaaaggctcccaagctagtccaacacaactgatcaggaagttgggtcatccaacagaaaatgtagcccacgttacagttagaaaattaaaaatccagggctaggcaaatgctttcttaaatatgatatgaaaagcacaagcaataaaaggaaaatgataaattgaacttaatcaaaatggaaaacctctgtgcttcagaacacgccctattgcctcttaccctgtgtaactaggagggagcccatctgaggacaattcaatacctcaggagggcagagcggaagagggcaagaccctgagctttgagaacgtcactgggcccccaaaatgaaccctgtaacttgctgtacctctgggttgattgttgtgtgagatggtcagtttctctgttgtgagagttggagtttgttacttgcagctgactacatccttagtgatccatgctgaaagaaaaagttaatgccagcccaggaagagagcacacagtgtaggagagcgtgcattgcaggctttactggcagaattgcaaatgtgtaaaggtgatggattttatttcaaaagccagagttacctaaattctcacattgtagaaacttgcttcagtctgtttcttatattcccaattttaaaatactttatacaagacataggaaaagaaaaatgcaggcttttgatgctgaaacttaaattttgtaaactaaaatccagtggttaatttgaaaagtaacatcaagtagagtttattctatgctcaatattaagaattattgcttagtattaagaaatttcctatacggatgtagtgtgttttacagtggcgctatgtccttataaactgataagctgaaaatattgtaagttgaaaatgcatacacctaacctactgaacatcatagcctagcctaccctaccttaaacgtgctcagagcacttacattagcctagaagggcagaatcacctaacacgaatcctgtcttataatcaagtgttgaaagtctcatataatttattgaacactaagcgaaagtgaagaacagaatggttgtatgggtcccattgcaaagttgaaaaattgcaagtcaggttctctctgtaattcaaattatgaacaagtcaatgacagaaaaccatatggtctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagtgcttgttcacaaattcagtgtacaaacttcagtagcttttgtatatattaaccatttataatcaacaacaaagaagacctcattcacaatcacaagcccaaaaacttgaaataaacttgataagtacatgatttatatgaagaaaaccataaaactttaaagaggatctttaaaaagtttgaaaacatgaagtcatactttgttttaacataagaatagctaactttgtaaaatgccatgtttctttgctctgtaaattaaatgtcatctcagtccaaattgtggatttttcttttttttaacttgacactctgatatccacggtaattggagcaatggaagtcttggatttgctgcagtgtgttttgcatagttgaaggactggggaattgggggagagctgagtctggaatcaggaacccactgttgcctaaagtggctcactccttatgagcaataccaccccacttaactgatctgaagttttccacttgggatatgttccttttctggaagacttgtgacttctgcccccaagctgtgcacaggaggactcactgtcatcagatgctgtggttacacaaaatatttttttctacaattgattttcttcacataaatcgtgtacttgtcaagtctttggaggttgggttgccttactgtagtgtcatagccagtcacagacctggcagcagtgcattgtaactctgaaagcccttcagtggctgccaccagaaggtctctctcctgcatactcctttggccactatacaggtcttccaatttaacctacactatatttttactggccttttttccagtgctttgaataaggtacgtttttccccaccccagaacctttacatattctgttccctctgcctagaccaatttctaaccatgctctgctcctccagtccccactacacacacccacacccccacacccccggtcaactctaattcacctttcaggtctcagattcagtaatatttcttcaaagagactttttaaaatttttcagaattgattaggtccccttgttatgcccattatttcagattgtatgctttttttcccacagcacttaggtgtaatcatgtattttatgcagtttctttatagtctgtcactcccattgaaggacacagactgtgtctctttagttcactatcgtatatctaacacctgtaattgtatgtgccacatagtagacattcgttaaatattttttagtgaattaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgcaaaaaaaaaaaaaaattgtgcattgtgagaaaattttagaaaacaaacactagtggagacttgcctttacatgtcacaaacttatgctaaagctgtaattgttaaatcagtataatactgacccaggactagacagaaaatgaaataaagtctagaagtaagcccaagtacatatgggggtttagtgtgtgttcaatgtatttcattttaaagtagtgtaaaatagatggttggttatcagcctgcaagttggctcccagtgatcattgccttgtagtattcttatccgtgtatagactctccttacatgtgtagggctgacctgtgtaaccagtaggatagaatgaagaggatagtgtgtgacttccaagggtaaatcatacaagacattgtaacctctgtcttgtgctcccttgcatcatttgctcttgggggagctggctacctttcgtgaggacactcaagcaactctgtggagaagtccttgtggagaggaactgaggccttggtcaaccgccaccatcaacttgcctgccatgtgggtgagccatctgggaagtggatcctccagccccagggaagccttcagatgacggcagctctgggaggcatcttgcctgcaacctcatgtggatacagctaaaccagagccacagaactaagctgctcctgaatttctgactcacagaaatggtgtgagaaaatgctgattgctgttttaagccatgaagttttggggtaattcatatacagcaataagtaactgatcagatggattattcagtcagtggtgtggggatagccagctagaattggggaaaaaataagttggattcttactgaattctgcatcaagaaaattccagatgtgctgggcatggtagcttatgcctgcaatcctagtgctttgggaggctgaggtaggaggattgcttgggcccaggagtttgaggctgcagtgagccatgatcatgcctctgcactccagcccgggtgacagagtgagaccctgccttgggggaaaaaaagaaaatctcagatggatcaaatatttaaatgtaaaaatggaaccgttaatttattataagcctgaaaaattttaaacttttggggtggagaaggatttcctaactatgaatatgcaatccccaagccataaattaaaataacaaaccttataaacagggtgaaagataaaccaccaattaggaagatttgagcaacctgtattacaaaaggcagtgtctcggagaactcttaaaaatcagtaagaagactctataaatgggatggctgaggacacgaacaggcaattcacaaagtagaaataaatgtatgaacagatattagccaagaaatataatttagaacaatgagaggtcacattgtatttaccagattcacagaggtgaaaaagaccgacaaggttaaagagattccttgattggcaggaagattatacggtgtgggtggggacacagatttgtctgacttttctggagggcagtctagtaacatgtctcaaaatgcaaataccaaatgagtgcacattgattcagctattgtgtaaatttatgctaaggtaatcggacacacacagaaagatgtgtatactgttaaaaaaaaatcccgaatttcaaaaatgtcaaattttcttcctttttcttttctttctttttttcctctatttccccttctattgtctctctttccagttcctcttggactttcctggatctgtctccacttctcaacattgtactcataccttttaaatcttggtttcttctcaatattagtaatttctttaattttaacttccttgttgccaactctctattctgaaatcgattctaacattcagccctgcttcgaaaagtttattttggcaattacttttgcaaaactaatttctgataaattttttcttttaggattctgttctgtagtgggtgtatagctgttcaatctctctgaggatatgaattagagttttaaaaacttgccttagacacgttgattgtggctgtttctcccagggtttgtggctgtgtgtcttcatcttgctccttccctcccatgctttaagatcttcaagtcctgatggtcctcagctaaatatccatgtttaacgataaaggactaggttaattaatactgcagctgccgcaggttttctctgtagttgtgtggacattccagctgccccctgcgctaaatggaggatggactgcaggctctggaatgtggtcaggttgcttggcaagcttccccgtggggtgctgtttgggtggggaaagctgggttccccccacactgctatcataagcagtacttggtcaggaggtgcagcagtgtaccctgtcaggcagagctgctgcttttcatcccacgactccccgtctctgtgtctgttgtaacagttctgagttccctttgttctctctcaagccctaatgtccacacctgaagctctccacagagaactcatccatgttgggttcctttttcactgccacacacagggcagggggctgtgtgtgggggtgcttcctagccacgctgttccaaactatatttttattttatcatttatttattatatatttatttttggagacagagtctcactctgttgcccaggctggagtgcagtggcacgatctcggctcactgcaacctccgcctcctgggctcaagcaattctcctgcgtcagcctcccgagtagctgggattacaggtgcacgccaccatgcccagctaatttttgtattttagtaaagatgggggtttcaccatgttggccaggctggtcttgaactcctgggctcaagtgatccgcctgcctcggcttcccaaagtgctgggattacaggcatgaaccactgcgccggcccccaaactctatttttaaatcaacttcttgttgagccactcttgcctgtatttgttggctctgagcttctcttggatcccttgagaactgctctcagtcatctttcgggggctacaattaacattgttctgtcttccaagagtccctcatagttttggtctcacatattttgtgttttctaggcattccataaaatatatggtctgctgatggcactggttttttgtcttgcaggattctttaattctacttaaaaacaaaagtccttgttagttcataagaccttgggtgggacgggaggtagacatttgtgctcagatgacctgttcttttttctgtgggtgttatcacttgcgtttcttcgagcatattcactttgacattttcttctgcttactgtatcagccatgtacccaggggtcaggagtgtacacatacacatgaggaaaccttgaggtcgggcagggatttggatccaggctgtgactccaaagcctgccctcttaacctctctgctgtctcttctgtttgtgcagtggggggccctctttcatgctgtttgtttacttcaaaggcttggtgtttcttgtatttctgttcacatttgtaggtaaggatctgcaactcagcgttgcgtgaaggttctcacgcaggagctcagcttcaggtgactttgcaggggaagggcagggagcatatagcggggcagggtattcactctgctgccctgctcgctggggggccggcggggtgggcttctgctccacggagttggtcactttgtcggctctgctgtcttccttgttaggacctctcatcggagagttgcatgcatgctcaccgacctcccaccccttccccggagcagacccctgagtcagacagttcaaacgaggacttgctcagctcttccagcttctcgttaattacttggccaattatctatggcctgcttctcctggcctgtgctgcactgataatgggattatgctgagcttctgctgaggaaacttttcaactgacatgggttccttctatttctttagatttgccatcattggtcccgtcacttttctagaaatttaatctgttccacaactctttattgtgcggggcaatgtgctgggcattagaaaataatggtgaagagaagacctgtcacgatggagcttatgtatggtcttgttggggagacaggcattaaacaattaatttgcacacacgtagttcttgttctgtgaggagaagttgccctgcgctgagggggcatatgaaaaggctaacttactgggagaggggttgccatggaagtccacctggagcacgtgtgacaattgacctgagattccaaggaagaaaaggagtgactcagtgaccgggaatggggataagagtgttccaagctttggaaacaggatggggaaagacctttattcgtagatggaggggaacggggtctgccagcatcactcctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttcctaaaatgatgtttatcttatggtttggcttatgtaaatgcagagtttgtcactaggtcaatatccgcaacattataaagatgttactgtgtacttactggaaatggcctgtgattggtgacaaagctgacttacacaaaggagaacattatccttaggaattcttgctagtatctcataatgtaattgttttaacgttgttaaatggttcacagtgatcagagacttaaaatctttgtctcctacacagcgttttaagagttacagaaaagctatcattttgagctaccttgagactgaagtgtctgcagaatagcacttacatattcaggctgacaatatgtgtttgaggaattggcggttcagtttggccaactttggtgttgtaacacttgagattgtattaagctgcaagtaacaaattcagatgaacagttgcttaaccaagtaacttaaaggcacaagctttaagcttttaacgttttcaagttcaggtcatgtaggggagctatgtcattaaggagactgactctttctgtcttcttgatttactgtagagtacggcttttgacctcatcataacagagtggctgctgcccctctagaaactccatctgtgattcaggcgaaagggaagggcctgctagttggcttgtcctttttattttttatcagaaaaatagtagctttcaaagaaaccacccccattagacttccgtttatatttcagtgaccagaactgtgagaaagccgtctttagctgcaaggaaacctgagaaatcaagcttttgtggttatgtttttcaaactggagcacattgctgttcaaaacaaaatcagagttctgttaataaataaggagagaatggatattggtaggcaacttgctgtgtcagctgcaggagttatgtgcttagaggtggtaattgaagtcaagagtgtgattaacattactcagggggagtatacagagtaagaagagaatccatgaagggactgaaaggaagtttagtgttgaagagactggcagaagaataggtattctcaaagggaaccaagaacgaggggcaagtgggaggaggtggtcacctggagggtgtggaccagtggtacacaggttaggagagggggaagggcagagtttacattgcccgtatgctggcgagtgaagtccactaggaactgagacatgaacttgaggcttagcaaaagagagcgacttagagaaagagcacccgcactggtgactgtgggctgcatggtgaaggggggcaaagcagtgacagcgggagtgagcccctctcaaaaactgatgccaactacgcaggacagagagggggcggggaagggggagtgacctgagggagactggggctcaagaaaagcctttttgtgttggttgttttaaaggctggcgatactgtagcatgcttagttctaaggagaggaagggccattaaagacgtttgagaaggatcctagaaggattgtattttccaacggaggtggaaggggttgagatccacagcccaggggatatgctttgaaggaaggagaaaagcacctctccttccctaaaagaaggcaggaaaggtgtgtggacagaaattctagagagcatgaaatgcgggtaattgggctgcaataagaatccagtcatggttagagaacctgaatttaattaaggtcagtgtatgtctgtagagtgccattatcttacatagaaattatttttgaaaattttagttgacatttttgaatgatacctactagtactacagataatagaagcataaatatgcacaaaagcagttaaaacttaaccgttcgtcttaaagtaatttataactaatacttattgatgccctactctgtctcagtcaaaaagctaaacaccttccctatgcacaagaaaaacctatgcagtaggcgttactagttgtcctcattttatttttattttttattttttttcaaacttaaacatttttttttgtgtagagacagggtctacctttgtttcccaggctggtctccaactcctgggctcaagtgatcctcccgcctctgcctcccaaagtgctgggattacaggcatgaaccatagcacccaccctttatccccattttaaagatgacaaaacctaggctcaaagaacttaacatgttctagatcacgtggctagtaagtggtgacaccagaatttgaaccacgtatctgactccagagtggtggtgccagctgctgttctgtggattgagccatatgaaattgactatttagcaagagaaatataaaacatcggcatttttatatgtctctacctaatacacttcctcacctcaatcattgccaaggtcagtggactgcttacttggtgccaggcattgccctaagtgttttgattgccataatctgttgtaatattttgaaatatttgcagtcttaattgtcctgatttaaaaaatcatgtttttgaatatgataatatactttaaatgagtatgtttgattagcgatgttgctttttcctatgttggcaaaattatattttgaggaaacgattagaaatattggcaaaacatagagaaaaatcattacacatctagtgtctcacaacatgaatagttttttggggcatttttcacaacatctgattcattgagtggtagtcccccaagagatacctgtgaattggtttttaattcagtagatttctgttttattgtatatttgttgacttgtgatcaacatatattctcttctatttttgaagcttattttgggtaaaaagaaagattacctttctatcttctcactttatccccaacttatgaataccataggtatcaaccagtgatattactagcaaatcacccactctcccactttactaataaaatgttgtcttgaattcttgcatttccgctaaaaaaaatcccattcaaaattatgaatttagaaatgggatgaaagctgagtgcagtggctcaggcctataatcctggcaatttgaaaggctgaggtggggggatcaattgagccaagaatgtgagaccagcctgggcaatagtgagaccctgtcactaccaaaacataacaaaaattagcctggtgtggtggcatgtgcctgtggttccagctactagggagactgagatggaaggatcacttgagccccagaggttaagattgcagtgaattatgattgtgccactgcactccagcctgggtgacagcgagaccctgtttctattaaaaaaacacatggggtgatttccctctccccagtttggaagtcttcaataaaaggataaaaagatgtgaagcggttttagccatctctttttggcctccatgtaatcagattttgtgcttatttgagacacttaaaaagtatctggctaattgtgctctctgttttgaggacctgatcttaaactggatggtcttgatattttcgtgtaacttttagttcaggtacaagaattctttaaagaggcatggacaattaattacacgactgagaaaaataatttcccccaagttaattgcacaaattactgtagccctaaaaggttaatgattatcaaacatctttgatgcatagagcctattaaatgccagtatcatttgaataatttaactagagtagtcctttcacaaatgggtctcatccaaaggacaacagtaaatagtgcctttaaaaatattttctctttagagaaacgtgttcaaacccttcagctggagtcaatcttatgggtcacaacacattcttacatttcagaatataagacattaaaacattttatattttaaatgatttagatcatttattatccttatagaactactgaggttttacttgaagcttgtaagttaaatttttgtattttatacagagttagcttaggccgtgattaggtagaaataatgggcagttatcactgtatttatttgaaatgaaacttcttttacagctattcatggaagaaaactttaatattgtattaaagcttttattttatctttaaatgccaactttattatgtatttcttaaaattgatcttccagtattttttatgtatactttttagtgctttatagttattagcaggttccacagtagtaactgaaatatactctgattttcatttttattttataaaactttgatttttaataacatatgctgaaggacactctgaagagtactaatttttttcagggatgcttttccaaaaaggattctgtggttcaataaacttgggaaagactgcgtcctatatgcttttagaagagtcacagtgtatactcacatactgaaggatttgagaaatgctagagcaaataaatctaacgttgtctaacccagtgtttcccaagcttgtctgaagacagacatttccactcttgttttacatcataccctcgaacatcgaaggacttcgctgatttgtgttctacacaaccgtcttgagatacgctgttagattagctgtagcttcccttgccacatcgcgaatttccagcattcaaatgcagcaggcatgtttatctgctgcacttacacctacgtgtacatatgtatataaatataccagtatacatcaatatgtacatttgaagcgtatatgcacacttacataggtacacacatatatgtatgcttgtatttttattttacttactgcagtacccgtagtatatagcagatagtgaaatcagaaaataattgttgagtaaatggatgagagagtttcaccagtctgtggcatacgccctgctgccttcttcaggatgcagaaaaccctgtcccctggcttaaagtgtgacattctggagaaagtagatgtgctctctctagagacacctgaaacatcaaacacaaacagtttgtcagtactgtttcaatattaagtctgtcagagggaaaagaccctgaattttgggtcaggagacctgggttcaggtatggattctaccactttccactcacgtcatcttaggcaagttatgggctttttctgagcctcagtttttctcctctatgaattgataataccttgtaagactgttgaaatatctatagaagacatcaaaaacttatttttaaccaattggaaggtacgctgtgaatgtattatcctgatacaggtgaaagctttattaaaaaacaaatgtaacttaacatttccatttcatatatataggggaagaaaattcccattttttggtgaagatactaattttcataagtaatgaacataaaaaaatatatttttttactgttagcagacaataattttttttctactgtttaaaaacttccatcctttttttctaataaaaaaactccagaatcttcctggattagcctcagacccatcgcacctgctggtctctctgcctggaatcttctttaaaacaaggtgacttgccatttctttccatcttatttcagctctcagtcaacctctcacttccctgcccaccaaaatacagcccccgtatgtatctctttatccctttacctactttattttcctttataattcttatcagacattttattgcacatatcattagtgaggtgagatggagatcatattttgtggcgattagtaagggattgtaatatctctcaataacaaaattgctttagaccaaatttttgtttgcttatatgatttttacacccattatttcagcactttaatgactctgtcagatgtataggttagttagtagtcatacttctgtaaaattctctagtagaatcaaaatacatgtgctctccctttcctctgcatggattttttttttccacatgagggaagctgtggtaaataatgttatagattttcactcgttagtaatattactcaaataaacgatgggaaaatgtttctcttgacaggattgagtaggtagacataggaattcatggaaccacttatgttaaaattgataactttaaaaaaaattggatagcagaaataagacttgttttatgtattagcatccagccaaattatcataactgattgtgtagtgtaaggttagtgatacaaagatgtgcaagatttggttttatactttatctattagaagtttgggtttggtgatacttttaataccatgcagattgcagttttagctatcatgaatttctgaatattttatgtaaaacaaagatgttgcctttaaaagagttaaagttgaagttttttaggctagaatgtgatttagctttatatagctttttgtcagactcttggaatcatttcaaaacacactcatattttgtttagagttaacagagctgtctagaagtaatttctagtttctcctaggctactcatgatgtttgaattattttccgtattctctgctgagagattcttgtggaagtagactttctgagcttctataaacattttccttctggaactatgcccagtccacctgttcaccatttacagggaaatgctgctttcctaatgaaaatcaagcccagattttccagttcagcttctgtaggtagggagtgcagctgtactgggcagcctccagtgagtcccggggacttgacttcttgcaggttttctgctgatggcagctgctatcaccatgtttatcttttgggggactggatgctgctccttcttcaacgttttggcccaagagtagacaacatatgtcataactaacacaaggctgtcatgtttaaagacatctttactgaatgctgcagaggaataaagagaggaaaacccagagagctccatgaatcatgaattcaggcattctaactttagagctatggcacattcatcttcagttagttgagatggttgcttgcatgtaagtggcttttcacatttcaaaaatggtttcccaagtgagcatatgtttactcttggctgacacgcctctgaaccagccccaagttggtgtgcatggtgctagggcatgatttcaggcccgactcatacccccaagctagacacctttgtgcagagtacatctatatgtgtactagggattgcctactgaggtttttcctagttctccctttaccttcagaaggcatagagcacctttaatagccctcctgccttggccctcatcctccctccccaccaacccctgaattcctttagagattcctcatctcctcaaagtccagaggtgggctgtcttctcccacctccttgtaggagctcaccctgatgaaggttatttcatttctgaagctctgtctcctttttggcaactggcaccagcaaggatcagatccttctaaaactgtctcctgtttataacagaatctgacacttccaacatcatgtaagagctgcatatgccaatcacagtggagtttttaatcctgtacccaggtctgttgtgaggataaatggtaattcccattgcatttttgtgtgtgataaagtatattgcttaagagagttctggggatgtatagtggtgatgattacacaacgatgtgaatgtatgtagtatcactgaactgtacatttaatgtttaaggtggtaatcttttgttacctgtctattaccacaataaaaatggaaaaatatattgcttaataaaataatacttgataaagtccatgcagtgtttactacatgtcagtaccattttgaacattgtacacgttgcggtttacttaatcctcacaacaaccctgttaagtagctaatattataatccttatttgacacatgagaaaaatgtgctacatagaagttacataatttgctattaagtgagagaacgagattcaaaccaaagttgtttagctccatagctcatgctgtcaaccactatgttaatacaaatctgcattgtcctaattttattctatatttatgttcagatagaaggcactctgggaatctggagactggggttctcagttctggctctgtgactgcaccacatttgtgactgtgaccagagtagcttctctagtcttcagttattttagttataaaatgagatgggataaggttcactgttaaatttctatttataaatgctgtggatgtgtatatatttttatgtatgtaaagttctgaggttgaataagccttattttctctgtggtctaaaccatacctatggaatctcatctgtcaaacgctatgtgattgaagattaaaaaaaaaatctcatctgtcaaacgctatgtgattgaagattaaaaaaaaaaaaggaaaattttatttgaagagactgggtctcattttgttgcccagacttgagtgcagtggcaagatcatagctcattgtattctcaaactcctaggctcaagcgatccccccatcttagcttcccaaagaattgttattaaatctcatttagaaaagttgaatttctcaaatattaactttgatgatataatactcaccacataagtagtagttgtgtgtactttctagtttgaaacgtataagctgtttcgtgcattagtggagatgagatattaaaaattattccttgacatttttaagagttgataaagggagaattttataaagtatgatatatgtaactatattatattatgggatgcaattttaaatgagatttctgtcacactaagtcaacgtgtgtttatcgagtacctactgtgtcaggcacatgcttgatgctagagtatacagatgataaagagaaggtggcctgcccaaatggagtttacattccagtgggaaagctggtaatcaacaagtaaacaaatgagagaatacaattaatagcagccgtgatacctgctggaaaggaaatagcattatcctgtgatacagaatcactgatggggtcaactttttggtagcgtagtttggaaaggcctctcaggaaatgacattttaagtaaaagctgacagaaggaccacaaggaatgagtggtgggaggaataagggcagatgtaaaggagtggggggagaatagcattctagacaaatgtggaaggctaaataatgttaccccaatgatgtccaggttctaattcctagaaccagtgaatgttaccttcagtgataaaatgagactacagatatgattaagttaaagattttgagatggagagattatcctggattatctgggtgggctccaaatacaattacaagtgaccttataagagagaggaaacaggatatttaactaaagagaagacaactacgagacataaacagagcaaagcagagtcagagaaaatgctacacctctggtattgaagttggaggaatgggccatgagccaaggacaagggagtgtagctctaccatcaccttcactgtcattcctttagactcatattttggacttctggcctctaggactgtaagataataaaggtatgttattttaagccataggtctattgtagtttgttacagcagcaacagaaaactaatacaggataggtgtggtggctcaagtctgtagtccaagctactcaggaggctgaggcaggggaattgcttgagcctgggaggtagagggagcagtgagctgtgatcgtgccactgcactccacagcctgggcaacagaaataaacaaaaacaaaaaactaacgtggaagttggtacctggaggtggggtgctgtggtaacaaatatctgaaaatgtggaagcagctttagaagtggtgattgagtagaggcttgaaaaattttgaggtacatgattaaaaaaccccaggttgccttgaacagactgttcaagtgtttaatgtagatattaaagactgctggtgagggcttagaaggaaatgagcttgttattggtaagtgggggaaagtggatcattgttatatagtggcagaaactgtagctgaattgtgtcttagagctctacggaaagcagaatttgtaagtgatgaagttggctatttaggaggagatttccaagcaaattgttgaaggtactgcttggattcttcttgctgcttatagtaaaatgtgagaagaaattctaactgtggtctgcagcttcagcttcatgccggagggttccagggtgccctttctgacagcctgccctacaaactatactttgaatagcagggttgtagagaatcatatttattcatttagaatgtcaaatatatctctataaaagagtttagctttgctcatcagccttttaaatgtttaccactgacagtgacttcactgatctaattacagttatcgaagccaatattgtaagaactgtgcatcctcttattgtgcacaattgatctggaagcatctttcctataccgagttaaatagtgtcaccccagaaaagttattttcacctatgaatgtgagtttatttggaaattgggcttttgcagatgtaattaaataagatgaggtcatacaggattagaccggactataatccaatgactagtatccttatatgatgagggggctttggacatagggacacatagggagagtgccatgtgcagatagacgcagatattggagttatgctgccgaagtcaataatgccaagtattgttggaaccaccagaagctaggagagaggtggaacaaattctccctttgagccctcaggaaggaaccaaagctactgaaacttgatcttggacttctggcctccagagctgagagaataaatatctgttgttttaggacattcagtttgtggcattttgttatggtagccctaggaaatgaatatgtcttctgacaagtaaaagtaaaatagtggactctaacaaattaatttttaagcacccaacagaaaatgtcactcttccacagagccaatgtctatactatggctgttttccagttttggagttctggaagtttgttagctaccattgctctttgagtaattcttaaaccttttataccaggtcacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttaaggaatagagttgtttctggaggtcttgcttaagcgtacatttggaagtgattttttttttcctttacgttttctgttgtagaataaaaaatttctttccacaaaggaattattatacccaaaatatgtttaaaaacaatttaaaagtatatatatgtacagtggcactggctttcagagaaaagaataaaagtatatacatgtatcctgttaactgatttttttttttttttttttgagacagggtcttgctctgtctcctgggttagagtgcagtggcatgatcatggctcactgcaacctccgcttgccaggtttaagtgatcctcctgtctcagcctcccgagtagctggtgtgtgccataatgcctggctaatttttgtatttttttgtagaggtgaggttttgctatgttgcccaggctggtctcaaactcctgagctcaagcaatgcacctgcgttgccctcccaaagtgatgggatcacaggtgtcaaccgccatgtttggccaacaactgaaatatttttaaaagtatgtatatcatgtaatatatatatatatatatatatgcatgctacctaagcttaaatgcaacaaagaccatacaaggcttttatggagacaaataaatgcacctgtgtaccacattcatgatagaaagtattagtattataaagatgcccatcatgtccacattaatccataaattcagttctaatcagtaactgaacgcttaaaacctttgcataacagacattttcaaactttacagaagtaaagagaaaagcatgatgaaccccatgtactctagcaaattccacttgtgaccaatgatttcttagaaatgtatcattattaacttatgagactttaaaatacacttgaggtatttaattcatgtcattcgtttttattgaaactcaaattgtcaaatctttgtccaattgtggtgcctttaagttggatcttgtgaccttttgacatgactccattagttttcttttatatatacttttatggtggtaaaatatatatacacacatatagcatagaatttgtcattttaaccatttaaaaagtgcagttcagtgacattcattgtattcagtgttgtatggccatcaccattatttatttccaaaacgtctttgtcatttcaaacagaaactgcaacttctaagcaataatttcccatttcttcctccctccaaccctggtaacttctaatctcctttttgtctttatgaatttgtctactctaggtatttatgtaaaatcatacaacacatatctttttttacctaacttatttaataattttattttcatgatgttttcaagattcattcatattatagcatgtaacagaacttaattccttttttggctgaataataatattccagtgtatgcgtatatcgcatttcgtgtattcattcatttgttgatggacacttgggttgttgcctccttttggctattgcaaatattgctcatgatgaacattggcttacaggtatctgtttgagtccctgttttaaatttttttttttttttttttcttttttgagatggagttttgctcttgttccccaggctgtagtacagtggcgtgatctcagctcactgcaatctccgcctcctaggttcaagcgattgtcctgtctcagtctcctgagtagctgagattacaggtgcctgccaccacgcctggctaattttttgtatttttagtagaggtggggtttcatcatgttggccagcctggtcttgaactcctgacctcaggtgatccacctacctcagcctcccacagtgctgggattacaggtataagccaccacacccggcccctattttcagttcttttggatgtatacccaggagtgaagttgttcaatcatatgataattctgtgtttagctttatgaggaaatgccaaaatgtttttcacagtggctgcaccattatactacttaacagaaatgtttgagagttccaacttttttacattcttgccaacatgttatttttaattttcctttcctatagctatgtgaagtggtatctgtacagaaatgttcattgcagcacagtcaagtgaaaaacaactcaagggaatatcgggaaagagtagataaaactggattattcgcagatcagaatactacgtagcagttaaaatgaatgggctacaagttaaaatgaatgtgattctgttgcattcttcagtacttcagttacatttttcaactccagaatttctgcttgattctttttaattatttcaatctctgttaaatttatctgatagtattctgaattttttctctgtgttttcttgaatttgagtttcttcaaaacagctattttgagttcttgaaaggtcatgtatatctgtttcttaaggattgttcactgttgtcttatttagttcagtttgtgaggtcgtgttttcccggatggtcttgatgcttgtggatgtttgtcagtatctgagctttaaagagttaggcatttattatagtgttcatcatttgggcttatttgtacccatccttcttgggaaggctttccagatattcaaaaggagttgggtaagccatatctgcattagggggcaccctaaggccagtaacactggttcttgcagacttctataggtactgtcttggtagtcttggataagatccagaagaactctctggattaccagacagagatattgttctcctccttttctcccaaacacatggagtcagtctctcctctacttctcccccgaccctcattttgagttaactttgtgtagggtctaagatcatctttttgcatgtggatatccaattgttctggttttatttggtgaacgtattatctattccctagtgtattgccttggcatgtttgttaaaaatcagtggataataaatataagaatttattgctggattcgtaattatgtgccattgatcaatgatttttattagtactataatgctttgatcactgtacctttatataagatttgaaatttagaaaagacctccagttttttttcaaaattgttttgattattctaaatgttttgcattttcatttgcattttaggacctgcttatcaatttctgtgggaataagcctcctggaatttgatagggattattttgaatgtatagatcaatttggggagaattgccattttaacaatattgagtctttcgatccataaatattgaatgtctcatcatttaaaaaaacttgaattttcttcaaagctttataatttttacagtacaagtcttgttcttatgttacctttatttgtatgtacttttttaatgctattgtgaatgtgtctcttaattttacttccagattgtttattgcttatagaaatataattgatttttatatattgatcttgtattatatcctgtgaactagatgtgctttttaaaaattagttctaatagtttttttgtggactctttggggttttctatatacaggatcatgtcatcttcaaacaaagacagttttaccactttctttacaaaccgaatgtcttttatttgtttttcttgggtggttagagcttccagtgctgtgctgaatagaggagatgagagtggacatctgtgccttttaccctgtcttagaggaaaagaatttggtctttcaccaatatgtattatattcactgtaggttttttgcacatgttaccaggttctattctaaggttgctgagactttttatcttgaatgcacattggattttgtcaaatgttttctctgtacctgttgagatgttcatttggtttttattctgtattaatatgatgcattactttaattgatttttagctgttaaaacctcacatttctggggtaattaaaaaagatggcttatcatctttttttatatgttgttgaatttggttcactaatattttattgaggatttttgcatctgtgtttgtgagagatactggtttgtagttttcctttctggtaataatttgtctcgctttgctatcagggtgttattgcatcccataatgagtgggaatattctagaatgagatgtgagtaatattcttaaatctacttcttatacttctcggaagaatttgtggagtattaatattatttcctccttcagtgtttgatgaaattccccagtgaaggaatctgagcctggacttttctttgtgggaacatattttaaaagctcatttaatttttgtacttgctgtagatgtattgagattttctattccttctttagtcagttttggtcattcgtgactttttaggaatttgtctatttaagttgttgaatttgttggcgtaaagttgttaatatttctttgtctttctaatctgtgaggggtcagtggtaatcatctctctttcattcctgatttttgtggttttctttctctctctctttgccaagggtttgccaattttgtttttaaagaaccaccttttaatttttcctctgttgtttttctgttttacatttctttaatttctcctgtcatctttattttcttcattctgttttcccttgatatggtttagtcttctgttttctacattttaaaggtgaattcttagattattgatttgagatttttttctttaatataggaatgttaacactatacgtttttttctaagtcttgtgttagctgcatctcatacacttggacatgagttgtatttctattattcagattaaaatacttgctcattcccccttgtaattttaaaaaaatttttctttgacccgtatttagaaataactgcattattgttggtaaatatactttatacgattttaatccttttaaatctgctaatgctttctttgtggtccagcatatgacttatcttgggttctatggcagcttgaaaagaatgattattttgctgctgttgtgtggagtgtgctttagatgtgtgttaaggtaagttgattggcagtgttataagtcttctgtatttttgttgatcttctgtctacttgttctattcattattgaaaattgaaatgttcaactattgtttctctttaattttgtcagttttagttttatgtattttggacccctgttactgcatacatatttataaattgttatctttacctgctgaattaccctcttattataaaatttccttttctttctagtaacaatttttgtctttaaattcattttgtctgatattaatatagctgtcctctgattactgttttcatgatatatcttttcccatccttttgttttcaactgatctgtatctttgtatctaatgtgaatctcttccagacagcatatggttgtcaagtttatttttctcagtctatactgttaatctgcaccttttgattagatggtctaattcatttatatttatttatatttaatgtaattattaagatttaagtataccttttcattatatgttttctataaatgttatatattttttgttccttcattcctccatgactgctttcttttgtgttaaatggattcttttcttaaatgcatcattcttgttgtttcttttagtatatattttgagttactttcttagtggttatcctggggatcataacaaataacttaaaattcagttcaggttaatcctggcataatttcaaacatacacagaattttttctcacttgcatgctttttttgccttataaattatgtatttatatgttataagcctatcaacaaagttttataattattgctttatacagttgccttttaaaacaaataggagaaaagcgttctcaaaaacaattatattgtattttatatttacctatttaattgcctttattggtactttcaaatttttttcatatggatttgaattacttcagctggaagtaatcctttagtgtttcttgtagagcaattctgctggtgacaaattctctcattttttctttatatgggaatattttaattttcgtttttgaaggatagttttgctggatatataatttttggttcgtagtcttttctttcccccccccagcgctttgaatatgtcacatcagtgccttctggtctttatggtttctaacaagaagtcagctgttaatcttatagaggattccctgtaatatgcaagtcattttttctgttgttttacagattctgtctttgaacattttgtcttaatgtgtgtttgactctttgagttaccctatttggagttcattgaacttcttggatatgtaatttaatgtttctcatcaaactagacatttttggctatcatttctgttgtagtgtttttgcggtttttaaaaatttgttcttagggtttttatctctgcttacattacccacctcttcttgcatgttttacacttttttccattagagcttttggcatattaatcatagttatgaatttctggtttgataattacataatctctgccatatatgagtctgattctgatgcttgctttgccccttcagattgtgtgttttcttgcctttcagcatgccttgtaattttttgtggaaagccaggcatgatgtactgagtagcaggaactgaagtagtaaataggtcttcagtgtgaggttttgtttatctggcttgtaggtttaacgttttctataactgtaggtttaacgttttctgtaactgtaggttttctgtagctgtaggtttttctgtaactgtaggtttcacaggctttagtttcccgtagtatccttgcttttttctcctttattttctttgggcttccctagaaataccgccttaagtagagtctgtaccttgcagctattttagttgtaatccactgttgttctattagagccctgttgatgtagtgataaggtgttgcggagaggaaacattctataatcttgtgataaacctcagatttgtttagtaggcctgagtccctgggctgtgaccttcagaagagtttcttagcatttttttttctcctcttctgtgagacagggatgctagaggggactgagttgtataatcaccttcccctaggtcacataaagttctgacaaagtagtttcccttgggagaaggcctttattatatagaacagaaggctccgggcatatttcaaaatacttttccccagatgcattttggcatgcttacttttccccttgcccttgctgagcacatgatttatttattattttatttttatttttatttatttatttttttaacctccagtcttcaccaggagaacatagtgggacttctgggggtaaaacttatgaaagtgtatgggtcccctaagactgagcccccagtagtttttttttttttttttcctcaagctagtttatactcagcctccagcaaatagtgagttaccacttaagtgttcctacagttatttcctctagtagcgctcctcctagtaagctgtgattttgtgtctccagttttcagtgcaactatttgccctgagacctcagttctctggtgtatctaagaattgtccatgttcaagttttccactatttttcatgttgggagagtgggacttccgagctctttacatgttgcaacagaaaccagcagtattatctcttcagttattctttctctcttcttttaggaccccagttatgtgtaacttcatgcacttggggatgtcccagaggtgccagagattcttttcatttttttttcataatttattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagcctactgtgaatggagcttaggagagagggatggagtagaccaagttaaaatgccatgaaccaagcctttctagccaagattcagcagctttcctaagataatgctttagattgttgtacagctttggttaattttcagaattttcaaaaaagttgattttgaaaattgtggcagcattttcattgtttttatgcatgggagcgtttccacagatcttcactccaccattctgagagtgcccccaacttcgaatggatgaatttttataacaagtgaaaaagtaagtccctgaaggttacatacagcctttacccattttatcaacttagaaacaatgaaaagaacgtatgtacttataaatacataaaaatatacacagtatttgtattacacaaaaatagataaacataaaactataaaaagtaaagtacaggattctggatagtggttacctcagatggtggcagaccaaaggatgggagtgggggttacctagaaatatatgtgtcataattaaggtccagttttattttgtagttggtgggttcatggattcttatggcgtaattaaaaatatatacacaggcaaaaacattttatggttgtgtttgccttcatgttaacacatgagatgaggaatctattatgcaacagagctttataaaggagcttcaacctcagttttcaaagccattcttacggccagaggaattgcttatggagcttatctctacccagtctcgtgtaggtctgcctcagctggccgaactccagtgtcaggacaggacagtgatgatgagaagggaagggacagcagccagtgccagttcgagatgagtagtcatctaatactgcctctgcgtgggtccctgctgccatccgcagcctcatagccctcagctccgtaatgtgtcctgatggatttagaagatacatagggagctgtcattgtgagtctgaaaaatatacagatcacgcttcacttactaaaatccatacttgatgatgtcagccacttacacgagcattcaagaggtcttctagaataatcacatgacaagatttgggggaatacacagaattccaatcaagatgagttgagcataatatcatggaggcaggatcagaatggaaaggtaactgataacttggaagtttaaacaattacaattttcctgtttactgtgtgacaagagcattatggggccttgaaaatggcagtgtcaccactgggtaatatattttattcaaagactttttgagagagagcatctgtagagtcaaatggtacttgccaaactattccatgtatggaacccataggacttcataattttatggtttgctgggggaaaataacaagaccactcatggcccaggtgagtcttgaagaggctgtggccacaatatactgagccagccgtagttcactggatgggaagacccaagtttgacttccagatttacttcttacttgcactttgggcagttacattacttctctgagccttattttttttttttattatggagataatgctactgatgtgtaataattttgtatctactagtattagaatgtatgaattaccccttaatttttcaaatacttaaactgttaacatctgaatcttggccaaaatgagcacaaatggcatttgtataaatgcctagttattaaatgttatcactatttaactatctggatttgaagaccagtgcatggcgtttgctaggagtttatatcatgttcttacgtatgtgtgtagctgtctttactgcatctgtcgattaggaggtaagaacacctgctgaatatgtaccttgagctagctattgtgggagatataaaagaagcacaaaactggatcctgtcctcatggaactcaatctggtttctgaggtttagcttttatgtgactcacagatagagcaatgtcacagaaaataatatgcggaaaataaatgcaaaaagaacttgagaaagcttcatgtggctcagtatcctgcactcagtaggatatgtggaggatatatataaaatctaattgagattcttaggaaaggctttaatgaagactggagaatgaatgatatctgttataaaggatggtgaagcttggctattcagagagtaatggaggaggtacttcagtagtttttattgtgtctgcccaagaaattcactcggaagcacaatgtttatttctgaagaggcaaagaccaagttttagaaaataaagttctcctaaatactattataaagtttgagtatttctattatgattttatgacttcccatctgtggtaggtgttttattgaaattatttgaatgttatcaagctgtgacaacaatgctttaaaggtcatacacaaagcacaattaaatttcccaagtgaaataagaatgtgcattgtgaaaggcagagaatttcaagtagttcagttttgttgttgctttttttcatctgggccatttttgaggtgtttaaatcaaaaagttgtttttcttcttgattgcagttttcccttagttatttgtgtagcttaaaaatggaaaccaatgtgtttaagttgcaatatttttgagtctattagttaatataaactttattctacactcaacagtagattgcattatagctatgtggaatgtaaagattattttgcacttatataaatgtgatagcttctgattgatacagatttaattatgcaaactttggcttattatgaattagatgaaacatttctattcctctgtttctttctttctttctttttttgagacagagtttcactctggagtgcagtggtgctatctcggctcactgcaacctctgcctcccgggttcaagtgattctcctgcctcagccttcccagtagctgggattacagctgcatgccaccacacccagctaattttgtatttttagtagaaacagggtttctccgtgttgatcaggctggtcttgaactcctgacctcaggtgatctgcccgccttagcctcccaaagtgttgggattacaggtgtgagtcaccatgcctgacctatacttctgtttcttatgagcttacttattagaagatctctaagattcctgtaatttaaaattttgtaatttcatttcattttacccatttacatcattaaagtgatgaatggttgcttctttcaaatggtgggaaatgaattttggagaattgttagttattattgctcatttaaggttatttgaacgttttgactatttgatggtgttttttgtttgatttgtgatgctgactcataaataccatgaaaaacaggtctttttgttctaaccgaaagagggattatttagcagcttaatgactttggtaaataaaagtttatttgcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttgaatgctggtcaggtatcctagtcatctttcacaatgtcgatcatatgggaaaatatgtttctagttctgacaactgaattacatgtacacctttggaacataatctgtttttaggttgagaactacctgtgtattcatcaagtactgaagttcccagtgttcaagaaatgccctatgctattaacagagaattaacaggtttctctaaagaacaaaactaagcttagtatggcctggtattaatccctgtctagaagtttcacaatcaaaagggcaaaatgtggaaaagcaaagataaataagtaaaattggaaaatacgcaaagccgttagagatgtaccagtggctcagaagtaggtaataatgagaaatgcacccaacctctgtgactgtgaaacatgccacccaagctttgggtttttgaaatctgtctctggcacttgaatctccttgtcagtggcaaactggagagctttccatacttctgtgcaaaggaaagcataccccagagcaaaaacaaaataaaatgctacttaatattcaatgtggtgtcctttgaatttaaaagttgtagtgatactattatagcagaattaacattattgtcatattagcattggaactttcccatttatttttggcttggtgaatttgaaagtgttgtttaacagaaaagattttaaaaggttagatgcaatagcatttattttgcacagtttgatggattgccagcagcagggaaaactacaactcagatcgtttcaacaactttctgttcttggatttttcctttctcaccaatttttctttcagagcaataatcattttactgtatatgaaagagatacctaaatatcaggtatctagttaggtgctaatgaactcctcctgcccattttttaattgtttgctttatcatagctctaagtagtcgtgctaatcttttagggggagggttaaggaaagattttacttaattttgggatttactttgtcttttacagagcttgatatgtggcttaacagtaagtaggattatagcaagttgttattttagagaaagtaaacgttatctcattatattcttttttaacataatgagaatctttatggaagaatttgcgacagctcaagaacattttttaaaatttaattttaagttccaggatacatgggcagggtgtgcagagtcgttacatagataaacatgtaccatggtggtttgctgcaccgattaacccatcaccaagtattaaaccccacatgcattagctatttatcctgatgctctctgtccttccacacctccctgataggccccagtgtgtgttgttcccctccctgtgtccatgtaagaacagttctttttaaaggttagtacttggattgttttattgttgtactgtttaagcagctttgttgagaaagagtaaattaaagcttttatcaatttttttttttttaacagcaaatctgtactctccttttttttttttttggtggcccaggctggagtgcagtggcgtgatcttgtctcactgcaacatttgcctcctgggttcaagtgattctcctgcctgagcctcctgagtagctgggactgcaagtgtgtgccaccacgcccagctaatttttgtaattttaatagagacagggtttcaccatgttggccaagctggtcttgaattcctgatctccagtgacccgcctgccctcctcggcctcccaaagtgctgggattacaggtgcaagccaccgagcctggcctgcactctcacttctagttatcaatgttaaatttatcatttgtcactaaataattatgatattcataattaccaaagccttttaaaactgcatttttataatttttgctacttgctgatagaagaccttttgacttaaatatctaagttttagattgacattagttttgatatataaggtttagttttcagtattgagctgctatctgtaaactaattatattttgaagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaataaaataggaaattagaagatatgaggccttaataacaacaacagcaaaaatgagatgtatctatctataatgagatttctgaatgtcataatacagagacaattctgtatccaattagaataaaacttgttaccttcaagtggaatgaatcaaatgcaataattctatacccagccaaactactcttacataggtggtcagaggatcaatatttaaaaacctgctattattctaactttgaatcctttcaggaaaaaaaaaatttagaaaatacttaaggcattggtgaagtcaagagtgaaaacctcataggaaagaatatgtggcttatatgcaaccgattaacttgagtcaaatctaaataaatgttagtaggttgtgaagctaagtggattcattgacatgaaaaatactatagaatataaccaacttttcttaatactggaagtccttttgaaaaatcaaattattgctgggtgtggtggctcatgcctgtaaccctagtaacttgggaggctgagggaggaggattgcttgagctcagaagttcgagaccagcctgggcaacatagcaagaccccatcacacacacccagaaaacatcaaattatttctttctgtagctctgagtttatatgcatatctaatgaaatgattgaaaaccctactctggcaacacaggagttgggctggcgataaaaggtgggggaaaagcaggagtacttaggatgtgggagaggaaatgatacaaatatgatagactgttaattcctgggaaaaataccagaaacagctgatctgattttcagaagtaatcataaaaatagatagcatttattgaatgttgcaaggcctttgctaagtacttaatattgttacctcattttaccctgtatatcagagatattaatgagctggctaatttatatacctgtagaatgtgtaatgaacactcattagcattatagatatgttagttttaaagtgtatctgtgtccttttaaaatatttccttttaactcttaaattgaaaagtctagggaataatcctaatcaagaaggagttgcaggaaactattgtaaatccaggttgtaaagagaaaataaattggttggtgagaactgtcaccttttccataagataatttaagcacaaatgattacaacaatttacgttttttattgtggccaatatagttgacttggtttaaatcagacaggagaaaagaggaaaatttttattgattaaccaggccctgaattttctgtcttaggaggaggaaattatgtagttaaattgtatgattcctgtcaaaagaacaatgaacttttgagcagattggctgagcagagagaatacaaagcagggctaatgattgtcttcatcaaagagaacttcttgggataagcagatttctatgcttttataagatagatttttttgggggcagtgagaatataaaaacaaattcgggaatgagaggttaatcgataaagaacctgagttgtgttttagtcatggaaacagtggcttttttttttttcagttttgtttttgataaaaagtatcctaaatataaaggaggtatatttccaggtaggactgtgctatgtaactcagtagtctctaaactgattttagttttgcttttgatatctgaatggattaggaaaattccttccaagaaaccagagaccagaagatcagacaaataccatatcagtttctctgctttgaaaattataattcaaccttgtaaaatttttctaacgttgtgttctctgtaaataacacagagtaaaaataagtcaaaccatttgttttttcctctaaatgttctgaacattaaacaaatggttcttggcaaacacatactattttttttttttttttgagatgagtctctattgcccaggctggagtgcagtggtacaatcttgactcactgcaacctccgccttccaggttcaagcgatcctcctacctcaaactcccaaatagttcggactacaggtgcgcgccaccatgcctagctaatttttgtatttttagtagagatggggtttcaccatgtttgccaggctggtctcaaactcgtgacctcaggtgatctgcctgccttggcctgcctaagtgctgggattataggcgtgagccaccatgcccggccatactaatttaattttaggaatgttgtattatagttcattttgaacaaattgtaagaagattattttgtgcccatatgtgtgataatcagaatagcttgatgtagatatttggtatctttttagaataattatgtttagataaatcttttctgtggaaacatattcctaaacatttaagcctagttataccaccctcaaatataagaagtttatgaactttgtgggctgattcaggaaatcttttcacactgataaaaacaggagactttaatattattttgggaagaaaaatgagaaatttgaagatatgtctcttatgaatcttgctgcatcagtttgttttctgctgatagtctggttgatgcacaatttagttttcaaagaatttctcttcaaaaataccggctaggcacagtgttcacaccggtaatcccagcactttgggaggcagaggtaggaggatcgcttgaggccgggagttcgagaccagcctgaacaatgtaaggagactctatctctacaaaaaataaaaaaactagccaggcatggtggcgtgcacctgtagtcctagctgcttgggagactgaggcatgaggatcccttgagcccaggaagtcaaggctgcagtgagctatgatagcactactgcactccagccttggtgacagagcaagaccctgtctcaaaaaacaaatatttttcatccttggaaaaataaaacctaaaataagaagagcagcacaatatttttcttttttttgaagtagcagggctgaccaaagccatttctagccaaataaattatttattaatcaatatcgttaccacattctctatgtggaaaaagtattcaaatcttgaggcctatgttttttcaaacttgagagtcatacagttgccagcttttttttttttttttaagtagtagacaaattgtaagaactacaaaactgaaaattaccttctgtttttcttccccataagctgctgttgaagtgaagtgagctcagggagacaggcctgttgttatcttcctatggcactgatttacacttttacagaagggaaatttatggcccttatctgttgaggacttttatgaatgactggtataaatcaagaattgaatgaatatttttccctttaagcataaatctgtgattgggagattgatttctgagtaactctttggtaacccatttaaattgtcatcttccaattttctgtattttggcataaactgaataactaaaatataacttaataccagcatgatagatttgtttttcttctgttagatactttagaattcatctagacttctcacagacctcgataaataactcagcagtcagaatggaaaacaaatttatatagtggaaatctcattaatgggaatgaacaatacaactgtattcaaggtttaggcaggagaaggaaaatgatagaaatgtatttgtttaattttaaagattcttatgataaaatgatcattaattagggaagataagtagaaaaagacagtcctttctgggacatttgaagactaacagccttttattgaaagtcctggaaaagtatgtgtaaaaagccagccatgatgatcttttacctacacttccttaggagactttccctcagcaagatgtgtctttctaaaaacaaaagataagagacaataggagcccacataggatggaaagctagaaatcaggtgggttaaaaataatttcatctacactatcttccccttctcaaaagatttttaatctgtaaatggcaacttatacatggaaggattataaaatacataaaattactttttatttgtcttctcagatatatggcgtgttctttatcttccccttgttccaagtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagggtgagagtgggttcaggttgtaggtgtggagttggacaggctggccttgttctagcagcaccatttactagctgtgccaccctaggcaagtcaccttctctgctcctcatttcccttctctctaaatggtgataataagagaagctaccctctgaagttgttaggattaactgagctgatacatagatgtaaaacccataggacagtacctagcacgttgcatccaacaagtgtcagcaaaatattagcctagccagtcacctgtggccattatcaacatctgtctccagttagtcaccacctttggtcaattctgcatttgaatatttcttaaagatgatttatcttctctgccctcatggccatagccttagtgtacagactttttaactctcaaataaattaattccgtttattcttttagtcaaattttactaaaatccattgtgcagaaaatgacctgttaattttctaaaatgcagatcttgccctgccactctgcttaaatccctgtcatggttttctgtcatccttaaggaatttataattaactttcagcattaaaggcatgcagagttcttcaaaagttagctcttgcttgccttccaacctcatctctcatcagatactttatgaacatcatatattctaattcttactatacctttccaaaaggcagtcctcattttgcacagtgatgcaggactgtaacagtgatggttcaagctgaactacacacaacaatcttaataacagtgggagcaactccagtattcccatgacctttgaatgtttttgttaaaacattaaaaattctctgtcagtgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacttatcaggagtagtttgaacagtgcttgtcttcttcatcttgtcatacgatataagatgggcctagcatcttttctatgacttggtgaatttccatactcctttctaagtttggatcagtttcccgtatttcatcctttgtgctttcagtgagtttcattaatgtgaagtttttttgctggcatcacttcctctgggacgtctttattcttttgctaatttatgtgaagctgccttcaccaagctcctgtggctgcacatcattgtctcttagatgtcgttagtgtctcttagatgtcgttagtgtctcttagatgtcgttagtgtctcttagatgtcgttagtgtctcttagatgtcattcccatagtcagctatttcttctctaaacgtcgtttatgtttgattcagatttcactttgagtttaccagtgtttcagtgctgtactttcatctttgctgcccaattccctctttggattacccatttttgtaaaatgtcaagtgggttaatcactgtgagacatggtggcagcacaactatatgcttttctgtctgtgtaccaactcagatgcacagtgaccaatcactgacaggctttgaaagaagtgacgtgattggtcatggatcatgatacagatctgttatttactcagtgattggtgcactgaatagctagtggtgaagtttcttttatgtaattattattgattaatttatcatagtaactgacatttgagtcttattattggcagaatgatgttaattaaactgtggtaactgaaatttatgcatctcagaactgtgcaaagcaaggactgcgagtatgttataaccatttcacaaagtcttaaaggttaaatggctacatacagcacatggccaaaaagtggcagaattacattaacataacttttcaaatatctttgatatttatgttataaggaggcacaatctgtctcttaatgcttctgtcaaattaaatactcatggagttcaaatacaaatggattgtcttcagaaaaaaattattagcatgtgtatttaggtccatagccctataggaactctgtctgtgcttagcttgggctaaccatgtaagactgccaagatttgcataaaaatccaattattgtaaagagctactcaaagctagcaacatacctgaccttatctgaggttattttttggaatgaatcaagagtccccagccttggagtgatgaaaagaccatcatttttatttgttttattctggaacaaataaaaaatccctggaaaggaaaggaacatcccgtagtcaagtggagaaaactggtctaaatagttagcagtggagatattgagatactctgcttaggatgagagatcagcagcagtgggtagggatgttaatgactggaccttaagcttcagggattcagaaataagttcagttagttctcttaggaataagttaaatagtgtctgctcaattcatctggccggctggtagtcagagtccacagtaagtagtcaaatttgaaagttgtaagatacaatccagcttctgcaataatgagaaggctcagtttggagcatctaaaattgttcagggtacaagagaactgagatacacagatggactaaaataatactcagttgtggatagatgaaggctgagaaaaaatatgataaaaggctttttttaagtgcctctaaaatgccaggtcttctagattacttttacttatttgtaatgtaattcttataaacatcttgttagcaggtgttatagttgttatttagaacttttctgagattatagagctagtaagtaatagagttgggttttttgttgtttttaatccaggcccttttaaatatataactcctaaatgaaagataccagacccaaacattatgaaaagaaggatatttggggagtgcatctctcatttttgatcttgcatgttgtgttgtatggaccttggaatgtaattttctgtagaaatatttgaaaatgtaatttgatacccagtccacactgcaaaagcctatttttttttttttttgtcagggtcttgctctatcacccaggctgtagtgcagtggcacaatctcagtttactgcagcttcagcctcctgggctcaagcaatcctcccgcctcagcctcctgagtagctgggattacaggtgtgggacaccatgtctggctttttttttttttgtagagacaggtctcactatgttgcccaggctggtgttaagccctgggttcaagcagtcctcctgctttggcctcccaatgagttgggattacaggcatgagccaccatgacagatatagagacacatatggagacacatagagatgtgcatgtaaaataggcccaaaagcctatccgtatgtgtctctctatctgtatatacatttctttctgtgctatttaaaatacatgcagtcactgtgtgacatattacatttcaagtgccaacttgggaatggtggaactctgcctctcaccttgaggacagcccttctttgcagcacagtcaatgactaggaggacagtaggcctgtgtttacatctgtgcaagaatggcatctgccttcatctccgcatgctcctagagaaggagccgtttcagcgagtcacttctcaggtattctaaatttggtaataaaaggacttgatgcactccaggtgcagtttctctgaccatatcaatgttcttaatttttttttgaggggaggggactgtgtcctaattagtaattaaggttattttgatagcaagtgttagaaaaatgctaattccaagactacaagcgtatttcacattctgaaatccaggtatcctaagggaccatggactggaactccactagatactactcagaagcttcgtccgcctcatctgtctctacttttacctctgtgacctagaggtcacttgaaacaagcttcctcctgctcgtcagcttcattcctctctttctgatgactgtctttctctagccatctgagcctcctgtcctatgtgacagtctcagctcatgactttccatcccctcagtttcaagagtgtgtctgagacctgattccagaatcccaaaaggcagaatgacattgactgacccaactggagttcgttaggtatccgtggcttgttaggaatctatctctagtaggaatgtctgctgccctgggggccgaatcctgcctgtgcatgacctgctagggcccatgcctccggtggatggaatgaagcaaggatgggggctgcctgcagagctgtgtcactcacttgtattcagctttcctgcctctggctctctgtcttttacctttttttgttcgtttgtgttttgagatggaatctcgctctgttgctcaggatggagtgcagtggctagatcttggcttactgcaacctccgcctctcgggttcaagtgattcttctgcctcagcctcctgaatagctgagactacaggcacatgctgccacgcctggctaatttttttatttttcatagagacagggtttcaccatgttggccaggttggtctcaaactcctgagctcaagtgatccgcttgcctcagcgtcccaaagtgctgggattacaggcgtgaggcaccacgcctggccttttatcacttttaaactaagaaaacaatgatcaccatacatgctctgcttccaaactatactttcacatccaaagtacccccagatcataaagtgccaccaaagagctgtgatatgaagaaagaccccgggtagaatcactctgaaaatgtgggaggtttttttttttttttttttttttaaagcaaattcattttacttagccagaatcctaatagcctgctgatttttgtagatgattactctgaaaacatatgcattggtgtggtctatgagtaaggctctgccttttaagtcacattctttgctgcttcattgcaatgaaaaataccaaaggtgaataccaaatcaattttttttagtattgtacttgtaaagacagtccatgaagtggtgagtgggagaatcaaacttttgtggtaatcttttattgtaatctactttcagctcagagaagcagcatagcctggtggactaagggaggatggggagtttggagctctgagatatgaactgttttgcaatgactagttttgtgaccttgagaaaggaccttaacctctgtctatgtcttcatatgtaaaatgggatctacctgatagaaacataggtgcattcatatgtgagcaaactgaataattagatctcacataaatcaggagtgattttttttttaaatggctgaagcctgcggtttataaaaagattctccctagaattcctttaagacctaaccttttctcaggggtgtttaaactgtgattaacaaatgttaaattatacatcccagtttacaaaatatacccgttgaatagagtgagactaacatgactttttgtctcataaaattatgacaataactcagtcagtctgtgtgaaatactttgtaaacagagctttgcaggctgcagtaaaaaaaaaaaaatatatatatgtattttatatttaaaaaatatatatttttatatatatatatatccccatacctgaagattttggggtgaactttttccaggttaagaatgacattagtgccaactgtgctgtattttggctatcgtgatgacattagtatcatcaaattggtcgtggcattgggacactggcagcatgtcatcctgccccagtcaagaatgactgtaggcagtttcagtttatctgttgctactagaattttgatgtagcagtgtcaaaaggttgatttgtactatggcaatcttattcctagatgtgaattctccagggggcaaaatatcctaaaagctaacatgtaaacaagctcaaaggattaatgtagtaggaagaaatagtagtttgttatatattcatgttgaatttaggtaactattttagttatttaaaagattactaccgaagggaagaaacatattttgctaggtttcgcatagaaaaacctgtgtctggctcaaggtaatacttgaattttaataggaacctaggtttgctgtcttcccagtgtagactgtagcctgcactgtcatagaagagtgttgattgatccggttgtgaaatagatggatacccacatttaagttgcttttgaaagagtcagtttccctccacaaatatggcaacaaaattcttttataatccacaaatagaatttttcttcatctgaaagagatttctcctaaaccagcctgaaaaattgcttttctaggaagaatttcatggctgagcctcattcttgtacagattcatagcatgttattactaacttgtaaatattcacttacagaagagagtgactagaatctttgaattcttttatattggtgttgaggtttctatccaagttacgcagtttttcattcattttagaggaagattttctcaaacaaggattcttcgtggttgcaaaacctatccccagagattccagtcaacataattcaagttgaccagtggattctaagtgtgacagtacggtgtttagcaagtccaagtgaaaccagatggaggtcagagaatatgcctggcttcgtccacattatctagttatctgcctcaaccctctagtttcaaccagcttcaagtgaatgttaaaccagactgctgtaatctacacatgctttcacacttcaaaaggtgtgtgttagttgatatttggtttagtcatttcgtctcttgagaggaggggttgaagtttttatttccagtagtattttattttattttattggatgaagttgtttttatttcttttctccagaagaggtaaggaaggttcctggattattgtatttggttggtaaactctcctctttttctctttctgtgtctgcatctcctcctttttctctttccctatttcttcttcctcttccttaggtttatatgaaatagaaacaattttctagcacaatgactaagtgaattgctacattaaagactggctggccaagaaatggttaatctttgtatggcaggctttagggaccaacatcaaatacaaacatgttggaaatctttttgtcattccagctcaattgattcagaaaaattttaagagcaatagtcagtgcttggaggaaaaaagaatactattgtaaatttgagacgttctcatcttgaacatggctcttgtaaatcacaagcttgacaaccttacagagtacatacaagccgtggttgacttcagaaatatgtgttttagacacagttttacatgaaagtcatgatattgtaaatataatgatttattaataagtttaacttttgttaggatactttgcgcataactaccgcaatgcattaagaaggaagtgttaagaattttcatcccacagatctgatgatttaaagtagtgttccatttgtgcagtcaatagaaggaggtgcaacaatgaaacagaaacaaggcaaaatctatccatatgggctcatcttatgacctgttcttgctggtaattttggcgtattttgtgatgatttttttttcctctctttttgaaggctcagtagctgtactactcactctaccaggccaaagagtcagcgtgatggagagaagattaggaaatcatgttttaaaattcttctaatgcagatgaatatgtcaacatgatttttctttcatcaggagcctgtaagagaatttccaccttgttcgccttggttttggtatatgaggtggactttttacttaggtgtcctccctgttgttttgaggctatgtgccctacgccactgtggtttaccctgaggaagtttgcgtagctcgcgtgccaaccacttctcttggagaagacggagtgtcataactacagctaacatttattaaggatcttgcatgtttttcattttaatcctcacagctccttaagtattatctccattttgtagatgggacatctctggctcaggctcaaagatgttaagtagctcacctaaggtcattttgccagctaagtaaccaagctggggtttcagcccaagccaactttaccgagtgtggatggttttaaccagttctctcgatttgcctccctgtgaggtgtgagttgttgccatcattaacccaggcctatctgcttttggggttcagagttggaaccatctgcagggagtgtagatagaatcatggggggggacagagcacaccctagtggagcctgccaagactcctcattgagcccagaaaactgagatacaggttagaattggccatttcatcgcagtgtttatttcatgttttctcatctcacaggtgagttttctagaggaaagatgatgaagtaaaattttacaacaatttttgaatacttttcctaactgtcaaatctccgtctggatcccattaataagatacaaagttatatcccaaaagtaccaaattatgtaattctttttctgattagttcattgcaacttgttcagcttcaaataaattaaagatttcttagttattgtgattcttaataattttgcaaaagtctctgtatttttttttttgaaatctttttctcattatttatggaagatagtgattgggagaaagcaaaatattaggcattaaaacagattatactggagagatctattccagtgtgatcaccaaatccacctattttgatacttgacttatgaaggggactgcctttttttttttttttttttttttttttgagacggagtcttgctttgttgcccaggctggagtgcagtgacttgatctcagctcactgcaacctctgcctcccgggttcaagcaattatcctgcctcaggctcctgagtagctgggactacaggcacagacagtcacgcccagctaattattatgattatgattatgattattattattattattttgtattttagtagagacggggtttcaccgtgttgtccaggctggtttcgaactcctgagctcaggcaatccgcccgcttcggcctcccaaagtgctgggattacaggagtgagccactgcactctgtgggggcttttaaagaggaagtgaagggtaactcatctctatcctactttacatgccccacctaagtccaactcccactgcctgtcttctaagggacatcttgtggcttgttctctgctctgctcgtattcagtctctacgtccctcatgctttctcatggatttacaatgattacttactctcaaacttatatttccagccctaacctctccagtgatcatttgttaacaagattgtgttaaaggaagcaacaaaggttcttctattggatgtagttgaaaaagcagaactgttgctctggcctaaacattaactttggagaggtttaaattctgtttagaagttataaatgagcttaatatcatgtgatttgcatgataagttattttaaagagtttaaatccatgattgttcaaaataggttgttttattttcaatataatatggttcttaattgtaacattaatgaacactgaagacatttttaagattcatttatgtaaagtgatttgatgaagtaagctgacatttgatggacttagtggaagtttagacccaatttgcatttcagtggtattttatggctgactttagaaaactttttagataggatttctcggtaaattaaaggatttagagggatgattacgaaataattgattaaaaagtgtgcaatattggttttcattgaacttaagcttgtatgggttcaatttaaaacctaattcaatacattttagattttatatttccctgaacctcttctgctgtattaattttgtcatgcttgtcattctaatctaatgatgatttaatgtttgcaaacctgaataaatctgtatgcaaggagttttgctgtgtttttaatcaatgaagattgaaatttggcaactgaggtgataaaaaatgaaaaattttaaatagaaaatgaaaataatgattatactttagaaagtactcttattaatgttcttggctatgaaccatgtaatatttttctcttatttttatcgtgtaatattttgaaggtgactgaaccttaaaagaagtaattgccactaaatcgtgaagaatgtttaaattagaacagattctttgtcctcactgtcttcccctttccctgaaatctgtagtctagagttgtgaataagagccagaagaatgttaaactgccttttaaaaactcgtctaccctccccaagaacctacatagacaatagaatgttctgtaatgaaagtgtatctttacctcattatttatttattttattgagcaaaaaatgtagaacatagaatgtctaacggattagtcacaataaaaaaaatttcctgggttatatatgtaaggggcagcggctgctcctctatcagtccaggagagcctggtctgatttcacattgcttttctttccacatgatctcatgacactaaaagacgattaatacatcctttaaaaatcaatacgggacattttactgtagtccttcacctttattgttcagtacccttcaggggtgaaaggagatattccaatgcaaaaaatatgtctgaaaacctgagtggtaagtaataaaagtttttttttctcttaaaaagtcttataacattgttatttcccagatttgaggggtgggccttggggtggaattaaaaaatcagtgtaatcatttgtaaggacaaaatgcgagtttctataaagaatgttttagcataatgtcactaatgttttgcagtgtgtagagagcaaactttaaaaaaagatgtgaaaatttacaaaccagtaatcctctatttcatgtgccagcagtcaaaattacgtgtgatcggctgggtgcagtggctcacacttgtaatctcagagctttgggaagctgaggtgggaagattgcttgaggtcaggagtttgagatcagcctgggcaacagcaagaccccttctctacaaaaaataaagttagctggatgtgatggtgcgcgcctgtagtcccacctatttcagggggcagggctaggagtttcaggtttcagtgagctgtgatcgtgccactgcactccagcctgggtgacagagtcggatcctgtctctgccaaaaaattaataatactaaaaaaattagatatgattaaggataccaaaaaattattcagataccttagtggaagctttggctgaatagaagttccatcttttgtagtactgaaaccaagtgaagggattacgtagttgacatctctgaaagagagaacgcagtggtaatgagaatactccccctacgtttgtgtatgagccttggcagtttcttttacactctctcatttaatcctctaagacctgagacattgttggggcaagtggaattattctgcattttatagatgaagaaatggacttggaataattaagttatttacagctaacccgcaccccagatctcttgacctagccccctgcatcctgcctttgccccagagtgcttttaatgttctgcattgcatggtctttttgttcattttattttatgtatcatagttaatactaaactgaacgtttgctgctaagacctatattattttatattcccaatgaatatgacttctgcataaaaacatttaactagggtaatcattttatagtatgtgcctgttgtctctgctatatctatcaccttcatgtgaagacagagaaaatagaatatgctgtgtattcgaaataatttcttctttacaatgatgtattctagattctaacatttacatatgagagaagcttcataaatgttacgttttctgtggccgctatttctgtcttatctgtgctgtctacacagtgaggacagctgcagagacactgccagtctcatgaagtgtccattgtgaaggcccatgtgtcagtgctgctgatggcatgcaggagttggtcagtaggatggttaagaacatgggctctggagtggacggtgtctggcttcaatctggggctgtcacttagttggtgtgggacctctcatctctattgccaacccaagtttttgattctttctttcctcagtaaactcttaatctttctgtccttggaatcttctcctttcacttcaaacaactcatctgtctttatcctgaaaagtttatactttactaagttccatcattggcagcaaccctgttttcttcccctttgtattaatattttttttttttttttttttgagatggagtttcactcttgttgcccaggctggagtgcagtggtgcgatcttggctcactgcaacctctgcctcctgggttgaagtgattctcctgcctcagcctcccgagtagttgggattactgttgcctgctaccacgcccagctcacttttgtatttttagtagagatggggttttaccacgttggccaggctggtctcaaactcctgacctctcgtgatcagcctgcctcagcctcccaaagtgctgggattacaggtgtgaatcaccatgcccggcccccctttctattaattatccaacatctcaaatgtgcagttcatcacatttttggggtggtggttagacacaatatagttaacctatttagataaataaactcttttatttcccctgagtgaacatttcatctaaaacgtgtgtcgctttcttgcttaaaaaccaataaagctaatgtttctcaagtcatcatatatgagtagcatgcaagctccggatgcagctgttcctctagagactactgttgcgctccttacaagcctctagagcactagtgaagagtaatgttagattgtttcgggtttggtcaacctttcctaagactcagtggacagcaatcagttaatgtgccaagaagcataagctaaatccagattgcaacatactactcattctgaatctgtaagggaatgcctctgtgagtcactgttgtgggaatgtcctgggatggcatagttaatactttctaatgggatttaaaaagtcagtacatttctctttttgaatttgtttcttaatgatctgatgcacttttggataagatacagcttgctttatagaacagaaaaaacattgtcatttatacatgatttagctttatgatcatgatttaaagccaccagctttgtgggaggaagatagtgagaatggccatgacagctttaactacacccttgaagacctccttgcttactagagggcactgtgctgtcctcagatgccctgaggcaggtcagattgggataataattacattaactcccaaactaccctgtgctggactttttttttaagttatagctctatggagatataattgaaatatagtaaatgggaaatatttaagatatataatttgatatgctttgacatattcacagtagtcccctctcacctgcatattcatttttttgtagtttcagtcacctgtggtccgaaaacattaaatggaaatccggaagtaaataattcatcagttttaaattgtgcaccgtcctgagtagtgtgatggaatctcgcaccatcccttgtgccctgtaaaatgaaggtgtattccagagaacaaaggaaggatggagcttttatagagcatctttctgcccaggtttgcattcaggtatattttttcaaatgaaggagtccaccttgcttagttcaggttgctcagtgcaagtgatttctgattggttggtgcaggctatacagtctgttggttcaggtggcctgaacaggaatggtaagctgcgaaggttcggagttaaacagatgtgtaggttttctggaaacttggggtacatgtgtgaccattagactcagttagcccctcaggattcatcttgagggatttgctctttgaggttcacagtgatcagatcaactgttgcagtatctcagtgcttgtgttcaagtaacccttattttaattaataatgaccacaaagtataggagtagtgttgttggcaattaggatgtgccagagagaagatagaaagtgcttcctttaaatgaaaaggtgaacgttcttgacttaagaaggaaagagaaaaatatgctgaggttgctaagattaagaacaaatctatccatgaaattgtgaaacaggacaagtaaatttatgctggtcttgctgttgcacctcaaactgcaaaagttatggccacaatgtgtattaagtgcttagttaaggtggaaaggtaaatttgtgagtggaagatacgaaccaaaaagatgttccaattgacagcaatgtgttgtgccagaatcattcagcctatatgacgacttgagcaagggatcccttgaaatgagttacaccaagtgagggatagttacacagattcaagaatacagataatcagtagtagcctaatgctgcgtcacaatgcatacgtctttcaccctacttcatctcattacataggcattgtaccatgtcacatcattacaagaagaaaggtgagtatagtacagtgaaatattttgagacagcccatgttcacataactattattacagtatgttataattctattttattactagttattgttaatattttattttatgatttataaattaaactgtatcataggtaaatatgaataggaaaaaacagtatatatagggttcagtactatctggtttcaggcattgactggggcctttgaatgtatctcttgcagataaggaggactcttgtacatcatgacatgtgtggatccaaaatctcaaaaaaacaaaaaacaaacaaaaaaaaaccaaaatctctttttgtgtgtgtacatgaattgttccagcaccatttgttgaaaaggcttcccttccttcactgaattgcctattcactttcttggaaatcacttgtccatgtatgtgtggatctatttttggactctgttttgttccgttgatacatttgtgtctctttgcaaccactctattttgattgctgtcacttcatcataattcctgaagtcaggtatcattagcctcccaactttgttttcctttttagaaacagcttgttagtttctaccaaaagatatcctgagattttgactgggattgcattggatcttgtaaatcaatttgggtagaatagacatcttaacaacatcgagtcatttctgagtctctcacatgtaaaaccattatctgcgtttaaaatgtaaaccactcagtgtcaccgatcataaaccaaaagtgatacttagggtaccttgaaattacattaagcagaacactgggaattggtctttttgcttgatttgcctgagtgattctccacaaaatccccacttaatatgataggtatgaatacgggatgccttatccagagcagctctccacaagcatcctcacgccacagatgccagttgaccgttacgtgtactcacctagcctgctggtacctgccagatggtgggcattttgggtgagattatgatagatttaagccagaggttcaggaatatccacattctccaaaaaagaagattaagccattattattgggagcagcctaattctagttatgaaggaaagagatcagggtgccatatgtacttagatagccatgtcttttatagcacatagcctttcatgttaaagctccgcatttttctaaaggagtattgattatagtaaggaagccaaggttcaactcgtgtatgtgtcaggtagctggatcattcattaccaccataggtgacacccatgttgatcagttacataaagaccacaaatggaatggtaactgggtcattgcaaattaaccctttctgaaagacagttcaggacatatttatccttgagagtgagcctacactatcctcctaagacctctcttttaagtggagaatatacattttggaaacaaggttgtattgtggttgagggcatgaagtcaacctgcctgagttcaaatcaccactctgcccttttctaacttttcaaatttagggattcacttagtttctctaagcctattttctttgagaatatggaaaattattatagtaacatggggaaattaaaagtgagtaattgtacaagtttagtgcacttgatatgttttgtttttagcatattttctccatttttcctttttccttttgtgtgttcttgttgccagtgactacctgtgaaatgtaaactgttgagtgaactgcttttgctttactttctgtgaattacttgttctactcactgtgttctgtctcttccattccctccgaacacttttgatcttttcgttttgccccagtcttctttcatttaaaaactaatttctcccaagaagcctgctctataaaggatgtgtagattagatgaggtgtgggaagcatgtttacttataaagcaacacaataccctatccatatccagcctgtaaaaataaaaatctaagtgctttttttttttttccctcccaagtaaagagaaaagtttcagggttatatccttaacatgtaattaagagagttcaagatattttatgttctatatagcaatgcagagaatatttaataagcattaacaaaaaaacttaaccttgtggtagatagcattgtactaattaacagtttattttatttagctacaagaactatgtcagcatgagagctaacactacttatgtttgacaattttagaataggaataaggtaaaaatactcaacagagataatggtagcttgcaaaccgtttatgtcaaatatattaaaatttggaatagttgaagactagaatccaaattcaagagtaattaaccaaaatagttgacagatgtcagccatgctaataaaatttgtataccctgaatattttccagcttgtaattaactgcacagatgatgtgatctgattttgtcactaactgcttattaatgaaggagatgatgactagttacaaaatccatagtgctagctgaattccaagtttaaatgtttctcatacagccggcattaattggagccacactagcctccatgctggtttgatttgtgcttactttcttcatttgtaattgcgaaggggaaactgaatttgttaaattcagctctgagtgaccttgaagatagtaaatctgtttttatttggtggtcagcagcgtaatggcttttatttttagattctttcttataaatgtattgtcatcaggctagtgatatcaccattggaagttgtataataaagtgcaaactgattatttcaagttcagctaaaccacagcagaacatgatgtcaatatgactgaagatgtgaacacagagtgctattaacaaatggtttaataacaaaagagcattatttatttctatcatatacatagcacggaagcctgagaagaagcaaaaggattcaagagaggcggttgtgcagccttcctgcctgcgccagctctctcccagactcctatactgctcttccttctttaccttacgttgctgtttccctttttacttctttccctggaaagggcgggtttaattctgtccttatttataagacagagatgtttgctacctcctgagcccaagtctgccagctgttggccttcttctttgggtggtctccctggcagtgtggtcttacagtatttatgtctgcctgctagctggttttgcctgttggacatctccacttggatgtctaccagacatccccaacttccatgttcttagtgtcactttaattttcctttccccaaattattttctctaccgtagtctcttctttcttatttttgtatttctgtgtttaggagtgcttaatgaatatttattgagtcaatgggtgatttcatgatacaattatagtagcaggtagtactaaaaagaggaactattttctccttatttaagaactttttataagagaactctagtttttcaaaattctgtttaaaatgggccacccagaactggacacactcttctgttgttcgttagtgttcgccttagatggccccacctctctgtcccctctctctagctatgtatatttcttttcaacagtcagttgttagattgctgtccttgattggttttctgttttcagtaggccagtccccagctaaattgggtgaccaacttggctaatgtccagttttatctaaagtgatgttccctgtttgcacagatgactttttaaaatctcctgcaaatgtgatcccctttagagccctacctgcatggtttgaatagcctcagtagccaatttcacaaacaaaaatgtaaggtctatgtgatgtagagtaataagataagaaactatttcctacttacaaactactttgaaaaattttgaaagatgagtttaaaatgtttaaaacattggtaataccagcagagtcagtaggcatatttgtaggatacttagtataaattttggtgtatttattttcttaaaataaatcacagtgaaatcatattattgtatcttataaaatgccttactctgttgaaaaggcagatttatattaaaaacctactagctgcatttatattaaaattgttcaccttattaacaggtcaaacaatatattcttttaagaattcacattttaacacttgggtttcagctgataaaacttatatgcatttgggtataatcttagatacctacaaaacagcaccaagacaaaaatgggctcaataataatgagagagcaagtattttaaagaaaacagaatttactgacttttaccatggttaggttaagttaggttaaactgtggaaggaaattgtgctgtctctcccctaaaaagtttaagagcaaattatcatcttgaatggtttagttattcacatgactgaagttaggaaccattccttttaactttttattttgaaataattatagatgtgtaaggacttgcaaagatagtacagagagctctttgtgctcctcacctggttgctcctaatggatattgcttatataatttagtacacatcaaaatcagaaaactgacattggtacaatgtatatgtgtggttctatgtcattttatgaaccttccttgaactcttcttaccccacactgtttataactgtcttacatatttcttctacacacattaagaatcacattagacaatattatttttgtttcagccatcaaacataatttagaaaactcaagagaagacagtctattgtgtttacccatatttttgcttatgttttttcttccttcctttccttcctgatgttctaatattctcttatcacttttgtttttttcaactttctttacatattcttgagggtcggtctactggagacaaattctctttattatttcaactgagaatgtcttaatttttatcttcatttgccaaggataattttgctggatatagaatttgcagttgacagctcttttctttcagcccttgaaaaatgttctattgctcccttctggtcctctttagtttctaatgagaaattctgtcatttgagttggtttccctgttaggtaagatctcatttctttctcaagacatgctaataatcataagattggttattgtaattcaagcagctactatgtgcttggcatggtgtatgctgtctgtaaccttgaaaccctctattatctctattttgtggataaagaatctgaaactcatgcaagtacattaacttagctaaggtcacacaatttagaaatgtttgagttaaggtatgaaccaaggcttgtgtgcatctaaaatttttgcactttatcatacaattgcggaaagttggagacaatcttatagttgataagttttctaccagcatcttacagcaaaaattacaatttttctgccagtcctttctttgactttgagtagaatcttaaaaagacactgtgtaagagccacgaaacttccttgcagaagctgtatcatgctaaatgttttggatcaattcaactcaatttaataagtctctgcttttaatttcattttctcaccgtgcattataaaatagcatttgtagaataagttaataataattttaagcaatacctattttcaaacaagacaaaattattattctatttgaattcaatccctaacaaataactagtatcaaatcagtggtactgcaaagaatagttaatatccagggtattgttttagctgcaagtgtttgtggattactgaacagtcaagtgggtttgctttgagattattgctttcccatgtgtttattctcttcacagtctttttcagttgttgcctggttcatctttttagacatcatgtaattggtagaacaacagtcaagaaaaaggttgaaaaaaaatacagatgagttctctggagatacgatgaagcaatctgagtgaatcatgatgtgcagtgggctttaggtttctatttttgtgcaagggaccgattatagagctctgaacttgaaatcttattaaaatctctgaagatgcagtagaatacatctcatttaagaagtgttctctaagagatttataattcagtattgtttatatatgtcttagtatattagatattattcattaacctatattagaggagacaatattttacttaatattttcttaagttacaaaagtaaaataacttaatagtaacaattggaatgattaacatattgtgaagcgaaacttatctttaccctagctgattgtgtaccatctcttctcaaataatgtgatattaatctccaactgatgttaacattgtagggtgtatctcttcatactcttccccatgctcaaacaagtacacacacacactcacttactcttcacatgtgttggacttcaataataataaatgtatgcttcataaattggaccattcgctaagttgccccccaccccattcttctaggacagtatgtatagaacagaatcacttaaaattaactggagtgtattctatagtatgaatgtactaattaattcagttattgcatattgatgtacatttgggtggcttcctgtgaggtattgttttttgtttctgttataaacaatgagacggtaaatatcttagcttatatatcttttttttttttttttttttttgagatagagtttcactctcgttgcccaggctggagtgcaatggcatgatctcggctcaccgcaacctctgcctcccgggttcaagtgattctcctgcctcagcctctcgagtagctgggattataagcatgcgccaccatgcctggctaatttcgtatttttagtagagacagggtttctccatgttagtcaggctggtctcgaattcccgagctcaggtgatccacccacctcagcctcccacagtgctgggattgcaggtgtgagccactgcacccggcctatatatctttattcttacacaacaatgctttgatttccagagggtaggtttctgataatgggactgacagttcaagggatatgtatacttaacattgtatagatattagtagatttctttcctaaatgtttactgcagtcttgtataaggttcattttatcacatctttaacagcactaggtgttatcactctttaagcaaatgtgatcggtgaaaactgctatctcgttgctttaagttgcatttgctgaatattggtgaagttgaacggcttatgtttattggccatttcagttttgtcttgtgtgaatttctgctcatattatctggccatttttctattgagttgccttttacttaccagtttctgggagtagtttttatattagggatattaactgtttggttatttattttggaagttttcccagtctatgtatttttgaagtggtttagggtatttttttttgctctagaataaattaaaatatatgtaatcacattgatctatctttgtttaggttttccatcttagttctacaaatatttgcctaaattctcttatgaatgttactgtcttattttttatataaatatcttttaattcatctggattttacttctatatatggtgagatatgtgagtcaagctttgcatttttgtagatatctagccacttattatgctaatgccatttagtaaataaaccaccctttctttctgaatttaaatgccatcagtactttaaaaaaatatttaaatggttacatttttccccagcttaacccattttcagtaaggtaatgactttttaaaagcaggatttagtaagttgaaaaggttatttctctttgctcaaatgtcaaatgctacctgttactctttattgtttctggctaaaattgcgagcacaggaaggattattcctgcgaacaaattcactaatcagcttgcaacctaacaattttaagaccctggggaaaaaagggaaagtttgggatatttactcatttcttctgtaaaagcaataacatgtaaacatagtgaagaaaggcatttatggaatctaagaaggaaagctctttgcttttcacatacagagaaattaggattcattgagtcctttctttacaacataagctctgtaggaatggttctccaagtaaagctgtgtgtcacgttttggggctaggggtgcctcaaagctgcacctacagagagatctgaaggcaaattgccgatttcacacttttattttgggctcatcctttatgccctgcacagagcgatcagatccatacacatcttactttcattcattgtggaaataatgtcctcaggcttggtggtacaaaatcgtgctttctacagtcttctgctaggaaatgtttattggatttagctgccattatacaaatgatgaaggagaggcaaagtaactccagtatctctagccaggagtggcttgaagaattgtatcagttacagatttgagaagatttgactatatgttgaattaggttagatcatctttataattagaagtaggcttttggagtacaaagaattcttctgtaaacaccttgaatatttaacaggaaggccataaggaaatataatgtgctacattcctaggatagaataacatgcagctattaaatagcacattttgtgaatatttaatagtagcatttaaacccaaaagacactgagcggcagagacctgtgtaactagtttgttcgttcatttcttcattcagccaatatttactgaacatcagctgtgctttcagcattttgtgaggctctggggaataaagatgaagggtgtagtctttgccctcctatagcttaggagctagtggacactcaggttacatcattgcagaactgtttattaacaattagccacgtgtccaggatgccatgaaaacgtagaggggaacacacaaatcagactggctgttggggggtcgacgagacttcatggaagtggtcacatcggagctgcgctccagaggaagaaaggaattaaccaggcataaaggttgagggtggttggagggagaggagctttcaactaggggtgaatagtaaatatagacactgaagaaaaatggaaatgtgtgtggtaaagtccgttattctgtataattggatcatatgtatgtgcacatgtgttcatatttatcgatatgtgagagatgatgtatagagtttggtaatagtgaggaagacctcttaccccaaactaaggtgactggttttgtcttgaaagtgggttatagtaagtaggggagtggtctcttcactgctgtttagaaggacttctctggacaaatgtgtggatgaggtattattaagcccaggatcttgaagatgagtagaatggtagcataataatctgggtgagaaatgtttggggcagataataaagtgggatgtttgagagagattttaagaagtagcagtgctagcatttgggatataaaggaagggaaggggtctaggatgatacgtagatttctagtttggaacaagtagacttgcagggatttggtttatgaaaacgaggggaggaatgagtttgggaatgggaagctagtgagttctgttttagacttaaatgtttggaggcttttagggttttgtggggacaaatgaagatctttattggttggctgaatagatctgaccttagctcatgtgaaaagagttggagattttgacattatcagtgtatataggtggtattttagtcatgggagtatatgaaattgcatagatggaataattgcatgaagagagaagagggatgaagatggagacatctaagatgtaggcaaaggatcacaagaagacactgagaaggaatggcaggagacataggaagaaaataggaagagaggagttttgcggaagccaaaggaggagaaagtttcataaaggaaacgatagtcattgcagtcagatggcacagagatttcacatcagctcatcctcaaacctgtctcctgggtttggcaataaagaggtcatcagtggctcaggcaagagaatgggaggcaaagtgagaggagtttataggttggctgctaagtggatgatacagtagctgggagatgatgtagggctgagcgagggtgtgggtatgtaagatgaacaagacgtgagcaatgtcctaaatctagggatgggggagagggtgaaaatataggagaaaggggcaattgttgtgaagttccaagagacaagcccggagttccaggaaaaatagggaccgctttcccactgagtctggagagaggaaggaacgttttaggatttaaggcacaggcaagtttgaggtagggcagagtaggccagggaagaatgcgaatagctgcgtttttgtttgtgaattaaagggtacattctgaggaaatggagggaagagagagggtcaggggacttggacacggggaagggagctgccttgcactgaggcctctgcagatgatcacactgcatcaatgtgatcaaaatgacgtcagtgttatcagcagtagaatcagaaacaagtcgatttcatctaatttccattatctttcactatgtgagatatttttatcctgaggatttacatgtaacataggactgagtgatttactgaaatttaagctacagccaatatttgattaacaatacaggtatgaaattaaacagtactgtcggccaccaggggttctactctgcgtgatcactttccattttgctctccttcaaaacgtccacattttttctctcagtcataaacatttaaaaaccaactgtactgggccaatcaaactagtgtagtaagtgaaagacttagagaagtgtatgcaggtggtgttgggcaattgcaaagagactagcctccaaatgggagtgttagcatagcacgcaggcttctctccttatgagctctgactccaatattgactcttttttgtatacagaaaacataatctgttcagaactcattacagtgaaggaacttgtattttaaaaacagagatagagaactaaatttgtattgagttaaattgtataaattctttaaggatttcaagggtaagccgactcacatgattaaagtaagttatgagcatttttgtttatctgttcagtgtgtttggggcttttgtcgtgtcagctttctttaggacaggtagaattttatctaacctcttaagaacaagtggttattttctcaaggactctaggatggtgctagataccccagattcttaggtgctggctttatgtgttgcctttgctaagcacttggttgctttctgccactctttggaagcaggtgattgatactagaaactgacaggttgtgagtgatgtacccttccattaaaaacagatatactaatttgcttttcaattgtagagagcctcttactataaacatccctgtaataaaggtaaccttataattagtatgtcaaaaaagcaagaaagttatgatgaacatgcattaataacaaatcaaaacctttactaataaaatgtcacattgagaggacttaattttgtgtacactttcatactaatataaggcactcttgctaatagtgaaagatggaaatatttgccaaccagctatgttatagaagaacttcctacaatattgtcctatgtacggtgacatttagaattcaaggaaatatacatagtcattgactttgtgtggaatttccctcccctcctccaccaccctgttagaaatccccgctgttgactgtttccagaagtcttgcagggtgttgtgataagagtccaattcctcttcccattcctgcctaggtcatctctttcttccctccctccttttgttctgtgattctttgttttatttttcaccacagaacatacttcattatgctgcccctgttaaaatcagttaccctattccacctgattcatccttgagaaaactactcatggccattgtgggttttaatgccactgccatccccgtcttgccattgcctcctcagctctgtcctgctaccacgatagagtggaccctgtgtcacagcaccattggtacccatcctgccactggtgtctagaactttgagcagtttaaccccccccggttttccaactctttccctcaccaacttgtgaagcctctgaactggtatctgagcagagccagtgccttgcactgtgggagtttcctgtcctaatgcttaaacaatggctctagaacttggctgggcatgaggaacatcactggcttgtaagggatgcagagccctggtcccctgaataagttgccctggtgggccaaataatgttattcctcacatttggtatccacatcaaatccctggaacctgtgaatgtgaccatttggacaaagggtcttcgcagatgtaattaaattcaggatcttgagatgaagagattatcctggattatctggtggaccctaaatgccagtacaaatatccatatgagagagagacacagagggaggggaagaaaggagaggaggcactgtgactgcaggcagagattgcagtggcgaccacacaggaaggaatgccgacagctgcctactgtaagaggcaaggagcagatttccccttagagcctccagagggagagcagcctggaacttctgggctcaaaccatcctcttgccacagtctctccactcactggcactacaggtgcaccaccatgtctggctaattttttttttacttttcatagaaacagggtcttgctatattgcccaggctggtctcaagcgatcctcctggactcaaatgatctcctggactcaagtgatcctcctgccttggcagtattttttttaatggcactgagagacagtattatttcctcccggcacatttggattgactgttaagtaatcacattcatttcctgattttgatacaatgtacgactggttttgtaggagaaaaagaattgggaagttttaggaattagaagttatgtagatttttaaacattgagaactttgtcattttcattaaaaggctaacttttttgttataacttatttcctattcacagtacatcaccagctgcttttttacttatataaacttggacccgagatcaattggttgcctgcttactcattctataaaaatttggaggcaccatacagtaagaatacataaaaataatttacatcaaggaaaaccaggtccacaaataaaatcgatacagctagattatgaaaatcaactcactttctagagtttcatctttatcattcattttaatgttacgttttttcagttttcccatttaaaaatgaacttttattaatgcatttcgattttttcgtgttccccaagatttgtgtgtgtgtgtgtgtgtgtgtgtgtgtgtgtgtgctgtgtacatttaagtctatgcaattctgttacaggtgtgggtttgtgtttccacagtcaagatacaaaatagttgcattactgcaagagtcccttgggttgtcctttcataactatcccttcccaatctctgatcagctgcaataacacatttgttttccgtttctataatacggtatgtaaccttttgggatttgctgctttactcagcataattctcttggaaataatctgatttgttgtgtttatcaacagttaattcatttttattgctcaggagtatttcatgatatggaatataccatggtttgactcttagccctttggaggacatctaggttactttcagttgttgagctgctgtgaaaatttccatgcaggtttttgtgcagacatcactttccatttctctaggatctgtgcccaagtgtgtaattgctgggttgtatagtaattgtgttcagtattataagaaactgccaaactattttccagagtgactgtaccattttactatttcaccagtgcttgagtggtaccgtttctctgtatccttgcctgcatttggtgttatccttatttttttattttagatattctgataggtatgcagtgatatcttgtggctttaattcacatttttgtaatggctactggtgttggatatcatatgatatctgttcgtgtcatttgtccattttgtaattggatttttgttttttttttactgttgagttttaaaaatatatattctagatacttgttctttgctggatatgtgggttgcagatattttctctcagtctgtagcttgtctcttcatcatcttacgagggttttcacaaagcaaaattttaaattttgatagatctaatcaattttttctatatggatttgcttttagagtcaattctaagaactctttacctaccattagttcctgaagattttctttcctttttttttttttctaaaagttctatagttttaagcattacatataagtgactcatttcaagttcattttctataaatgtgagacttgggtggagattcatttttctttttaattgttcaatggatgcctattatgccagcactgtatgttgaaaagaccattcttgccctgaattgctttttcatccgtgtaaaaaattagctgggcatcttactgtgtgtctttctggcttctctactctgttccattgatctgtgtgactcttcctccaccgataccacacagttttgattatggagctatatggtaggccttagtattggatagagtgattcttctcactttattctctgtcaagattgttttagctattctaggttctttgccttttcatataaatttttaaatagtcttatctgtgtctgtaaaaaaactttgctgagattttgataggaattgtgttaagccaatagatcaatttggcgaggagttgacattctataaggtgacattctatgcatataagttgacattctatgcttagtcacaaattctttcagttttccttgtcttagaatgttcttatttgttgttcattcctcaagggtgatttcactgatgtagaattcatggttgacagtccttttctttcagcacttgaaaaatgtgttgaaaaccttctggtctccatggtttctgttgagaagtctgctattatttgaattgttattcctctataagtacagtgttgtttttctcactgatttcaagatctttttcttcagtttttattaatttgtcttgctatgtttttccttgagtttattttgtttgggcttcactcagcttcttgaatctgtagatttatgtcttttgctaaatttgggaaatatttagccatcatttctttaaatattctttcagccccagcaactttctcctctgcttttgaagctctactgacataaatgttggatcttttgcttttgtattacaggctctgaggttcagtcatttttctcccagtctgttttctctctgttgttgctggtcaattccattgctctatcttcaagttcactgattttatgctttgttatctgcattctcttattgagctcattcagtgagtttatctttcagttattgtatttttcagttctttaactttcatttgtttttaaaaaaataacttctagttctagatttttttgttttatttttttccgagagaatacatagttgcttgttgatgtatttttgtgatggctgctttaaaatccttgtcagataattccaacatatgtctcttcttggtgctggcatcagctgctagctttttctcactcaagttgtgattcccctaggtttggttgtgatgtgtgactttgaagtgtctcttggacattttggctgttatgttaggagactcttggtcctacttaaacctgttattttagctgacagcccccttagttaggtttagcactcaggttctggcctgcttttgtgggtggttccaatgagacctcaattttagagcgtttgtcttgctgtttgggtgtcttttgttcatctgctgccgataggactcccccgatccttgcaggtgcctctcaagggtgcacaaggtgcttccgcagtcctggctgcctgggaactttaatgggggaagggagtctggaaagaagtgcttctgaccactgttgtcagtgcggttctctgttgtccgcttttctggtgccactgtgcttacttgggtgtcgttactgggattctgtttggtccgggcaaggagtgagcctgccttagctgctgcctttggttgtttgtaggtcaggaaacacggggcctggtttgctttcttcccttaggtgaggttcataagatgccctgccattacgttgtcccttcagtcttggccttcctaaccagttagtttgcctctttccacctttcttcttgcaggaagaaaatttaacttttttttctgattcttgtgcctttcccgagccaatccccacagacactatacacaatgtcttcttatctccctttaccttcccactgtcacaacttgtggttcaatcataatgtggtgtgtacatccttatgactattaattattggtcatagctgacccatacagcatacgatgaggatagctcctctctttccaggtttctgttttgcctggttggattctatgtatttatgattagctcatctctaaactgtatgaatttcagcttaatatggccaaacttgttgactggcttattatttccttttccttttcttcctggagatcttcctctaagagctacacatcagtatgagctgattgttctctgggtcttccagacagctctcatcttggcacctcacaccaccaccttctccctgtctcctttgttgttaccctgattccttggactccatgtctctctctctttctggttttacttgtttattggagcacaccttctgggagtttcctgagaatgcatgtgtaagaagtaaatgtttagacacttttgatctttggaaatgtctatattttactctcacacttgtctaggtaaaaagttcttggttgaaaaccattttccttgagaattttatattgccctttgccttatagcctccagtgattctcttgacaatggaagtgacacttggattcttttttgtgtgtgtgtgtttttccctgttggaatactcttacttgtctttttctttgatggtttgaaattttgcattgatattcgttgatgtggcatggtggccttgatctgggtcttggtgggttatttaatctggaaactaatgtttttcttttgtgggaagatatattattttcccagaaagaagtaataaaattatttctttcccctgttgtctctcttttctctttctgaaattcatttaggatataagctctaaaagtagagggatttttgtctatcctaagtgcctagagcactgtttccatagagtaggtccatataatacatgtattgcacagatgaataaatgaactccttctatgtggctgttaagtctcctggatttatcttcaaatttgtttccctcttttattgctcagttctttttcaggccatctacccccttttttcttcagaatttttttttttgtacttttttgtaccttttctaaggtaacagttgtggcaagaaacagaaccatctacaagtatacaacctacctggaatggatttttacaattccagagtaggaggtagatagaggtcatgatttattgttttctatataaatgtctgtttgatgcagcatcattataattaacataatcatcctttctccagtgcagcgcagtgtcacctttgtcctaaattgagtgactttgtaggactctttctacttgctccaggaaatacagattacgtttcattggtctgttttgtctacctatgcaccattatcaccgtatcttaattaccgtagttttacaaatagtctttatgtttggtaatgaaagtgctctaaattcattgttcaggattgtcttgatcattatttaatgggggaaagagttttaagtttccatgtaaagtttccatgtaaacttgtagaatcaattgtcaaatgacatacacgtaaacacagaccaaaaaactctgctcagatttcgaatgagattgcattaaatctatagattgacctgggacaattgacatcattatagtattgtatcttctaacctatgatttttgtgtattctttttgttgtaactcttgcattttatctgaaattgcatgagaagttttgtctattctttgaagtaccttgttcatttcataggaatttggtactgtatttgtagtacctttttatactcctctttatgtaaggtatgctttcagttgtcatactttttgtatggctcatcacttttaaatgttgctggtttcaaaagacttgaaatgcacaaatcgtttgctgtttatgtattagtttttaacattatctgatgttgacaggcagtcgatatagtgctggatgtagccactccccagtgccatgaagaacccagtttctgcctgcctttctgcttctccttccttaatgtgttaatttttgttctgtgcttttgccttatagttgaagcatcactttcctgtttcaagaaggaagtggggaggaggacaaagggacaaaggagatgtctgtagaatgtattggctctcttttttaaaatcagggaagaaaatgcttttctaagtccccaccccataaattgcttcgtcgcatattgttgggaagaccttggtcacatgaacctcctggtcgatcatgaatcaagggtagtgagatggctccacttggtttagaccagttgtgatccatgtccttggcctggggtaggggccttcccttcctctccagtactgtttgaactgattgggattccttgaatagaaaaggagagagaaataatgtgtaggtaagagaaggtatctctcgtgtttattgaggcttttcaatatgtaatttgcttttaattttaagaaacttgcctgcctcttggatagcaaagaaagtgatttttatttgtattggtcttgcttttgccaaacattttaaaattaagtgatttggggataagtatttattttgaagtctattttattgtttattaagatatatttcaaagtggtataataaatgacattattattttcataaactattgcttcctgaagtgtttcaagccaaataaacatttatctttttgatgggaaaatgctttctaaatttccctcagccaagttatagaatggagccaactgcagtacatgtgggtcacaacctgcttgccatagttgtattctgggatgattgattaatttatgcctttcataaggatgctctgagaaagaaatgagtgagaagatttaattactgaattattaacttttaggagctccactttggaatgtgagtcaatatctattacagactgtacgtgtttatgctattgaaaatatgaattaagaattgtctttggttatttgacaactcaaaagattttataactttttgtgcagcttaaaaaggaatttagaaatgtacttttagaagggaaggaattcggataatttatatgtcagtgtgtcataataatttatttacaccaaaatctcattcacagattccagatttaatgacctgaatcttgccatttcttttctttaggcctacccttattttataggttctataaaataatcggaaaggaattagaaatagttttgtgtgtggtgtcaagtggctttgtttaatcattgggaatgaatcagttaaaaacttattttggggctaaaaacagccagcccaattgttataaattggagaatgaatgaatatgaaaatctacttacagaaaccattttaggttattcatatttcctgcttgctctgtttcttgtcatttggtattttaaaaataagtcttagactagattcttgactaaatagcaacctttttatctttgacagagacacgtttcttacattataaaaacatgaacattcaagaataaatcacagccaacttgaggaccatacatatctgacttggaaatttgctaatatatacagatttaacgggattttacacattttcgtgtttttgagggcttgtaaggtttcagtttgattctcatatatgatggttgatgtgttgtacaaaccaattaggagagcaatctagcaatcccttgttgagttagaagtgtgcagaccctaggacccagcatttaccttaggcggtcttactgttgttgcatcttggctttgtctagtttctcttgattcctgtccatttttggaaccttgttttctagtcactgtgacaattctgtgagcgacatggtctgtttcccataaattctttgtctgtttgatatagctgaagttgtattacttcaaaccgtaactctgagtggtataacaaagatatcaaattttagataacacccacatcttcctgagcatcgtgtgattttagtagctagaatttctttgtacagaagtcattgtggagggaaatgatgtgaagaaaagaaagaaaatcctgagaacagagcaacagttgctgtggagtggcgtgagggccgaattcaagtataaaaatctggattagaatcctccggtcacttagtagttgtgtgactttggtcattgttgaactgttgtgaggtttccttttcagatcaaaactttcccttttccttctctcattcccatcttttcaacagatgacatcaccttatatgttacagagaaacagaagccattagatggaaaaaacctcaatatccaacttacagaaatgactgacctgcatttatcttcagcatttcctccttttattaaatatctgaggtcagtatctccacttgggttttgagttccatctttttctgtcttcctagggaacatgtactatcaatttatcttttccctttcttgaatacccaacttgttgctcttaaccagatcagtttcatcggcatttaagcatgttcaagactcttctgtattaaaaaagaaccacgacctcccctaacccttccctaatctaactactgcaccctacctcttctctttgcatttacagcaaagctcccggaaagagttgtctgctcgctgcctcagcccacacctttttcatgtggtttccgcttctgtcattctatcagaattgctctgcagaggctgatcagtgacttcagtgaaaccaggcctaaaggatgctcttcagttcacatctcactcctcagcagcattcttcaccgcttgccgctctatcgttttgaaatacctgtaacaagcatgctgccttggtttccctcctaaatgacctctgctccctctcctctcaatatctttctctcttcccccctgccccgccgaggttgagtatcattataatatcattgtctacctattattgaatgttagcatttcccaaagctagacctagttctgttccattctcaacctacaatcttttcctaagctatttcattcatgtacatagtttgaattgtccttttatgtaatattatagatgattcaaaaatttatctgagctcccatcacgtctatctacctgttaacttgatatttctacttatatctttctaagccatctcaaactcaactcgaactagaccaaacttacctatctacctagtccagctgtaccataaactttgatgccttattcttcttgatgcctcatccacattaactccacttatcaccatattttcacctcaaacacctctgtgatctctcccctcctctctctattgccgccatcctaatgcaagctgtcatcatctctttcttggccaactgtagtagatgtagtctcatccattgtggttctttctagtctgtctgggactcatgacatcgtgcttttgggaaacagaagtgatatcatgttacccccaccaggttatccttgcttgccttctcattgctgtaaggataaagaccacagaccctcacatggattttacctccctgggctaccccatttggcagctcccccgtgtgttctcccttcctttcctctgagaggtgaattgtgccttgttccctcctgctatggggctttgcacttgtttcttgcccttccttcatcaacttgttatctaactctatcctgtgctttagatcttaacacaagtgtcatttccctgactccatggagatggggtcgagatttgtaggctttgcttattcttcatagtcctttaggtttacatttaattttgtgaggatttgattaatatctcagtaaccatgatagcaagaatatctttttgtttttgtttttgttttttcaccattttaactttggtgctgaaaaatacttgtcatatagttaggactcacatattcatgaatgaatgaatgaatgaatgaatgaatgaacatagattgagttttgagccctgcacttaacacgttctttttgtgtgaccttggacaagcttttatagaggtcagttttgctaaaagccttgcttcctcacctgttaaatagggataataattatatacaataatataattgaatgaaaagtgcataatttagtgccagtaaatgggatcatttagccatgggatcatggctttcactactggagtatttacaacttctgttttgctaaagtaggtgagttttctgtgcctatttaaactactttatatccctcaggaaaaaacgatggagccagggcttaggccttgtgaggagcctcattcatttccccctctctgctggtctcactccttgaatgctggtctctccatacatttctctgccttagtgtctgatggcttttaacatgttccctccaggacaggccataggaggagggtctaatgcaatggtgactttggaacctgaattggcttcttggacacattccaggcataagggccccaaagttcttttgttctgccttaggcatgtgtaacctcagggctttttctcccagctctggagcttcattacccagaggaccaggcagatgtcaaatgtttctcttacagttcatttatatttctctgatagctttaatctaaaaataatcaaaatcgttgtatatttttactgtgacttaaccaattgtaaaaattattctaaaaatacgcagttatttctgagaacaattacactgacgcatcgttccctgagtgaaacctatacatacatgttccaagtatatgaagcagttttttggggacagagtaacttttttttcccctctgttgaaataaggtattgggccaggcatggtggctcacgcctataatcctaacactttcggaggccaaggcgggaacattgcttgaggccgggagttctaggccagcctgagtaacatagcaagaccccatctttacaaaaatttaaaaattggcccagtgtagtggcatgcctgtagccccagctacacaggagactgaggtgggaggatcatttgagccgaagggctcaaggctacagtgaactacgatttcgccactgcactccagcctgggtgatagagtgagaccctgtctctaaaaatacaaaggtattaaagttaacacttgaaatgcctttcattctgtcagtggctctttttttgtttgtttttgagaaaagctgttttttcaagtcaacatttaaaacaaggataataaatgaagcatgaagcaaatatgtataatacattattcccgttcattgtgtatgtatgtatatatatatatatatacacacacacacatataaagtactttggcagaaatatatttcaattttgacttatttttcagttcagtttaacaggacacactaatgtcgggacagtctttaaaaatttggacaaatttttaaagagtaagttgtgacaatgatattacatgttaaatttgtccttgggaaacatagacatttatgtgattttttttccctttagtatttgacatcaaactatagcttccactgagtagttttaaaataatgtacttcgtgctgctaaggctaacattgttgctaaccagaggaaccacagaggaagacttttgaaagagagggcacaaactcttacagatgtcaagagtcagaatttacatgtggtggggctaatccgtaagtgagattaccgttagggagctccttgacgcaaattggcattgtgcctgcacttccgtgtgacaagtgggattctcagggtgagccctagagtgtgctttttgacttgtagcatctctggattctgggctcaagcagaggccctcctgcccagttggccaactgcgacaatgaatggtatcgtctagaggtcatcataattctccccagcatttccataacacatacaaattaaactatgagtaaaaaaatacttaaaccaaaaataaaaatgagaagaaataggcatatgaaacataatgagtaacgtcagcataatttgagattttggcaatggaagactgaagttgagaagtgtttccactagggatactctcttgtgcctcacattagtgtgtcctgttatttaatacccacagaagcttccttttcttccttgaatggctttgcactgctctcattgctaggttcatatactgttgggtgatgggtgggatcaagtcccctgtgtgctgtgaacacacgcatcctgattcaccactttactgagggtgggaaatgacagaggttgggcctgtgttctcttgtcacctccgtatatgatcattcaggcgcgtgtctgggaaggtgtgaaggagtgtcctgtcagccagttgagaccactgtgttggtgttctctgaatggctttgcagcctatgatggagtactttagggagtcaccttttgggttggccatcagtctaacactccaagcagccatagggacgtgcagaggataaattcatataaactacacctaaggcgttcacacatggtccaagttgtctgtgaataaaaagtgttgctgtaattttccatcactctttttgtttgtttgtttttctggagtgataaagatggacatggaaccctttgaatggtgcttcaggaggggctggtttttctcttctcagatgggcaactcagctaggggaggtgaggttttgttacaggatatgccttgactactaccatgtggagcaggactgctggacatgttgccagccatgaccgagcacctgaaaaccctgtgggaaactacctgcctttcatcgagttattggaatagggagagccttaggagtcctaaggcagattttcagctttatatgctagttctgggagccgtgttctgcaggctctgccaaaagactttgacctcacaagtgagatgttccatcctgaagtcctggatgctgcttctcaaaacattaataggaagcgtgacatcaagccatgctggctctctgaagttggagaaatgctgcatgctcacttggctaacaaggtgaacattactctgtcaccacatttttatctagtatgcgtcctaatctcaaggatccagctaagttgtgtgttgtcagttggagacattagcttgggcagtaagctcagccttgcactgcttctggcaggtttactcatcttcatccactcttatctcgatatgaggatatctgttttttgagcatgttccatatccatgtttcatgtgaaattgcttgtcattcttgcttatcacttaaaataataactggctcccttcttttgtagcatttgctaatagtggcagaactatttatacgattatgataatctgtcaagaggattatgcaaagtatctccccccaccccttctctaaagcagagttaaattgaacactgtaaaggacattttcataaccaaggatttttaccaattatttactgtggatttaaattgatactgaatgactggaggcattgatttttaaagctggaaatatttacaaaccatccaattctttttccttagtattttgtctctagttacttcgaaatctctctcctctctctctctacacacacacacacacacacacacacacacacacacacacacacacacacagagatgtaaaacatacacatagaaagactttaaggaaagacatcaaaatggtaaaagtcattatacctggttggttgaattgaagttattttatacttctttatacttgctttcttcatggggaaagtatttttatgatcaataaaaatatttttctgtaatatgtatgtactactttacaatattaaagcactttcacatttttccaaaaattaaaagcacagtgaaatttgcacattgagaaacatttggagccaattaaatgccacttatgtttctctaaaaaaaaggaaactacttttattcatgtaattaagagccccactcatgaacattaaagaattgttgcccactgtacttttggtatatgtagaaatataaaaccaaaaatgtatagtataaaaataaaaaatatacaaaaagtaaaaatataccaataacccagtaaaacaggattttgattggtatttggagaaattagctagatgtttatctgaatagattttttttgctttttagatatttaataattatagtaaattattttaaagtcagtatctgtactaaagtatgatagaagttggaatttatgttttgcagctattaaattttcttaagaacaaagtttgtttaaaccttacattcaatttcttcgtttgtgatttctttccatagtttctttgtattacaaattgagataaaattaaaggtaaacttaatttttttagtaaagcatttgtgattggatagtgttcaattaaaatttgttctctaaatggaaatttagtctttttcccttagcattagactttattagcttgtttgctgataaatgcttggaggaatctgaaaatgcatcacaagtttattagagatcttttatgtagttattaggttttctggctttctaattatcatatataggtgatgtaatcattgttgtcatgtttttttaatgaagattttaaatcgttttccactgtagacatttataatgtaatctatgcaagaaatgaatatttatctcagtattttaaaatggaaaaaataaagcagagagaaatcataaagcagagagaaatcattcatttcagttgtgaaaagttcagagatatgtttgacattcctttagtcttaactgcatctgttattcatgcttttctagataactgtataatattttcttttactactaatgaaatgtgattctctcatgtccagtgatgtgttttctgaaatgatataaacaaaaagtggttaatatgattttattaactgtgttgggactcagaaaatatcccaaaatgaaggcctcagaagaagccttagaagcaaggctttctctgaccttctcctgccctcctgtctcagtcgcattctcccccgaatctacccatagaaactagaatttgtcttccccaaggcagatcatagaaaccagaacccctttccccatagccagccataaaacctaaaagtattactctaacttttcctctgcctctctgtgtaaaaactagccagaagaacattgtctgacctacggtgtttgactgtaggtcataacaccctcattccagagagtgtcctcccttatacccagaaggaaggagtattgaatacatgcccagagaggccaggaagaatcctgctgggtttccgaactcagtctgttagcattagatcgtactgtctctgttcaatagtatttcttgagtgttgtccgtattttgttaatcttaagcataaaagtggacaacttccctagtatctttgggtcttcattatgaaggcctctgtgtacacgttaataaattgggatgcgatttctcctattcattgtcctctcatcagtgatttttagcataccttcagagggtgaagggggtaggtttcccttgactcctacaacttttaacacaatttaggtatttccctaattgctgaagttaccatatgaaatattcttattaacaacgtgttaggcttaaaggccagtttttgctgatcatgtcattatgtactggctgattttatttatttatttttagagaccagagtctgttgtgatttgaaatttcgaatttcgtgtcaattatgtaattccatcagaaattccccaaaggacacacctgtaatcccagcaccttgggaggccaaggtgggagaattgcttcaagccagaagttcgagaccagcctgggaaagaaagcaaggccctttctctacaaaaaataaaacaaatgaaacattagtcaggggtggtagcacacacttgtcgtcccagatacttgggaggctgaggcaggaggattgcttgagcccaggagttcaaggctgaagtgagccatgattgtgccactgtactccagcctgggtgacagcaagaccttgtctcttaaaaataaataagaaattccttggaaggaattaagacctgcagtaaatagcatgaggtgatgtacacttctttagtatttcttaatatttgcagagagcttgtctaaattgtgacttagttttccggttagggcctattcctaggttgtttttgcaaagaaagtttttgtgtatgtatgcctagcttttccttatccaatgacctttgtaaagactttgtattctccatctaacgtctagttacttaaggattttctgagcagtttgcttgaagtctgtttttccttcctagccattgacagaaaacacatctgccttagtgaggcccctttgatcttcagagagctttatctaaagagagattaagaataaatctgtcaggcattttcccaaagaaattgaaaatgcttcctaagatttcagatcaggtaggtaaagtgtttctctgaattaagacatacgaaaataagtatgctagtcaatggtttcatcctaagttatagattgcagagatttgcttctggcatgaaggaatattttttatttcacccgagacacaaaatgcatgcagtaatatcaatggccagaagcaactgcttttctttcattcatttttccatatttaacactagcagggtctgtggagaagatactagagagggtccatttgttctcagcctttttggggcttagcatcacaggaagaattttcagctggtctagtttgaatctacatactaaaaatttccaagatccatatgccaacctcctttctcccttcttctctccctcctttaaacaaatatgcacagaatgcttattttctaccaaactctgggttcatactatttactaggagcaaacctaacagataggtataggatctgatacactgtgtgcctcagagatagtcaaggtactaccctgaaaacgtgtacaactatttaaagatctcatgaacaccctcagttttagtatagaaatataaaatttgtaatcaaacaatttaatttttgatacactattttgaccttttaaagagttacagctaagaacagctaatgagctgttaatttagaaaataaaatatatacagaagtctgctttgaggttcttagtcagtaagaaaaccttggggagagaggttaaactaggtacgctggagacttattatgactttggcagtatgaaaggacaggaaacaaaaggaaaatcttacaaagagttatagtctgatttctgaaatgaatgtttacttgaaaggacacagaaaatagggtgccagcaggagaatccagttttccaaattccttttccgaaatcccaggctttttatgaaattttgagagaatggcttaggcttatgttttccattttgagctgcttagaagcaaatatcatataaatgcaaatttctactattatcatttactcaccttgtattatgtgcttaaggagttggagaattcagaagctgtttaatatacaaggcattgcctataaaatatttctttgtgacataatttgcttatttgataaacaagtatctttctttcctcctccttataaacaccccaaattagtttctgagttgaccaacaagattccatcagcatctggcaattattttatctgtttgaggactattggtatatgggacatgagttgctattatttggtaacattttgatgtccttcatttccttaattagtttaggaaaactatttggattttatgtacaagtgcttgctaattacttgagtcgtgagaagactgagtgaggtccaagtgtcctattaatccctttgagtctgaacattttcttataattggtttggcaagaggaataagtgagactagttgctaatgaggagataagtatgtaattttaccatgatataaagctgtgattgtcagtaagtggtattaggaatctagattatttttattagaacttatttctttctgcaaaatcattatcatctcctgatattgtaaattgggttatttcacaccattatttttaatatgtgttaatcctcaaactacaggtacttaaaaccttgctaattaaggagtcattaataaagttagcaatatgagccgtcagtttcgattcttcacaccatttagacgcaattcaattttgcgtatttacactatgttttcagtttggctcagatgtttgaagtaagtcaagagtaagaagtgttgtcaacttcagatccataggccagcttagcttgttttcaagatgaaggactgataacattgtaaagaaacagagaaaatactgcttttcttagccaagaacagagtaagctttgtatggttttactttttatagtctactcggcttttctgttcttaaaagttgcctggttatagtagtttaaaacactctttgggactttatccattgaacttcaatgttctctgaaacaaatattgaagtgttttgcatttgattttgaggaaaggtttattttccttttgaaaataatcaaactctttaagttgttcctaaccatagtcacttttacttgaaggatgcattatagtcttgagcattttttcacttttgtaatcggtatgaccctcttgtgtttttgctgatgagatggtagcagtgctgtggtattgtttgcaggtcctttcttatcctttatctgtgtctccttcccactgtgttgtgggttggtaaatgcatagttccctccattactttttcatggctgaagggattgtaaatattgttttgcatttctagtttttttagatgtccatagaattccatctttagccatagtgcttttataattttgtaatacctttgactagctggggagggggtatagataacagtttagtttccacatattactcattttgtgcaattttattgtgcttctgatatatgcccagtatgctattaggtgctgtgaaggaaatggaaaaaaaattagtaatttttcctgcctgaagaggtttacgatctaattagagggacaaggctaactaaaaagttagaaaacaatacatggtgaagataatgtgttaagatatgttttaaaagaacaaatttatgagattattatgggtgtatcttaatagaataattataactgataatagctggttctacatttaggtaaaaatgattacttccctatgtcaaggcctgaaatacacaggatgttacattttgaattttaaaacaaatcagtatctcattaaactttatggaacaccatgaaactttcaaaatttagaactttaacctagattactgaatttgcatttgaagacactgaggccagtgacgtcctggagtttcaggtctggctaacagtaccagcatgagaacatagggtaacagcaagttgcttgccgtagttttaggtctggcttacagtaccagcatgagaacatggggtaacagtcaggggcttctgagtagttggccgcaggaggtaaagctagtaagcactgctaacataataaaatgaaaggcattgcacacagaccagtggtctgctatttgaccctttcccttcctcctcttctttttccccattttccttttgctgctcttcttccgccatcatcatcagcatcctgacatttgcatggcttcttacgattttgaaattgttttcatatgtacacatttaccggagcatcacaacagccttgtgaggaaggtcagcattgactctgattgaagatgagaaaacacacctgcaaaccagtgaactaatttacaagagtaaatggagcaggacctcaaacccaaatttcctactccaagcctttcactgtacacactgcctcttagaaggctggttccaccccaaatcctttcccaaactggggaatcaattagaagaacaggtagaaaacaaggagtgaagttgtgttcaaatgcttacaataattacttggcttgtaccttttaaaatactttatagatttacttcttcaataatccttgtagatgtgtgtttagtgtattgttaggaattgtatagcatttacaaaagtctaggctggtttaaaccagtagtttgtggagcttttaaaccctgagagaccagcctctagataggactcttgcagtatgtgggacgttggctgtcctaaatgacctccaaaaaggccttttaaatctactccttgcttccatgtgctttattcatgactaccttttatttcctgggtccaggtactaatacatcttgaattatttttttttttccattttatctttctagttaccttccttctacttcttgctgctgcctcctacacagagccctggctcccacagtaggttaatatgtgtaataatgttcagggagtgtgatgaacatgagctgaaaattttagaccaccgtatggtctgcctatatttttctaatttttttttcctctccaaattcgcgtatgttcctagctaccacagcagtgaagggtagtggaaggaatgtggactttggagcccaaatagtttgggctgaaagaccaatcctttcaggctcaaatgcctcgatatttttggacatccacctttaacctgtaaaatgagggtagctgcctgccatgtggtatcatgcgcctgtccctttacctgtcaacttgacatctctaccagatggtgtttttttttttttttttttttttttttttttgagaccgtgtctctctgttgcccaggctggggcgcggtggctcaatctcggctcactgcaacctctgcctcctgggttcaaacagttctcctgcctcagcctcccaagtagtggtggcgtgcgccaccacgaccagctaatttttgtatttttagtagagacggggtttcaccatgttggccaggatggtctcggtctcttgacctcgttgtccgcctgcctcagcctcccaaagtgctgggattacaggtgtgagctactgtgcccggccatctctaccagatgttttaaagacacctcacatccctcctgtccagtaccaaccccagtatctcaccactcagtctctccctccagtcccttggcctacccttgacatgttcattgttctttaattcctttaacagtcttctatcacattggacgtttacctctccctcacactttgtgtcttacctgttaccgtcttgccacctctacttcctacatttctctgtaacccatccatgtctttccacctctaatgtcatcatattcaaattattgccatctcgcacctgggtcattacttctatttttattttttgagacagggtcttactctgtcacccaggctgcagtgcagtggcatgatcatagctcactgcaggctggaactcctgggttcaagcgatcttcctaccacaacctcttcaatggtggggactatataggtgtgcaccatcatacctggctaatgttttaatttttgtagagacagggtctccttatgttgtccaagctggtattgaactcctgggctcaagtgagcctccttcctggcctaccaaaattctggaattgcaggtgtgagccaccgtgtccagccctgacccattgtatcatcctaactgatacccctgcattcacttggtactctcccgtccattttccacatggcaaccaggatgataattttaaaacacatttaatcatgatatcctcttgcttaaagctctttgattccttccccttgttccattctctcccttatgtagaagctgatgactagttagttccagggtctggaacctgaactctccctcctgctctttagtgtcacttgcttcttgttgtcttcaaggcctggcccttccttggatacttgttctcccctctgtctggaagtgctgcttcttgctctctggagccctccccagccctgccccttaactgccccacctattcgcactggttcatagcagctcattctccagtcttcctcctttgagccccctcgggtgtggggctcctccagagcagcgtttccacccttggagcacgtctctctcacttggtgctgcgatgacttgatttcgcaaaaatcaagcaggacaaaggagatgcttcacatcctagttttctttttcctctaacgtcttttctaattgtgaagtttattttgattattaatgtttcattggaaagaaattatttctcattgattgtataaaaatcaaatgacatgattatgttatggccaggttttccccctccagatgaaagtccaggggagaatggtattaaaagtaaataaatttacttaactctcaagtcaagatttatgaatcattgactcaaaagaatgaagtatattatatttgtacaagacagtcttccacagatgcacggtttcatagtggaactgcatttaaaaatcacctgagctgcctctctggctctctgtggcatcatgtggtacttcttattcattgcgacatgggattcctgcccaaaccattaattaaacattttgactttccctttaaaattctgttagcatttagtagctttaatttagttttaaatgctgtttatacttcctgcttattatcttttggtaattaaaacttttcctattcatcatcaaaaagtctgtatttttaaaacccatattttaaaactcaatttaaaacctattttcaaacaatttctctctgttttagattaagtgactaattttctttatattccgtttcactcatgaaaggttttggagagcttcctaaaaggtacgatatgcatatgaaaactgttcctgtgctcttactcttctgatctgctttcaccttttatggctttctttaatgccagtgacttgaacattacacaggattccatcacccacagctgtttgctgtttatacatagacaatatttttcagttgccgttaccgctcctggtcgcatctaacactaccagggctatgtcttcagcaaaaggtgagtggtagttccagtacttcttttcctttaaccagacattactttttcctagattattatgccattgttctcattgtaatctatttctacatttctgccgaatgatacaacttagtgaaatcttctaataccttattaccaaaaagtttggggtcatataggactttatcattattttgtttcagaatacatatgtgttttctacctatgccattgttttttgattctgttaatggtggatttattttatatgttgaaatttagtatttttatatagttaattttgtcagtcactttgtagtgaacttttccaacctcgaattttttcctctgtaaccgttcactgaggctggagtttggtttggatgacctcatccccaggcccagcgattgaccctagtcatacacccagcaaggtggctgactgggaactcaggcctaatctaactagcgggtggtattcgtgactattaagagatgggtgtataactagggcttttggcagtaagtggggaaagaggaactcctctaactggtgaggcatgcaggcctaaggacggagactctgtaggcgtgagggaagccatatggctgaagaagctagcatgtgcaagaagagggcagatttgagagaatggcagagaaatggaacaagactgatcaaatgagtctgattgtgaccttcctctgtactttggaattacatgagccattaaagtacttccttgtttaagctagttgagatttcctatttgtagcttgaaatatcctaacacttcatttttgctttatggttttctccttttttttttttttttttttttttgagccagagtcttgctctgtcgctcaggctggagtgcagcggcgcgatcttggctcagtgcagtctccatctcctggcttcaagccattctcctgcctcagcctcctgagtagctgggattacaggcgtgcgccaccacacctggtgaatttttgtatttttagtagagatggggtttcaccttgttggccaggctggtcttgaactcccgacctcaggtgatccactttggcctcccaaagtgttgggattacacgtgtgagccaccctgctcggcctatggttttgtttctttcttttttctttttttttttttaagagatgggggtctcactctgtccaccaggctggagtgcagtggtgcagtcatagctcgctgcaacctcaaactcttgggcttaagggattctcctgcctcagcctccttagtagctgggacttcagcacacactaccacacccagctaatttttaatttttttgtggagatagagtcccactatgttgttcaggcttgtcccgaacctctagcttaaagtgaacctcccacctcagactcccaaagcacagggattacaggtgtgaggtaccacacctggcctgctttatggttttttatatataaaacgtatcatgagaagttggatggaaattttatctgtatttcctcttactgatttgttcgtttcacaggtgtttgaatccttacatacagtgttttgtcctatggtgtgtgttagagatctgcctttactttttttcctaaacagtttcccatatgtattgaattatatccttcctattgatttgcaacatactccttaggaaactttaggctgttggtgaattttctgttttgttccactaatctgtctttaaatcactgtatcagtaaaaaattataaagtattatccttttgtaatatattttaatgttttcagggaaaatatccctcattattttcctgaagtttcatggccattacctcccctttattctttgggattaatttgggagttattttatgttttatgaaataacttcttggagttttgattagaagtttataaattttataaatgatgagagtgttgacttattttttgagatagattcactccatcccttttaatgtattttaggcataatatattattagtgctcttataaatgagagcttcattttcttatttttcaatttggggaaaatttttgagaacataactatggtaattattagaaaaataacctaggagtatcatatttacatattctctttaaatatattcaactttaaaaataactttatttttaaagttgcatattcagttatcacaaattttatgtgtatctataagtctttttgcatttgtgtgggcctttttctttgttcttgatcaatgttgctggaggtttattgattttattagactttccaaagaatcaaaggttttattgaattattgaatctttatttatttttgctcttttattatttccttgattctacctgattcatgtttatactgtcgttcctttcctaattgttaaatttgttgaatttgatgcttagcttgtttattttcagcctatattcttttatcatttgaacatttaaatgtgtacgtttttttctaatcacttgctgcttagttccaatatatggtgtttttattatttttcatgtatactttagctttatgatttcttctttaatcagtggattatttagaaatgtgtttttatgtgaaaaatgtcataatgttttttgaaatactgatttctaacttgattgcattgtgcttagaggacttgaggtgtattaaactgattgtttagaacttgttgagactgacttcatggtccagtatgtggtcacttttcataaatgtttcacatttgcataagcatatctattgttcaggctgggtgtggcagctcacacctgttgtaatcctagcactttgggaggctgaggagggcggatcacttgaggtcaggagttcgagaccatcctggccaacgtggcaaaaccccgtctctaccaaaaacataaaaattagccaggcctggtggtgtgtgcctgtagtcccagctacttgggaggctgaggcaggagaatcgattgaacccgggaggtagaggttgcagtgagccgatattgtgccactgcactccagcctgggtgacagggtgagactgtgtctcaaaaaaaaaaaaaaaaaaaaaaagaatatctattgtccaattggtggatacagggctctaaaaatatctgttaatcatattgtctaaattgtcaatatatttaatgattgtttttgctctgattagcaattagtgagatatgttaaaattacttcactaaggccaggcatggtggctcacgcctgtaatcccagcactttgggaggtcgaggtggggggatcatgaggtcaggagttcgagaccagcctgggcaacatagtgaaaccctatttctactaaaaatacaaaatttagctgggcatggtggcgtgtgcatgtagtcctagctactcaggaagttgaggcaggagaattgcttgaaactgggaggcagaggttgaagtgagccaagatcgtgccactgcactctggcttgggcatcagagcgagagtccatctcaaaaaaaaaaaaaaattttttttttcattaaatgagagacctctaattttctcctagttctttcaattttttctttatatgctttgaagctatgttattaggtactgtgataggcagaataatgccccctcacctgtccacgcccaaagtaaagatgtctacatcccaatcgtcagaacctgtgaatatgtccctttacatggcaaaggggaattaagatagcagaaggaattaagcttgctgatcatttcgttttcaaatacagagctaatcttggattatccaggtgggtccagtataatcacaagtccttaatgtgaaagaagtaggcagaagaagagtggtgtgacatgagaaggattcagcaggtcattgctggctgtgaagatggaagggggcgtgaaagctagcggtatcaacacagagtggctcatgtgaaaacctaaggaaatggagccgcgaggccatgaagaaggcgccctcgtgcacatatgctcatgtaggaactactggaagaacttccgtgttccggataagctgcctgcctcctgcacatacgctcatgtaggaactactggaagaacttccgtgttccagataagctgcctgcctcgtgcacatacgctcatgtaggaactaccggaagaacttcggtgttcccgataagctgcctgcccatggacacttgcctccttccagctcctgcaaccagagagctttgtctcaagacagctcatgtggacttctcattttttccttttaaaagcttctcttgtctcagcctgtttggatatacctatgggtctgccatagcgtgcatatggattgtagtcccctgctattcctgaataaactgttttggaaagccagtctctcgtttattttacgttgacaggggctatgagtcaaaggatgcagggagcctctagaagcttgaacaggtgaggaaatggattcatctctagagcttctggaaagaaaggcagctttgttggttgtagccagtgacgctggcatcggacttccagttagtgtttctctggtacatctttcttccttcttttaaccttctttctgttggtatccttgtgttttaagtgtgtctctggtaagcattatgtatgtgcattatgtatatagattttgaattttttacctattctgacaatacttgttttaaatcagagaatttcaaagagttatacttactatgattactaatacatttggaattatttgaattatttttaccattttattttgtcctttcactttttaaaactattttacttaaaaaattttaagaggcaatttaaaaagttgttttttgggcaataatcctttacagtaggtatttttattccactttgcagctgagaaaactaagacacagagggttaagtaacttgttcaagatcacacaattagtgtgtggcagaagctggacttgaactctgttcatctgactgtagtgactgcatatcatcctggtacagtttcgtttattgagtgtgatagatttaaaaaaggcagaattgtcagtcaaggatgtgccgatgtcttcgatgtactcctctagatatgccctctacacgctgttctgtgctcccagagtctgacctctttggactgttagtgagcctcctgcctggtggctaccaactgggtccagccagtgagaaacgagggcaaagaattaggtccaggtatttattctgacccttgaaccacccttccttcccacatacaagcccttcctgtgtacagggttacctcagggctcactgtgtcccttgggaaaggtcacggctcgtgtcagggaccctgtccactctgtcctctcagcatctagtttctgcttccctgctcttatgccttaaggcctaggggtgcaaacagcagttgtcatttgctccagggcatggcattatttggttttactaaactgtcctaccttttgtgaaattccctttattaaatgctttccaaattatccctgttgattgcacagtctgttttctgccaggactctgactgatacagtgagaaaggaatgcttaatcaaatcagccgtcctttatggaaataaattattaaagccctgcctcacatcaaaaagcaaagcttgaaaaaaatataataagggattaataatcaaaacatataaaaatgtcaaacatctattaaagaaaaaaggcaagccatgcaaaagtaaagttcagggacatatcctaccagacattgtaaagctataggaataaaatagggtaatactggtgtgtaaaaaacacatagttttacagtctattcatcgatcagataccttaaactacctacctactaacaacaattaaaaatattagaggagagatgtaaaaaactattgaaaatgtatttctgaccaggcaagagaagacggaattggcagggtgaaaaagggcaagccagactctagggagggcagcgagctcttagactgccttcaccgtctttctgaactcaagggccgggagtgtctgctttgatggctgcatgggactccggagataggcaataaagcccatggtttctacaaagtgggaagctccaagatttattgctgaataaatctggaaccctaaagtccgtaatgtaaaaggtgaatgagaaagaaatctctgcgcagaagagagaaggaaacaagccttaactcactggagtagcaaggaaagcgcttctctgagaattgatgaccaccagagggcctcccacaggtcttccctgcacattcctgctatcctactggggaggtccaaaacaacctccagcaaacaattcaacgtggtcttcaagtagttgtgtacccaggcaactggcaaaaacaaatacaactcctctctggaggaaagcagcttccacccaatattcaaggcattactgaaggcaacaaaacaggaaaacaggtaaaggattctcaggcaactcacaggacataaaatgtacatcttgattacgaaataatctgtgtaataagcttagaaaattgcctgacacgtaataagtgctaagtaaacgttagctatgatgatgctggtgacaacaatgatgatttcaagtctttttaattctctcctattaattgatttctcttgctttgttaaaatcacaccagtttaattaacacttgtcatattgtaaactttttaaaatgttcaaattttttcattgttctttttagaagttttcttacatattttatgtgagttttaggattggcttgtcaagttcctgaaaaatcatgtttgaattttgatgaggataggggttacctttatagattactttgttaaaaactgacatctttacagtattgagtcctagcatttctgaatagagtatatcttttagtttattcaggcttcttttatgtcctttagtcaagttttatagttgtcttcataaagatcttgccacctttttttagttttatacccacttttccatttatgttgctctttcctattaaatgcttaaattggctatattgaagatgtaagaaggctgttgagttttgtgttcaccttgtatgttttgcgcttgccaaaatcccttactttttctgattgcctctgattttctaggtgaataatcatattgtttgtaaattgtgataatcatttccttgtgaatatttctgtctctaaatttttatcttattgcaatccctgcaccactacaatgcgggattttaacaagtggaacagatatccttgttttcttcttcattttaatggatgcttctaatattttaccattaaatgtaatattttctctaaatttttgatatataccttttatcagaatttgctaagcatttttgttaggaatgggtgttcagtactattagatgatatttatttcagtctctgatagttacatgatgtttctcctttaatacatgactatagtaaattcattggaacatttcttttttctcctctttatcattaaaatgtttatatatacgttggataagctctacatggccataatacttgtctaacattttaaaatttatttttagtttttaactaatacataatagttggacatatttatggggtacatgtgatattttgatatacgcatatgatgtgtaataaatcagggtaattgggatatctgtcacctcaaacatttatcatttctgtgtgttggggatactccaaatattctcttgcagctatttaagaaatgccttacttcagtatatgtgaggggttgattccagggtcccctgtataaccaaaatcgaagcatgctccagtccacaggtggccctgccaaacccacggatacaaaatttcaccttctgtatccatgaattcacatccctccaatactgtacagttttgtaggatttgaactgcatgggtccatgtatacacacattttttttcaaccaaacatagatcgaaaatacatattcactggatgcgaaacctacatatatgggggctgacttgttgaatatgaggttccacaaggccgacttcgggacatgagtgtgtgaggatttcggtaaacatgagggtcctggaactagttccccatgtagaccgaggaacggctatattttcagtttggttggaaaaatatccttgtataagtggatcctggcagttcaaaccagagttgttcaaggattaactgtacaatagttaactatggtctcctgccagtgctgttgaacactagaacttattcctttcctctaactgtggttttgtatccataaccaacctcgcctcacactttcctctcccctgcccttcctagcctctgggaaacactgttgcactcactacctccacaagatcggttttttttagctcccacataggagtgagaacatgggatatttgtctttctgggcctgactttcgcttaatgtcctccagttataaacgtgttgctgcaaatgacagcatttcattttttcagtggctgaatagtattcctttgtggaagcataacatattttgtttgttcattcatctgttgatgagcatttagcttgattccatatcttggctattgtgaatggagctgtagtaaacgtgggactgcaggtcatctgtttgatagactaatttcctttcttttgggtatatacccagcagcggaattgctagatcatatggcagttctattttccatttctggaggaccctccatactgttttccataatagttctgccaatttacattctcaccaagaccgtatgaacattctttttctctgcatcctagccagcatttgttattttctgtctttttgataatagctatcatatctggggtgagatgaaatctcactgtggttttgatttgcgtttcttaatgactagtgatattgagcattttttccctagacgtggtggccatttgcaggtcttcttttgagaaatgtctcttcagatactttgcccatttaaaaatcagattatttgcttatttgcgattgagttgtttgagttcagtgctgggttccaccgtggcagggctaacacctagttccaatgccaagtcccacactcactttgctttccctaccccaagcataggtgttttccctccaggctgtgctgcctggggatgaggtaccagggtgtaggtaatgtgagactgtcttccctacccctttaaatgcatcttttcttgttaagctaaaaccaggtcctgtcatctcccatctgatttttagctgttatgaaaatgctttcttgtatggatagttgttcattttgatgtttgtgctgaggggatgatctttggagggttttttttttttttttttttttgagccatcttgctccacctttctctctggtaatttttaaactttatttaaaaatgttccatctatattcataagtgctattcccacgtaagtgtgttttcttattatatttatgaatccaactatggtggctttctaaaacatcttaggtttttaaaaaatcttattctttgtcccgttaggacagtttatataatattggttttatctattttttgaagatttgaaaaactcttcattaaaaccatctatgcctagtgcttttaggacactattaggacagtttatataatattggacagtttatataatattggttttatctattttttgaagatctgaaaaactcttcattaaaatcatctatgcttagtgcttttttcccccctgagttaaattattacctgtaattttgatttcttctatggttatttggtcttttgttttcttttttcttatgaaaattttagaacattcttctagtatctgttttgcttagcttttaatgttaattaaaattatatggagttaaattttaaatctttaatatctgaggttgttttcttttccatttctattgtactttatttggatcttctttcttttttcttagttagacttggcaaaacttagccagttttatgggtcatttcaaagaacctgggtttcaaatgtgctggtatttttgtttggttttctaattcatttctttttttatgtctaataatttattctactttcctgtttggttttgtttttacccccctaattttgtaagttataaactaagtttacttattttcaatctcttgtgttttctggtaaatgcattttatgctatgattttttctgaccctgctgtggctgtttcccagtctttattttgtgcgctttatttgttatgtatgtatgatgaaaatggaaatttttcttcagtttttttttcttcatcccaaagcacaagtaaggcgttaaatttcaataggtagatagatgtagagatagtagatttttagccacgttttaattttatcctattacatttattttaaaagatttggaagacttgtatttttttaatttgtaaatatatccttttgtcctaaaacttagataatttttgtgaacattccacatgtttgataagagggtgcattactctctgcctctcttaactgtcttattctctaccagtttatcttatataaatattaaaactattattacatgtgtaaaggttatatttgctttgctaagattgtattagctatctttttatggtctggaacagaggttggcaattttttcttgtaatgggccggatggcttctgtcaaaaccactcagctcgccattgtgttgtgaaagtcgccttacacaatatgtaaatgcaagtgcagctctgttccaataaaattttatttacaaaaacatgtggcaggctagaattggcccactggtcttagtgtgccagctcctggtcagcataagccttatgacactctgaaatttagatattaagtttatgtaatatcgtatatgtctgttaaccttttgggtagtaatttgttgaaaaacatacaactttacccattattttggtatttctggtattctcccttttgaatcactatggaaaatccttatttttctaaaccatcgtacttaacattaatgcttgtattctcaacaagcacaatattgtgaaaattggtttgggtcaggaggaggaaaaaaaaatcttagaaattgcaatggctgtgcatggtggctcattctggtaatcccagcactttaggaggccaaggtaaacagatcacctgagcccaggagttcgagaccagcttgggcaacgtggtgaagccctgttactacaaaacaaacaaacaaacacccaaaaaattagccaggcatggtagcttgcacctgtagtcccagctattcggaagactgaggtgggaggatcagttgatcccaggaaattgaggctgcagtgagctgtgatcatgcccctgcattgcagcctgggcaacagagcaagaccccatctcaaaaaaaaaaaaaaaaaaaaaagaaaaggaattacagtgtcttgtggctctccaaagctcagcccaacaaaatcataccttagcatttatttacaagcggagggtgttgagcaaggcaggttcctttgggggttgataatgaaaaataggtaaggtattcaagtttattaatgtaatgctcttttaagtgtttgtagcatctgtgtctgtggtattgttgctacacattttgcttactcctacttttgcaatttgtattttctgtaattcttattagactagaggcttgtttcccccacacctttcaaagaagtctcttggtctaatttttcagttcaactcttgtgcagattcatctctttaccttttatctttactttgccattgctgtgtgttttccgatgcctttaattgaatgactaatttgttttctgcctcccgttccctctgccactcctcctccccaattttatgctgtgtcttttcctctaattataaatctgggtttatttgcttttttcttttcttttctgtgctttctctttctttaacttctttttttgatatgcagcgtccttactgtcgttattttctaaagattttgtaattgcttgtttggcttctttgagacacgatttaatattagtggaggatttttaaaacatttcccttctttagctatttttggtttgtatttttgtcctgaatttcagtttttattgcattatcttcagaggctgtgatccttataattaatcttcttttgacttgaggcttagtttgtggcaacatatgtcatcaagttttctaagtcttccatgatcacaaaatgatagttgaagtcccttacaatgctcatcagctaggatgctttcagcttcaggtaatgaaaaaccaactgaaaatggcttgaatagaaagaacatttattatctacataagaagtcctggagtagggtaattttagaggttgttaactgggggcctcagtagcatcatcaaaaacctacattcaattcttccctactcaatctgacagcttggacttgtctcataggctggctgtcctcagggtctcaggatgacactcacatgagaggttgcatgtcccctttctagcacttctctctttcccttcattcctccctccgtgtgtgtgtgtgtgtgtgtgtgtgtgtgtgtcattcacagaagtttctcttagatccacagctctttcaatgagtggaatggtgttacatgtccattcttaaaccagtcgttgggaatgatatcaccaggggtagtagagtgcaatgttgattcatggcttgagggccagtccaggctagcgatacagagtgggtaatattctctccctgcagacatagcccctggacccaagtgaacagaatcagagttctcactgaatttaaggctaggggtgggtgcaggcaggtacagggaaggcagttaggcaggcaccagtagtatcatctgcacagttgaatactttattagccataacaatgtgcaaacaatccacacacttcatttgggatatttattccttcaggtgtaacttaagcatcttttttgactctaaacaattgagcgtattgtggaaattttccggtgatttttgtcttaaataagtaattgctgcagcgctgaaaattattactataaaattctactcctgttagtatatcagatatatatatttttaccattttctttataattcagaattttaggattttgagcagccagacattgtgttgtctttattgttcttccagcactgagtgctgaatttccagaaacgaatggtaataatgaaaggtgcatatctggagatagatggaagtgtaactcaagatgtgattagctacccagtttgtttttattaaaatgttatttttttctgcatatttgtaattcagggaaagtttctaatgtgaaaaataaagtagcttttcttaaggcaacgtataaaaaataattggtttaacagcattgtgtgaatacagatgagatggtcctattaaaatttgatcacaaagtatacatggtaaatgcagcaagattcatgctaactaattactatttcaagtttggagtaaaatgctgaattatgggatgctgtaatgtcactaatgagtcctgtcatggagaaatgatattgccaattacacataaaatagtcaaaggctaatacatttggagaattgtcaagatgggtttttttttcccctcgtgcttactggttatgtgtttgcatttttgttgagagaatacacagaaatgatctactgtcacttgctttcaagctggaattattctcttcatatttaggcgtaggtaccaattaagtgaaaagaaatctgtcttaagtgaaactatggactactagtatagtgtatcttgtagctgtttaatgttgtaactgctaggttctttactttgcatccaggtaatgtaatgtgaatgatggattattaagttcttttcataggaaataggcatattttaagttaatagtccttatcactgataccaattagccgaagagaaatgaattccctggatttacatttcttaatagttctttcaggattgctttgttacttttgaggaaggtgtatgaaatttggcctaggcactgtatccggtgtgaaataaatttatgcattcaataagtatttattgagtgcctgtgatatgccagtcattcctgtgttctgtatatcattttaaagattaccattcgttttcttctgatatttctttaaacatcttattttttgtgtcaagaacttaccatatagaattctgtgacttcccgccacttccatttagctttatatcaaggatagaattcagtatgaacacatgaagacctgcatgcttaaacagactaattgaaatggttgaatgggtaagaaaatgctcccttgaatccacatccttaaatgaggccaggcagacttggaggggtctgtgagcccctgagctcctgtcttacagtctcaggctattggagggggctgcacatcccacatttgggtagatgcccaaattctccttttagtatatactctcccttttcttgggtgttcttggaactctggtagaagacagggagaatgatagattttccttgccctccacagacacaggcaaactagtttctgttaggcattcactctgtgtaacattcatcccaattgcaatggtgatacagctaccgtcaacagactgatcaccttgcctgtgccatgtgccctgtgcacatttactctagtcttcacagtaacctccagagaggtgttatcccattttatagattacagccgaaaaaggttaaggaccttgtcactgaactgcccagtagaagttcaagcatatgctcatggaatttgattttacggaagtatgtaccctttagggatctacagttaggtgccctctagggtgtctagaattgctgaggagcccatcgttccttaagcacctgtgctgcgttgtattgtaatcacctgagggtgctttaaagactatgaataatactcagactttcttctccaaccatttacatcagagcatctgggggtggaacccaggcatcagtattttgcaaagttcccaaacgatgtcagtgtttagccaaatatgagacccactggtttagagctgtaaacagtgcagttgctactgttttatggtagatgttacagaaatatgtcgttgaattgcctataaaatgaattaaagattggagcatttctttttcccctattcataaaccattgtgatcgcagtcttctatagaaattacctattttgcctgatgagatttacttagaaagggaaataaacacatagctatatctctcctgaagtcttcttgcagttactaattaaggcagtacacacattctcagttgagctagaactttagctattgtctctttgctctactgaaggtaacccgagtgttacggctttttaaatgagctggaacaataaatacaaatttcgttggcaagacaaatactttttctcatatgccaacgattatgtaatcaaagtataaagtatccatataaagccttgcttttgaaaataatttcaatttaaaaattaaaaatagtaattaacattggtaacagtatattgatgaccactgtttagctgatacagtgaatacaggtgttcatataaaacatcatttaaaatcgtctatccatatggaacacattacgttttcttccaatttacattgacttcctgttggtttctgaatacaactcaaggtgttaatttcgttttcaaagccagatgttatttggcaggataaaacttaaatttcccctaatagatatttttaggcacttaggatgctagggaacttagtaagtgctttttaaaatctagagcattttcaaaatgctcctttctgttcagtctttcttctctgctaaaattgttatgtgctaggggagatttgtgaattttagagtaatatctttaagaagcctgacagagtagatcgagaccatcctggctaacacggtgaaaccccgtctctactaaaaatagaaaaaattagccaggcatggtggcaggcacctgtagtcccagctactcaggaggctgaggcaggagaatggcgtgaaccggcaaggtggagcttgcggtgagccgagatcacgccaccacactccaacctgggcgacagagcgagactccgtctcaaaaaaatacaaaaacaaaaacaacaaaaaaacctgacggatgtcagtgaaattgggggatactaaataaagagtggacagcagtggcggggcaacaagcagttcttcagtgttcctgttcctcagcgtagccaacttggtcctgtatctccacagttcacaggtaacaagtgccctgttgcttcctggttgactgatgctctctctgttacataacatccctgacaacctgttaagtttgtaattattgaacaaagtcccacctcattggcaataatggcaaacagaacgatgcagctgtttagcttgctcttgattgaacagaggacataagttggctgttagttgactaatgactaaaattttgataaagataagaaaacactaggcatttgagattcatgtaataagtagcttatgcatgtactgtattcaaagagaagatttattttatttttttatttttctattttttgagacggagtcttgctctctcgcccaggctggagtgcagtggcgtgatctctgctcactgcaaggtctgcctcccgggttcacaccattctcctgcctcagcctccccagtagctgggactacaggtgcccgccaccaagcctggctaatttttttgtatttttactagagacggagtttcaccgtgttagccaggatggtctcgatctcctgacctcataatcctcacacctcggcctcccaaagtactgagattacaggcgtcaaccaccatgcctggctgaagagaagatttagatatatgtctgtctgtccatccatctccctacccttcatctaactgtccattcaggacatttcttcacagctaaactctacctcagtttttaatctttaagtccagagctcagtccattgatttactgtattcatcagattttaatggatgcttatagttttgttctcaaagaaaattaaaaatattacttctagtgtggtgtgctgttctcactgcagagtactgtttgttttgtttttaatttacatatatttactaggaagtgcccacactgataaaacagtcagtagtaatcaagaaatgtgactttcttgcactattatttaactaaaggaaagcagaattatagaaaagaatgttaggaatgttatcttcatgagtcagggcttttgcaatgctaggccttctcactttcaatttctctcttgcaaggttaaaagaattattcttgtgttaactcacaattactgcatttgatcatcctttctcacttatgacatagcttctatgacttatggaacattggatttgctatagtagaccagtctgaatctgtctctacatggaatgaccagattgaattggcaccaaagttccactacaaatccttcatccagtcttccagtttgaattggaaatatcaattcaagcagctcacaagtcatcaaatgtttcagtggttttgtatagccagaacaggcagaagaatatgttcctgtatagacagttcattgaaacagtttattctgtattatacctaggtgagttttgaaaagtcagattttttttttaaggtaaactctgatctcatttatttagaagtcagacatgttccaagaacctagaggaaagcaaagtgaaacctccctcctccccactgccccaacattcaaaatagctattataaagccattttttatttcattaggaaaacttttaggagcttttattttgagtcagtgtttctattttatatatagttttaataacttttgttattttaatccagattaaagatagcaatttagagatgggtagagcaggtcattagaaatgatacgggtatcctacctggaacagagtgaagaaattttagtcttgggacatttagggtggtggcaaataactctgcagtgtaacagcgcttgaatacaatgatgacttgtaagggtatcaacattatgggaagacagtgttagaaattacagatttgtgaaagaattttttttgttttcattttctgagaaatagatatggggtgcacagtgatgttatgtatgaagtgtgggatgattgaattagctcattaacatattcatcaccttaagtacttagcatttattgttcctgtctaactgcaactaccaacccttcctcatctcccaacaattatgttttatatactctgttaaagaagtcagagaatatattgggaaaacactgaagtggttccaattttaacattgtgtttgagagcaaatgtttgttaagttttggctaattaggtcacctcattggttgattatgctgtgtaactgagggatttctacacacggtttatttgttaaaaacttaatgtgtataagaagtgatgtgaggatttctttacacttctgctcccatggtttcaaatgtgtctccttctctctatctgcaaccatgacctccctcttgagttacaagccattatttcttatgggttaacagttagtgcagctgttatctcctgtcagaaccataaacctggtgttgattccttcatctaatttcttcaatttgtctctctaaagtgctgttactctggggtattccctgtcttggttgatgacagatgccaccatccgtcagtctctgaagcttgaaactgcagtgtaacagcgcttttcttagttgcacatcctcctgatcatgcattgtcatgaatccctcagaactgtcatttcagcgaggcccctttctgttctgagctggaaagcataatggttctttttttttttttttttttttttgaagcggagtctcgctctgccacccaggctggagtgcagtgttgcaatctcggctcattgcagcctctgcctctcaggctcaggtgattctcctgcctcagcctcctgagtagctgggattacagcctgtgtgacgccacactggagtaatttttgtatttttagtagagatgaagttttgccatgttgcccaggcaagtcttgaacacccagcctcaagagatcctcccgcctcagcctcccaaagtgctgggattacaggcgtgagccactgctctgggctggaaaacttggctctgatgctgtccctgtgttcaggctctttgcaacattgatgaaattactcttcttaaaaacaaaagtaatgatgtcatgcttcccataaagactgtcaccaactactccgtgtggttcctgcgtcagtcttcagtgttagctccctccctgccctctccacatgccacgaggcgagacagcaagtgctcctttgtcctcgtggacccagttctaccacagctctctgcctttgcacgagctggtcccgtggcctgggtgctcctacaaaacgctagagccaggaagagagatgccagcggtctcctgagttaataccgtattctaacgaagatctgtttcacacttttcaaagcttcagttcacagattccagaagaattttgcatacaactagaacatacttatcttttctcagtggcccgtcactataacattaaataagatcttaattgtaaaacacacttaagtgatacactttttcccaggagagagctgataacggtctttaagagcttggaccctggagatgcgtagtgtggtcttgaattcctgctctggtgctgagcagctgtatgcctttaacttctctgtcactgctgcctcctcattgaaatgaggctagcagtgggacctgtctcgtgggatcgctggagggtcagataagttagcatatctgaggctcccaggatagtgtctggtgtggaagcatgtgtatgttttagctgctgttattatcattagtttcaattccctggcaatagcactgtttggagtctcactgtgtattatttaacagattctgaataaagccattttatcttctttttattctttatagatgataaataatgttcctacaactcgaggtatcacgctgtgtttttaactttttttttttttagcattactgaaagaagttgtatgtactttatcttattttgctccctaattataaaatacagggaaaatcatattcttttgcatgaacaaatgagctatttgaaacaggttgcttggtgaaagtgaaaatttaaaacaggattcaggtcaagtataatatattggtttacacttaacagagttcatagtgatttttatatgtctcctttctttttgatgaagaatgtctgtgttccgactactttacttctccgttcattttcatttgttacattctgaaagcataaaacgtgccattggttaatcaatttagtctagtggaggtacacaaattcaaggtaaatttggctaatttctcctgcaggctagaagataaaatcctttccccccaccacagttaggttagtagtgcttgacgtgatcagatgcctcttcagaggtcacctgatttaattgtggttgtgaagcagccaatccaaatccccatattttaatttctatccctccacattctcggcacagaataattaagagtatagtttttgcttatgtcatttatccagtgaaaaatgttcctaataaatacgtgacagttaaaattgttctagagaagaatgtttattaacagacaagacagtgcttattgccacagcatcattttaatctaagacttaactaaaaagagaaactctttttagttagaagaatgctccaacaaggctgttaccactcagcgaaggcaatggttactcttttattttttaaattggtttgcccctaaggtaggcattcccagggctaaaactgtgaaataaaatgtacgcaaggggactggtgcttatagatttgtgtgtataaatgtagtatttgtgggaaatgtcaagctatgtactcttctttaccttttattttctcctagatgatgtttatcagtctttttgtagctgtctgctgcagacatcattgcgtctttattatgaaagtgctatgtgtagctttccagtcattgctattcgagagtgagtttgtgaagcagcaggagagagatgattttgcaaattgcaatataataccatatatgatcttgtctcaacctgtaacacacacatcttcacagaaataacatttaattatggtaatatcctccctgatatcagacacagtatggcgcctgttaagattatattgtttgtagtaagatggagtaaaagaggtttaaaaatgaaagaataaaatcacataccttgataaaccccttagatgctatttaggccatggagagcttttgattttgtttcctttctttcttcccaaaataaaaacgcacacaataatttgacagacaaacactgtcacacactgtaaccccatctaatcccctcactgcacatcttaatccctgatggacttttctcagctatgtgggctatgaggttagggagtttctggatgtgatactttttccaaagtttcccagtgacagatgcagtgaccttatcacggagacagctttatgcagtttgacagttcagccatctggcttgtatcgattataattgatttaaagaaactaacactccaaaagttggccacttaaaaccctaaggctaaattggtctacatttaatttgaagtttcaaaactttattcttaaaactaatttgggcctctttgtaaaattcagccaacttcttttctgtgtggggttttggggtgaaaacactcaaagcctgccttgaaaaaagtcaacttttatgagaactaaagacgacatgtgtactcatagacatagattttatctcttcttagattttgctagagtttaaaacttaggtagacttcggttctaggacttcaaaaagtttagaaacttttaggctagtttctttatttaccagccttctagacgtgagctcattacctgaccttttagagtcttggttttctcatctataaaatgaatgatgatagtagctttctcattgcatttttgggagtattaaatgatacatgttaagtgcttaacacattgcctagtatattgtgggtaataaagatttattttactaatgattactgctacaaattagtagctaccattgatagctattacttcttcctttcttggttttccatctgtcggcttcctcttgttttcctccaatatcacagacacagttgcttagtcttgtatgtgtttcttcagctctctgcatatttgttaccggaatgtctcagaatgttgcctgtaggcctcatcttttttttttttttcccctttactccctccatatacattctcatccacaatcaagacttcagcatgttcttgtatgctgatgagttccacatggtcatttccaactgaagtctcttttttgggctcatctgaaaggcatttcttatcctgctacatgacactttaggggacccagtgggcataagggcaagtaagcatcaatttgggaatgaatactattgatctggcactaacttttattggttgattggtaagaatttgcagaaatctaaagtttaattaaaattttgttttatactttgtgttttaaaatctgatgttgcatatcacactgtaatacaaatgcattcagtaaagtgtgccctttctacaactcttgattttaatgtagttactggaattatttgtttggaaaaacctggctttctgaatagctgaaattttacgcatttcagcaataatggtgtccttaagatcgacatctttccggattcattttttgtattgatttaattcaacaatcatttgtgcaacagtaacttgcttacaatgccttctcaggcactaacttgctatattaaaatagaatttattaactgaccattccttaatgacttagccattttttgtgtgttttttttaattgtcagatgtatgccacataaagaaaagtattaaaaatgtgtagtatggtgtaaagaatagcaaagttgagctccaaactacccaacttcaggttaacaacattgccagtgtcttagaagccccatgtgttcctctctcattgtttccgtctctctcagcctcagaggtaaacacgtcaggtttgctagctcttctttatggactaaccaccccattgttgttttgcataaagcagtgtattgttgttttaaaaatggagtaacttgtatacccatcgctgtgtaagggcacggcagtgttgccactgcaggctactataagaagagaaacggagctgagtctgggtcatagccgggcctgtttttccctggagtttaccaaagccccttctgtggaagttagtggccaagggcaagaatgggtcctgggaaacacagggcttagcatagtccgaacaactaacagggctgttttgagggtcatgtgtcacatgtctgacagaagtatgtttgtaagttcactatgagtagatcaaagtgggccattatagggtgaaaggaatgtcctcagctgatagtgacatcaaggcagggctgggaattgacggagatagagtgggaactccattaacaggtgattaggacaagtagccataggagtcctggtcaggctcactggggtgtcttgtcttcaggttaaaaaggtggttgggtgggtgagtggggtttagggggggtctggtgacagccctcaacttgtctatcgagtcacattgccgaaatgtgggcctattctctctatatctgttgtttagctctgatcctgtgatcacatttctctgtgttttgaggattccatttgcttcttatttgtactgagtctcctttcttatatcccctattttctccttcttggactactcttgtgttagtggaacatgtcatctggtatcttaaaacgtcatgagaaatgcattctttgagatcttgtaaattcaaaaatgtagacattttttctaccctctttcttagatttactgggtagagaattcttggtgggaaataattttcctcacttatttgaaagtattgctccattgacttcttgcttccagtgttgctgttgagaagttaagagtcattctgctttctcattattcttatgtgatcttgctgtttttctctgattatttgtaagaatttctgttttctccagtgttttgaaatttcacaatgatacagctaattgtagatctcattttcctttgtgctcggtactcagtggattctttaaacttggaaacaaatttcttttatttctaagaaggcttctagagtcatttcattaatgacttcatcctttaattttttcctctcctttctttctaagactcctgtttggaagttttgcctcctatactagtcctctgtttttcatgttttttttcattttttattttttgacattttactttctgggagatttcattttccaactgatattattttcttctatcatgttaattattaagaattctttttcttcttgcagcatcctattcttatttaatagatgaagcattttttaatatctgataattttaatgatagattttttgaagttttctctgcatactttcttctttattactgttttgatttctaacttctctgttaaaggcttttcttagatgactgttcattgtatatgtgcttataatgcaaagtggcagactaaaacattgaaagtcttgagcatgcagattaaagatctgggcatattatttcattgcagggtgatctgcttgagctcttttcttggggtaacttttgtcagtatcttttcttagtatctttagagaattcctcttggactgattagattccttagggaagactccttcagttttctgcttggctattaactgtttttactattcttccctctgttttctccaacttgctctttccaacttgctatgggctagggaatcaggaaaaagaaaaaaaaaaactgatcaggacagtttcaaagtagaacagttaggttccgagtgacagcctaagggattggcctgtgcgtaaaatgctttaatgtgtggaatttatgacattgattttgatgacccaggagcatgtttttatttcgtgctcctgattatattgtggaaaggtgatttagtcatacaacagaattctaagtagatgaagtattaatgcaaactgttatagagtatttgtttttcttaatccatttcatttgatccactgtgtgtacttttccagttgattataaattgatttgttcattaatttgttctagttactggtccataattatcataatgtttttattttttgttgaagtatgtgcagtattttggactttttccagttatgatggactatcagtatgttctcacaagtaatgggacactgtattttacaaatatttattactcttgatgttctctaagattctgtattatgagctcttgttgatttacagacatttggaaatgtaactatttgattcttattcttggttaatgttttatcctcctagaccaaaggtgtttattctttagaactttatatgtttgttttaacagctggatttctagtgataggcaaacttttaacaaaaattccaattacatataagcttactgccatttgatttctataattaaaaatattaatattattagtggggtttagtcagtcactatattagacaaacgtgtgagttagaaattcaggtgtacacaaggattattaattggggcttcttcaaagaattttgacattagtaaaatttttcttttttttcaaaatgtttcaaagatttttttttaattaattaattaatttatttttagacaaagtcttgcttaaagtcttgctcttggccaccaggctggagtgcagtggcagaatctcggctcactgcaacctctgcctcctgggttcaagctattctcttgcctcagcctcccgagtaggtgggattacaggtgcctaccaccatgcctggctaatttttgtattttttgtagagatggggtttccctatgttggccaggctgatcttgaactcctgacctcaggtgatccaccgccttggcctcccaaagtgctgggattacaggcgtgaaccgccattcccagccaggatgatttatttttaatagcacccctaatgtatttaaagcatgattgcacatacaaaatttggatttacatacattttcagaactacccgttttgtgtaagtatacacttatattttttaattttaaaaatattaaaattttgacaattttatgtgttattggggtaccgtttggtattttgctatgtgtttacaatgtggaatgagtatatcaggctaattaacaacacatttcttacacgtgagagggctgttttttagaaatcagcttcagcttttgattttctgaatgaccttgagcaaattgttttcttgttctgtaacatacttttcttggccataaaattgagatgaagatgttaatgctgatctaaccaaatgattttgatattatagggattaatgaactgtttgtaaaatattttgttgttcttggaattacttacactggtgatgttattaatattatgtactatgttcacagtggactaatgatgccattgtattagctaatgttttagattacttttaattaaaattgtatggagacattggtgtgcttgctgcaatcttgtcctcctctgcaaatggcaagggagtattatcacaaaatatttaaattatacataaattcaaggtttttaagaatttgtcaactccctggaagaagaagaagtaagaaattactcattaagactcaggaatctcagcatccctatttggaagaattggattatttggcttatttataaatttcaaaatgatacattttcagctaatgatgattgaatcttgtcagacaccttacacaactgtgaacattccacaagttaagaaaacaacttcaggtggggtgtggtggctcatgcccataatctcaacaagttttgaggccaagcaggaggattgcttgagcccaggagtttgagaccagccgggcaatatagtgagaaccttcctctataaaaagttaaaaaattagccagttgtgatggtgttacttatagtcctagctactcagtaggctgaggtgggaggaacactagagaccaggggtttgaggctgcagtacgctatgaccatgccactgcactccagcctgggtgatagagccagaccttcatatcttaaaaaaacaaaacaaaatgcatttatagtaccattaataagaatgatatacttaagagtaaactttaaaaagttcaagactagtacactgaaaattttaaaatattgttaaatcgaagatgtaagtaaatggaaaggcgtgatgtgtttatggattggaagacttaataatgttaaaatatgtagataaaggcaaggcatggtggctcatgcccgtaatcctagcactttgggaggccgaggtgggcggatcacgaggtcaggagtttgagaccaacttgaccaacatggtgaaaccctgtctctactaaaaatacaaaaattagccgggcatggtggcacgtgcctgtagtctcagctactcgggaggctgaggcaggagaattgcttgaacccgggaggcagaggttgtagtgagccaagatcgcgccattgcactccagcctgggcaacagagcgagactccttctcaaaaaaaaaccaaaaaaattatatatatatatatgtgtgtgtgtgtgtgtgtgtgtgtgtgtgtagataaaacacaattcatatcaaaatcccagctggatgctgctgttgttgtcgttgttgttgttgttgttgttgttgttgcagaatttgaccagctgatcttaaaaccacacagtgataatacaagggacccagaatggccaaacagtattgaaaaagaagatcaaagttggaggactcatattttccaatttcaaacttactttaaagctactataatcaagatgctgtggtactggcataaagaaagacatatatgttggtggaatagaattgagaatctagaaatctttacatttaatagtcaattgattttccagaagaatgctattaagacggttaaactgggtaagaatagtcttgtcagcaaattgtgctgggacaactggatatctacaagaaaagaatgtttagatccctacctcacagcatatgcagaaattaactcaaagtgcattatagctaaaactatgaaactctcagaggaaaacattggagtaaatcttcattaccttgggttaggcagttgtttcttagacattacactaaaagcacaaacaacagaaggaaaaaaaaaaaaccatacttggctggtgggggatgtaaaatggtgcaaccactttggaaaacagcctggcagttcctgaaaatgttaaaatacaattaatatatgacctagcaattctactcctagttatgtacccaagaaaaatgaaaacataaatccctgcaaaaactagtttccaaatgtaatggagataggcagtcagtaaacaaaatatataaaatgcccagtggtgatacaactcctgatgtttcatttcattctttttctatatggtaagcccccttgactattagaaaaattgtacttaaaaaatatagcttgtacatacttcgtcagaataaagtaggaatgttacttttttcataatctcttttaggtcaattgaatattttaaaatatatctgtttttgttttgctaattaaacctatttttttttgatctagggtttacaatacacatctgtaatttattgttcaactgactgagactgggtttcactctgtcacccagtttagagtgcagttgcatgatgagaggtaactgcagcctcaaaccccttggctcaaggaatccaatcctcctgcctctgcctcccaagtagctaggactacaggtgcatgccacatctggccagtttttgaaatctttttgcagggatggggtctcactctgttgcttcagctggtctcaaactcctaggctcaagcaaacctcccacctaggcctcccatagtgctatggtgataggcatgagccactgcacttggcttattgtttatcttaatatatctcttcacataaaatatagtatgcttaaaatagtatatagttggcccttgaaaacatgggtttgaattgcatgggtccacttgtatgctgatttttttcaataaataaactcggccctctatgtctgtgaattctgcatccacaaccaaaagtggctcaaaaatacagtattcctgggatgcaaaacctgtagatgtggagaactgaccttttgagtatgcacattctgcagggacaactgcaggacttgagtatgcttggatttagtagccatgggaggtcctggaaccaatcccctttgaataccaagggaagactgttgcttttatttcttccttcctgccccttgtgcaattactgttatgcattttatatttatttttatgtttgttataagctctacaatacatttttatttttgctttttactgtcagttttctcttaaatttaaaaataagaaaaaaattcatttgtagacacccacatttaccattcatcatattctttatttctttttgtagatgcaagttttcatctgacaacactttctctttgccaaaagaacttcttgtagcttttcttgcagttcacatcttctgacaactagttctctcagattttgtttgcttgaaaaaaattttggtactatttttgaatgacattttcattgtatgtaggattccagggtgatagttttatttattttttcctgaactttgaagatgttcttctattgtcttctggcttatattgtgtctgatgaaaagtcagtaatcactcttacctattccctgtgtaagttgtattttttccctttgtttgcttctatttatcactagttatcaggaattttctttgttattattctcttttgggtttcgtcttttaaatatatggtttcatgctttcataaaatataatttgccaaatttttaacattgtattttcaaatgctttactctcttgactctgatgactctgatgtactttgatgacatgcatattatattatcatattatattgtttgctgttttccctttttactgagagtgtttatttcttacagtcttcctccccctgctccccaaccttcagtttatgtagctgctcttgtgttgtattcagattcactgatcttttcttctcctatatttatatgcatttaactatatccagggagtattccagttcaggtgttgtatttttcaactccagatgtttgattttttcctatactttatttaaatacattacatgtcttgtttttttttttaaataaacacacacatttattcatttgaattccttccttattaattccatcatctctatcattgctatatctgtttatatagtctaatttttctcttggttaagggctgcattttcctttagagggtatttgtttttatttttgtgggaagctaccttacaagtatgtcaacttagtctcttcaagccggggttttgagttttgtttggtgggtgaactgtgtattatcatatggtttgtttagccctaatcccggtacctggtcttctagggtgtctgctgaatgccctaggtgtttactgaagttccagtgggactctaatgtcttcaacactgtgtgtacttcagcatttacccagcttagttctctctagtagttgtcgttttttgtgttgtctcttgaaatctcaccctacacatgtgcagcgtagtattcagacaaaaaccaaggggacctgtatgcggatttctggacctctttctttgtagaactccttctgtttttgtattctcccttcaaattgctctgatctctgtgttgtcatgtaacaagaccattgtgcttttttggggtagccagtacctacagcatggtgcagtaaatgctcggaataatagtctagtgtcaggaaaccattgtttcccatattctgctttctggttgttgactgcaggaaggactgatctagtgctagttactccacagtggctgacagtcccctctgtattattatttaacctgttattttatagtccattaatgcagaaatgtttccatccttgctgtactctcatgtccacaacaaagcctgacacattctaagtggttagtagccatttactgagtgctgtatgcagtagattatctctccctttctcctgcatggtcaaatttttccttcagtgcgggactccctccaattagcattggaatatgtgttagtctccctttgtcttaaaccgccatatctggacctgcccttatctaattcccaacctgcttcagtgttgctttcatccagcagttccattgcaataatattcacaagtgttattgatgactcccctatggtttaaacctatctcggtcttaatctcacttgattcctggtggcatttgacactgctgactgtcctggaatcctcttttcccttactttcctgaccccatattttctacttattttccttctggctgtccctttgtctgtctggcttctgtttctctgaccaggcataaactgctactgatagtcagggtgttgtccattgtccttgttgttctacaaactgttgccttgtaatctcgtaattaccatccagaagctggtgttttctgaatatttttttttctggtttcagattcatgtggacagttggctgttgacttctctgtccctgaagctctcaaaagtatgccccaaattaagctaatcattactctttcctctctgacatcatcattcttcttcttcttcttctttttttttttttttttgagacagaatcttgccctgttgccctggctggagtgcagtggtgtgtgatcttggctcactgtaacctctacctcctcggttcaaacaattctcctgcctcagcctcctgagtagctgggattacagctgcccgccaccatgcctgactaattgttgtatttttagtagagatggggttttaccatgttggccaggctggtctcgaactcctgacctcaaatgatatacccgcctgggcctcccaaagtgttgggattacaggtgtgagccaccccgcccagccttacatcatcattcttgagattgcaatttagatagctctaatttcaagagacctttcctgattcttcaaagtgttctgtaccttttccatcttgacacttcgaaccctagtattgaaattgccttgtagtgcattggcattgccccaaacctgtttatttccctcactaggcgtgaaattctttgaaggcaggaatggctgctatcagtaggtgctcaataagtatttggggatggataaatgaaggaatgaatgatattataggaagtgagtattttattcagtgcaggatttagtttgtttttctgctcttaaaggataaacatatctgcactgttttaatagaatgttctagtaatatctgtggcagtgatggtgggtcatagcaggcaggcagcagttgtgaactcagcatatcagggcagcctaaggaaggtggggtgtgtgtgtgtgtgtgcgtgtgtgtgtgtgtatgtatgtacatgcgtgtgatactcagacacacagacatccatccatcttaaggtgtcagaatattaagtaagattaagttgtgttagacaatggagtcttacacagtgacttgacccccaggataccacttctgttacagatgcttggggaggggtcctctggtttttctgtttgtgctggatttctaatattcatgataggagcttctcaacctaatcctggagccggagctgcttgggtttgaatcccagctctgccaacatgtgacctcaggcaaataccgttacttttctgtgtgtgtttcctcagttgtaagacagggtaatgataatacacaccttcttagaggtaatgtctgtaaagcaattaaagggtgcctggcacgtgataattgctatgtaggggcttattaaatacaaccacaatgtttggggccgttgtgttacctccattttacagttcccaaagtgagacccaaatagctgagtgttacgaagtgtccctccagtagcagagctggtctgtctgtctctgggcccctcttcctcaactgtgcttacctgcatcttcactcaacacttaacctctgtttaatgtcacagggcaggctcagagagcagcagccagacatgggtgttttctaccttcggccctgcagaggatttctgtaagaaaagcagcatgacagagagagccccccaggacatacagaaaatgagtacttagagtctaaattatagagaatggaatgttaagtcagtggttctcagttcagactgcacgttagaatcacctagtgggcttttaaaatatacagatgccagggcttcaccccagactcattaaatgaaggtctccgagtcatgaataacatcggtgggtgggggccaaggactttccagagctccccaggtagttcagatatgcagccatggttgacaaccattgacttagaactgggagggggctcccttattctcttgttcctccagtgtttcctaagcgtcgaccttatcaaaagtaggtctgacagtgtgttcccagtgcctggacctggatattttttacttcagctttaattcaaaccattatgtgctgctagtcactgtggtgtgggagcagcagtgcacaaggtggtgaggaagccagcctgcctcaaggagtttaacatttcctaggaaagcagtgtctgaatacttagatgattctataactgacttgcacagacgttctgctgtcacagtaggtattactgaataatgtggctgctccaagttttttagttatgttccatgtagttgtgagtcactgccaaggcactcggtcttctaaagggtctctgaaaaatcactgacgtgaggcggattaataggcaaaaaggcatgggatttatttaatgtttgtacatgggagccctcagaatgaagacccaaaccccaaatgaggaacagaaacttctgtgcacttttgaggttacagaaagaatacaggctcagagaatggcccaagacaggttttagtggcaagacaagtaatgggagggaagaaggggggaggcttggctagcaaaggtggtcttattatacagatgaaacctcagagatagcagttctcagagagaacagatgatagatgtttcttttcagacgtttaaaggctgcagactctcagtctctcctacatccaagacaggcctggatacgttcatggagattctctgtagatgtaaattaccccaacaaaagatggcattccagaggtgtttctgtctgctggccctgcagccgccatttcaaaatatgtcaaattaaaatattttgatttccttccgtgggaagccatcagaacaagaagagatgagatcaaacagcaaagaattgccctggctgctgtcttgaagagtgtagggggacgagggtgaaaatggaggctgtcacagcagactagacaaatggtgacagtggcttgggccagggtggcaggggcatctttgagagtagagccagcaggattaggattccacggtctgagaaaggaaccaaggacgactccatgttacacttgtttctgctcaccatagtctgtgttaataggtgatttagaatttcatattttccttcttgggtacttacaagataatttagtacttctgaaaacttttctatagttagattatttttgctttctttttagatgcagaataatatctacctatttacgtgtgttgagattttgcatttgatttcagtgctaaagattttagataaagctccaattcaaaaataacctgaattcttggaagtttaaattacttaaagttcaataagttgattatttaggtcattttacttactttagtgctttacattaaaattttcctgtttaatgaacatttaactaattaggaaaatttattagtcaaattgtcagactctgttaaatggcttgtcaaaatgtttgtttagcagttattcctgtcttcttaacattgttgatctttctaaccctctagttcagttttttctgggtgattgtgttaagtggtagtatttaccaattattttaaaaatcctttattatgaaaataagtcactgtggacagttaaagcataaaaagtttaaagaagcaaaaaataagcatacaaaatcaaccattattttaccattcttaggcagccactgttttttttgttttttgtttttttttaactttttagagcaattttaggttcacagcaaaattgagtagctggtacactgatatctcgtatgtctcctgcccctgcacgtgcacagcctcctccatgatcaccatcccccaccggagtggtatgttgcaaccattgatgagcctgtattgacaccaggatcacctgaagtccatactttacattagaattcactcttgatattgtacattctctgggtgtgggtgaatttatgaggtgtgtattcatcatcacagtttcctacagagtcctttcactgcccttaaaatcctctgacctctgcatagttatctcttccctctaacccctggcaaccacacgtcttttaactgtctctgtagttttgccttttgcagaatgtcgtatcattgggatcatacagaatatagacttttcagactgataactttcacatagtaatatttattgtttcctccctgtgttttcatagctcatttgtttgataactcacttgttttcagtgctgagtaatattccattgtgtggctatatcaaagtttatgtattcacctaatgaagaatatcttggttgcttccaagttttcgcaattatgaataaaactggcataaacatctgtgtgcaggtttttgtatgtggaaataagttttccatttctttgggtgaataccaaggagtgtggatcatatggtacgggtatgtttcgttttgtaagaagccaccaggctgtcctcagaagtgactgtaacattttacatccccagcagcaatgactgagaattcccattgctccgcatcctctttaccatttggtgttgtctggattttggccattctagtgatatgttgttgttgatgaagtatctattaaggtctttggctcattttttaattggttgtttgaagcaactacttttaaaggtattatttccttcctgtctttttatttttatgcttttttatgtgagtggttgagatttggggtaaatattccatctgttttttttccatttaacgtcacgatgaaatctttttctgttttgttaaagtgcattatgtcattgtaacaggtatgtaattataatgagatttgacattcacctattcttagaaattttggttctttctacctttgcaaaattataaacaatattgccattgagatgattgtgcctgaaaacctcccctgtgttttgtgttgttttcttagagcatatcctagaagctaagtgactggtttggagaacagagacatttttgagggtctttaaacatattatgagattactttccaatgtttatattaataaaaatactagcagctaacagttactgagctctatgtctgtgacagacactagatttagtctttcagatgtttttcagttctcccagcaccactgtgggtggacttaggacagttcttgttttatgggtggagaaactgaagcctagaaagatggtaaaagtggccaataagagacagtaataatgacagagtcgaataaagagatatgctatatagaggaagactattttttaaatttcggttattctcaagttgatttacagtgttaacagagttccaaacaaaatcccttaattaaggtaaaatatagacgttaatatttatcaactttttggatgatgtttttaaatttcagtgcaatagaagaaatcatataagacacaaagaagaattaagactgatgtggccaacagatgaaggaatggcaaacaatataaagaaaatatccatatttaaattgttttaaattattagtgggcatttttattctatacagttcgtaatagttttaaaataatttcaacttttattttagattaaaggtatacatgtgcaaatttgttatgtgggtctgttgcgtgatcctgaggtttagggtacagatgagcccatcacccaggtagtgagtgtggtgcccagcaggttttataacttttcagtctagtcccacccacccttagtagtccccagtgtctgttgttcacatctttatatccatgtgtactcagtatctagctctcatttatacgtaaggatatgtggtatttgtttttctgttcttgcattaatttgcctaggatagtggcctctagctgcagccatcttgctgcaaaagacaagattttattctcttttatggctgtgtaatattccatggtgtgttcctaccatgttctctttattcagtccaccattgataggcacctaggttgattccatgtctgtactgttgtgatggaaaatattcatatttcagaagtaaggaaagaagagagggacgacaagacaggttatcagtgtttcagagcaaatgtctttagactgcctgtctcatggagtttgtatgtttttactctaaatctccagtctgatttttgtgtataggagatttacaatggacatttctgcattttagaagtagactatgttgtacagtctcctgttatttcttgggtgtgtctttatgtgtgaatttgtgttttctgttgatgaaacaagaaaaaatatatacttaaaacacccaaatatatctgtagataatttacatatcagttgatgaactattactgtttttgatagaaaatccatgtggcttaagcaagggaaaggtttgtttctctcttaaatgtagagaggtagatagtccagggttggtttggcggtcccacagccattaggacttgggcgtctttgtcagtcactgctcgccattcacctcgtgtgtctcgtcactgtcctaggtcagtgctctagtctgactatgatgcatttcagcatgcacgaaggaggagagtagtagatgaaaatgggcaggagtggaagggagcatatgcttagctgtcatttaaggaggtttctgaatattgccaagtagtacttagaccccgtctccttgaccagaactgtaggtacgtggaacaaggtacattgttttatgcccagctgaaaatcaggatttgtattactaaagagaaatgagagaatggatattgggcagtgtaacaatctttgccccatcacgcgtgcatgcgtgcatgcgtgcgctctctctctctttctctctttcactcatttaagtgtgacaagagcaaaagaaacatttctaatacaaatcagaacaataatcacttgggcccttttctctgctgaatgtaaagttttcataatgaggcattattaggcttggagggtgcctttggcactagagttcccttgacatcatccaagatattctgcgggtagaaggagcaggtgagagaagcggggaggctggtcttggtggggaggagacaagacctggaggtgcagtcaattctcattctgctgttttgagcaaccttctgaagaagagcagggctgtgcaactgaatactgactctgagcccattgtgaccctgctgagagaacacctctaggaggaaagagttctgtattttagaaaaagaagaaaattcgttcttcttttgttgtgtctatattaaattcagaaagaagtaaggctgaccagcaagacttgggagggcacaaattacatccttctgaattgctaagcacaggtccatgtgataggcacttagtaattactttaatgacagtgatgagatggtgctaaaactatcataatttctaactctgtaacttcatgaatgattttatttaaaaacacacactgtcctttttaatttatgcttacagttgtatttgtgatcaaatcaagtgttctctataatctagaatgtactcttaaaatagtagacttctcttatgctccaaaatttaaaactgaaggaacaagtaactttcgtgttttagtatttggaagtcatttcagaatcatataaggaggttagccaaagagaaatgttgatgtaaattttgctttgtacattttgtgccatttttcaactcgattttactgctgaaattacacatgcattatttaaaaatcccagtggtacagtctcaaagacataaatcaccttattttgatcagtttttgaagattgaaacaaaactaatgaaaaatattcttcactaatgaaaaatattcttcactatgtggaagagatttagctgaaatttttcgtttttgacctttgaaaatgttcatgtagtataattagggctttctgcacatgtcatttctttgctaattgttttatacttatagttcatcagatgagagctaaagtgttaaatcttcaatgcatgaagttgaaaatgtaagaaaattgtagaactcacctttgttcctgttctttaattcagaagatattttctttttttttttttggtatactcaaaaatatacatttgcatgtatataaacatatatacatgcacatacatttacacacctatataatgtataacatatagaggttatatattatgtgatatatacatagtatgtataccatcaatttataatacacatatatactatgtttacttatacatgcagctgtagatcataggatacacagacaaaccccaggaatggcagctacctatgtcataccatcctgctgggtgatgcttttcatattcttttaaccaacaactaacttttataatttgaattactttgtcacaggctaattattgaaagtataggtaatttttaggtgttctacttaaagagctattttttactgagtgtattttaaaaaattattatgaaatcttttatgaaactattctcctgattactaaatgaaatatttttagagcttccatgacctcttaaggaattcattttctggtgtgctactaacagtattttcacaaaatgctttaagcatacattaattaggttgtaatagtcttttggatgaattatgtgtttgtataaatgataatttggaaaagttcatggaagtctgatgtgaagaactctattgtttgacaacagtttgaaagatactgagtattagacatttttactttaaaagaaatggagacaaaatcattcaaaggaacgcactcacttaagaattcattaactgtaatagactttatcacccattatttggggacatgaaaaagtgctcatttcaagggtattaagtgccatgttgggtcagatctgcctgctgttctcagatgttgataaccagatactttatctttttggtgaggtgatgagtgtgtgtgccttttattgtgttatctcagaagattagggttataagcaaacattcctgatttttctctgtagtctgtattttatacattattcataaatgtatgaaaatcattactgaacctagttacatttttagtctgaaccatttctggaaggaatttcctaagctttctgaaaaaagtagcagcatgtggtgtgataggaagctgtattattaggtttataagagtgcccagtaattcacgcatgttcatcattatgtaaaaatttcagttattccctatttattattcattttgtagagcactaatgtttaatctgttttcatgttgaatgcatatcctcttaattattttagctgatttttgtctagtgtacttcatttcctcttgagctatacctttgtaaattctgtagagtattagagagagagatgcatcatggttctacagaacagaaactcaagtagtgttttgtgtttttactcctcttcctggcaatactcaacacttttgcttgcttcctgcaggaatgtattgacctgttgcattaggaaatagcccacaacgacttagggagccaggcacatatcacttttcatgacttgcagctcagagcctgtcccgcctagagtaaggtggaggtataattttggatgtgttgctgcaggttgtccatgttgatgcccaccattgttctgctaaggctttcagctgttctgtgttgtatcatctgttcgccttgaattgtattgccactagtgcttcctttttccagcacaggtaaagaattgcctgtgcatttcctctcctaggtcatcattacataagaccattttaatacctcacactatagttaaaattgctctttctggaaaacaaattcctttttattatggtatctttagcccattctcagtgactaagtcttttttctcagtttaatggtaattcatttgaagttttttgtgtttgtttttgtgacttctctctctttagtggagaagcttaccagaagtacttaaagagccaattaagttacagttttaggcccttattttgtcaaagcatttatttttcaaagtgttttagtaagatatttatagtttttatgtttgtttcccctagaagataagatgagcttatatagcatacccagtttgagtatgaggcaggaaaatacattgtttagaggtgaataatttattttgtactattctttctgcagataaaattagtaatatgtattaaaaattttaaagcatgagccttttctcttcaggacattgatctgggaaataattttatgaataatatctcaaaaacacaggcaacaaaagtaaaaataaatgggattatttcaaactcaaaagcttctgcacagcaaaggaaacaacagaatgaaaagacaacctacagaatgggagaacatatttgcaaactgttcatctcaaagggaactaatatccagaatgtactaggaacttaaacatctgaacagaaaaaaaaaagaaagattaaaaaatgagcaaatgatctgaacacacatttctcaaaataatacatatacatgagcaacaaatatatgaaaagtatgctcaacatcactaatcagggaaatgcaaataaaaaaccacaataagatatcatctcatcccagataggatggccattattaaaaagacaaaaaaaaacatgctggcaatgatacggagaaaagggaactcttacacactatgcaggaaagtaaactagtatggtcactatggagagcagagtggaagctcctccagcaatcccactactgggcatttatccagaggaaaggaaatcagtttatcaaagagatacctgcacttctgtgtttattgtagcactgttcacaatatacaagatatggaagtaacccatgtccaacaacagatgaatggataaaaaatgtgctatatatatgcaatggaatacgctattcagccataaaaaaaaaaaggaagtcctgtcatttgagacaacagggatggaactggagggcattatgtttcttgaaataagccaggaacagaaagttaaacaccacatatgttctcatatgcagaagctaaaaagaagttgatttcatagaagtcaaaagtagaacagagaataggagggttgaaggaagagtgggggatagggagagagttgttaaaggatatgaaactccagctagataggaagaatcagttcaagtcttccatagcactgtagggtggctatcattaacaatgattatggtttaaatatgtaggagggtattgactgttcccaacacaaagaagtgataaatgtttgagatgatgaattatgctaattacccattactatatattgtaatgtatcaaaacattactgtgtaccccatacatatatatgattattatgtgtcaaataaaaataaaagtgtgagccttgctacccaacaattacacttttggggatttgttgtatgaaataagagtaacaacaataatagtcaacatttctgtattgcttgctatgttttgggcatgatttaaagcatttgacatacatgtacttacctaactcattgaaatcctgtgagtaggtactgttataccagttttataaagaaattgaggcagagaagattaagtgatttgtccagttttagtctgtctctgttacatccagagatacgcataaaaaatatgtagaggattagtaattttaaatccatttatatttccacaatagaggttatcattaaataagaggagactcatataatagaattctatgaggagataaaaacggcaagtctagccttctgtaatgctaaacttataagaagtataattctattttagtaaaaaggatgttagtatacatatattgaatgcaaatattgtgtgtataaactagaaagccatgcaagagaatattaatagtactgatgaactctggatattgggattaggagtgattttatttgtgcatatgtttttctattttacagtgctttttcattgagcacattctgcatttgggaaagaaaggttatttaaagttgttcttattaaagttactgcatttaattctgtttttgccattgtgtcaggcaagtaaaaatgctagatatcaagttaccagaatcttctctggagcccttcctctgggggttacatgtatatgctgcctgtcttttggaatagtgatttgtaagtgacatggtttaagggtttggaccaacaggttcatagtttcaccctgctttcttttagagctgctggataaattctgtccggtttcaatgatttatctatatttaggttgtcaacctaggtaagaacatcctgtgcagctctctgtttgctctattgagtccttgtatggttatcttgttagtatagtgctaatgataacaggctgtgtgtaaaagctctctgtacacagctgtcgaactctgctgtgtttggtggtgcagactacaccctgaatcctgttaaagaaaacctttgagatcataacaggatgtttggaagttttaatataaatctcttacttatatcaaaagcagttgaagcaaatagtcttaaaatatagtagaattctaatgtatctgacctgcttccttaagaattcagtttggctatggtaatctctgcaatcttctccttaaataaaaactgaaacattaagtctgccccttttctttaatccctgttcaagagggtatgtcgatacttgaacccttttaccagcatttaaagaaccagctgctgctggcatagcatgtctgagattgcattttgtcctgcctacctttttattagaccttgcacagccatatttgtgagtggattagtttcctgtttttgccataataaattaccacaaattgaccagtttaaaacaacactcatttatcatttcccagttttgtaggtcataagtctaggtaaggtatggctgcactaagcctctgccctctcacaaggccaaaatcaaggtgctggtagggctgtctatgttcctttctggaatctctgaggatgagtcttcttccaaacttactagaattgcctgagttcagtttctttgattgtcggatggaagcctccatcttctgccagctcttggccaggggctggtctttgcccatgaggctgctcacatcccttcgtgttttccatgtgaccctgtccagcaagagcagcttgagagccattcaagggaatcttttacttcccttctgctacatctttctgctttaagagatcatgtgattagattggggccagccaagtaatccagagtaagctccctactacatttgaaagtaccttttgctttgtaaagtaacagattcatgggttccagggatccggaacatggacatcttttgggggccactctgcctaccacagtgagcctgttctcatgtatacaaacatactctttctatctgtttagcactacagtggatacccagaccataagcgtcatagtcctgacacacgagttggtaaaaaactaactgggaacttgtgataagcacttatgttagtgttttaggagtttaaaggaaagaaaaattagtgaagatggaaaatagcaaaggccttatagaggaggaagcacgtgaatttcgcccttgaagactactgtggattcgatagtctaatgattgaggagttacagaagtgggggaagaacttgatcaacttgaacaaataggatgtaggattgggcctgatgtgtttaatgtgatagcagagaggcgatattaattaggaggaagtagtaaggaataaaatatacagttgtacaaggtttggagaggcatgcagtggaatttcaatttgaattcctgaaaagggattttagttcaccaagatttgagcgagatagtaatataggaaataagtgtttcataaagatgagtctgggagtgatctgcaggacagagagaaggtggagaagatggagttagccaggtgagcatacgatatggggtttgggccaccacaatcaggcatcttcttatttagatcatcttaaatcttgacttcataggattgttaccatttcaaaacataggctttaagtgactacttcattaactccttcattcaccttactatctttggttttattgtatacaataacttttttttttgaggccctggtgttaatcagaatgatgcatctttctcctctgtcaggctttcagtgcttcacatacttttcagatagtcttcagaactccttcaggacagagagaactgcttttcctatatgaatatagagagagctaaaaattcagaaatttgaagtgattatatgaggatcacccagcatgtcagtgtctccagtagaagtgaaattccagtctttaattcggagacaatgcccaatcactgtggctactcttagaaacaatttaagagaatcttcagacccacagcttaaaataactcacgtacatggcataaaataaatacttgggagttccttggatgcagggtgtttgtcttgattatcttgggtgccccttcagcttattatgggtcctggctcatagaaggagccctgatatgtttattaaatcagggattgatgattgggaccacctgggctgacctttgaacgacttcttacttcctatagtcttcaaaactgccagaggctggggggatagttgacaaaccgggggacgtgctatcctaatctgcagaggtgctatcctaaatcactgaccaattccagctttaaggttcacagaaccttttgaaaaacatgatctggttttaaaattgtttccgtgttgatccattttgatggggggtgaggttcgctattcacatcagtgagtatggccagcctttgtctgcggagatctgattagtttgttaaattcaaagtagcattttagacatgatttcagtaaaggttaggggcactctttggctcttaaattttaatagttttataaaaaccctcttcaagacaaagttgtaatttaatacaaaatcgtaaattggtaaacctgtaacatttgtatcatgaaacaggtgatgtaactgaagattaaataaatgtaaaaaatttagatattgcttttgaattggaaatggcaatatttgtatatttttgacaaagcttgaaggagcaaaatctcatgataaacactatatgcaattgacctgaatgatgtaatgttaaagagccactgcagaagcatttgcaaatcataaattaaagagctctttctcaattaacagttacagatgtcttctcagtgcagggaagtgtgctagggactgcatcctagagatacagtctgtgctggcatagggcttctaacctagtggaggtgacacagatacaggatgtagtttccaaagtagtctaccacgggtccagcgagagcatgcaaacattattaacacagggtaagttaccactgagtgctagattagtggattaaaatgacctttctacccctctctgcctggtgaacggctgctaatctttcaatgttagctaaagctcctaagactcctgtagacggtctttttcgaccccatacagcctttattctctgcggtactcaatgtgcgctgctttccaagcatttgtgatacctcaatgggcatagtctaccagaatgagtgcaggatggggaagtctgggactcccagcctcccagagcacaagaaaaacttgtaactgtcagaaatcagaattaatcgattaataatagcaaatattaagtaacaaatattaaggttaattttttaaatattctaccagccaatttagtctctttgttctaatttcatcttcaccaagcagtcttatggttgtacatttggttttctacccccttatgtggcaaaaatattgctgtgattgtggttatagcccctgctgtcagcttgagacttgatgtctgtacattctcctttgagtctggatccttgatcctggcctgtgattccatctcaggagttagaagcctgtggtgcctggcctgagtcagctcattagcttcattgacaacattggttcgttcaacaaatattgcctgagaagaagacatttaagcaaagacctgcaggaaggaagggagttaactaagtggatatgtggggcaagaacttcccagaatgaagaaacacccgcattaattgcttgaggtatgagaggtgaggtcaggggcaccagtttgtatagggctttctaaaacattatttggagtcagatgacaagctatagaggatgctgagtcaaggtggaaacaacaaaatcctacttaggttttaacaaaattactgtggttgcggtgttgagaatagtgagatggtggcaaggatggaagcggggagatcaattagggggctgtttaaatgatccaaacaaaagataatgaggtaattggatcaggtgatagcagtacagatggcaggaagtataggattggggaatatattttaaaggctatgccaaacaggccttactgacagatgggttatggagtgtgtgtgtgtatgtgcgcgctcatgtacacttgtacatgtacctgtaaataaaggagagaaagaacagacaaaggataaccccaacgtttttagttgagaaattgtgttttcacacacactgagatggggaaactgagagcagcatgtttgatagtcaacgttaggagctcacctttagacatgttcactttgagaagtctgttaggtagccagaaggaactgttgcacaggcatttcgatgtacaaatctggagttatactctgtagaggtccagattagaaaaaaaattggagggtcatcaatctaacaaaaggtttaaaaactgtgggaatgtactgggtgcagtgagtcacatctgtaatcccagcagaaatgaagatcatgctgtaagagagtgggattacaattgacctccccatgtctcaggttccacatgcacagattcaaccaattgtggatcagaaataggtggaaaaaaaccaatacaacaatagaaataatacaagtaaaaaaatataactatttacgtagcatttacactgtattaggtactataagtaacccagtgatgattggaagtgtacaggaggatgtgcatgggttatttgtaaatactatgccatttcctatctgggacttgagcatctgaggttttgggtattcttggtgggccctggaaccaatgcccgtggatcccaagggatgactgtatgcctgtacgtgatgatgggcctctctccatgaatttaagtcaccaggactgggtttggggagtgtcagctcattttctgcctgtttatcagcagacacagatggggtagttttctcacttgcacctacggaaaatcctccttgctcctggggttgtttgactcagtgtctcccttttcttgtgtctgggaggttgatggcatagtacatttactccccaagtagtctgtgagtgtggttggttaaggtggctgaactgaactcggcatctcccagcaccaccaacctggaaagtgtttttggtaggtgctgtgtgtacaacatccttctgattgcaaaggcctgtactctagcattaggtcgggttaattcctgtcaggtcttttttttctcttagagccccatttctaatgaagggattaatttggcaggtgatatcaacttgcaagccaaatttagagttgattttccaaatgacttctcccaaatgccctattatttcctgtctccattgtaaaatatttcttcttcctggaattctctaactccctcttctttgagaaataaaaaaatatcaattttagtgtaataatttgtcttatttaattttgttacttaaatatcattcacattttaccaagcacttaaaatttggataggaatagagattgagataatatagctctactctcaggtaattcacattgtgggccaggcgccgtggctcacacctgtaatcttagcactttgggaggctgaggcaggtggaatcacctgaggtcgggagtttgagaccagcctaaccaacatgcagaaaccctgtctctactaaaaatacaaaattagcggggtgtgatggtgcatgccggtaatcccagctattcaggagctgaggcaggagaattgcttgaacccaggaggtggaggttgctgtgagccgagatcgcatcactgaactccagcctgggagacagagcgagactccgtcgcaaaaaaagaaaaaaaaaaatcacactgtgacctttataggatatctttttactgtccagttttacatataatttaccatggattttttaattaggatacctattttattgtaatctggcaatatttttcacatattggagataatttttgaagtcagttctttgtctatgatatattataacttccatttaataatcattggttttagattggaattgtgtcagctccctttctataacatatagtttccatgtataaagtaatctgagtatatatcttatgtgtgagtgtgtctctgaatttttttcattgcagatagtttggtggaattctatttttagttatgttttttctccatcactttgcttgggaacgctggatgaagtggttactttcatttctctttttcaccatcatgattgtttcctgcagtcccatttatttttgtcaagtttttcttcatgccatcaatctgtctcatttgtgtatctgttctgtttctttttcttttttcacagctgcgaagagccatggatggtcttttatttggttggttttcattcctgatgcatatacaaaccactagagtatgcatttttgaatcttatatatatcttccagatttagctttatattatgaagatatttgtcatttgggcagctgagaaaggctttttccttgagacactctctgcttaccttttataatgttcagacaggaggttgtcagttaacttgctataaatctaccttcagcttcagtgtgatataattatataagttctattattaatgatgcatttctggtttggtctgctcttgatagtgctagtggtcaccagccctgctattttggcatttatagtgagcacatatcttctgataattatatttctcttttataaaatgttttatatacacatttcttttaatgtgtcagcatagcaaatattttccaaatgtccacaacgtctgaggcattgttgtaagcaatgggaatgctatggtaaataagatgccatatacaaattacattctagtgtgggagagagacagcaagtaagaaagacacttgatagagctgcagagtgttgagtactgtgaagaacacgaagcgcgatgtgaacgtggagatgaaggcatgtgctgtggtcatggaaggccttttgggggaagtgactttcaagcagagacctgattgatatgatgccatgaagggcagtttagggaagggagcagcaagtcaagaggccctgaggctggagtgtctcagggccagcaagaaggtcagagtgcctggatgatagttggctagtgggtgagtggtaggagttgaggctggatcatagccagttagagggtgagtggtaggagatgaggttggatgatagtcagctagggggtgagtggtgggaggtgaggttggagggatagccggttagcaggtgagtggtgggaggtgaggctggatgatagccaactagggggtgagtggtaggaggtaaggttggatgatagctagggggtgagtagtggtaggtgaggttggatcatagccagctagagggtgaatgttaggaggtaaggttggatgatagtcagctagggggtgagtggtgggaggtgaggctggatgatagtcagctagagagtgaatggtaggaggtaaggttggatcatggccagctagggggtgaatggtaggaggtaaagttggatgatagctagcgggtgagtggtgggaggtgaggctgggtgtcagttagctaggggttgagtggtgggaagtaatgttggatgatagtcagctaggggttgagtggtgggaggtgaggttggatcatagccagctagggggtgaagggtaggaggtaaggttggatcatagccagctacggggtgaatggtaggaggtaaggttggatgacagtcagctagggggtgagtggtgggaggtgaggctgggtgtcagttagctagggggtgggtggtgggaggtaatgttggatgatattcagctagggggtgagtggtaggaggtgaggttggatcatagccagctagggggtgaatggtaggaggtaaggttggatgatcgtcagctgggggttgagtggtgggaggtgaggctgggtgtcagctagggggtgagtggtgggaggtgagcctggaaaggtagcagaagtgatccaggatcctaaggtgtgagaaagtgcttagattttattgattttcttttaggcataagagaaggccatggaggattttgagtagggttgggctgtaagcgtgtttgcatttatttacaaaaagattactctccttgctgtctggagaatcaaccataggattgcaagagagatcacgtaggagattctcataacaatctttgtaagtgatgaaggcagcttggattgtaggatcaccctgaaaatggtgagaagtggcagggcttgggttttattttgaaggcgtaatacacaggacttgataatggattagatctgcagaatgagggaaagaggtgaacctacattttgccctgagcaatggggtgaattgtgctatttatgaaaaagtggaagactcagagagagaggtaggtttggggctgaaaatgagccccatttgggctttttatgggctcttcctgatctccttctctccccttgcttttgaggtattaccagctacaggggctgaagaaggagcaatcaggccagggtttaaaggggcactgggactgagccagggaggtagctagcatgagtggtaagttgtttacatgcaggggattgaacaaataagtaaatatattgagggtaaagggaactaggtttatcatcaacagataagggatttataaatgtggaaaggggaaagattaaaaagaaccttgaggtgttagactagaattggaagtattaatgtaaacacatggttttggaaacatgtatatataggtgataatatagagacacactcatatacacacccagaaggcctaggagcagtcaatcacttatcagcagtgagtttgccaactgcctagattctggtttgtaaattccatcctctactaaaagggaagggaaccaaggctccttgaaggaatagttaattccaggataagtacaaaatgaccttggaaaactatctgtgctagaaagtaaggaaacactcagaatgatgggagcctttcaagttacaggtcccagcttgaagggactctcactggccaaattttggacaatttgagcaagagagtaaatgatggcgatggatatacattaaataaatgggagagaagcaaagtttgttgttgttgttgttgttgttgtttacggtagaatggctgaggaaggaaggagtaatggagtgaaaaaaatcaccatttggcaaccactgtggtggtggttggttcaagtggtagttattaatagacactaacgttggtgtgaggatgtttgatgagaaacagaatattgatgtagtcttgagatatctcccccaaaacatgtattaattacagagggagagctggtgaccaggtggtcgaggggtgggctatgctcacatcacgtgcctcccaaggagaaatactgagatgggcaccgcatccttgctgacaaaattgtattcctgacgacatcccagcctgagtctgggtacgagaaaacactgacagactctggttaggggacgtggcagagagggacaggcctgaactcttactattatgtgataagtacctttgtggatacaagtctgtatttaagagtattccttagaatagagttctaagaatgtagtaactagatcaaagaacaagaaattttaaagactctcaaaaagtataatcaaattatgtccctaaacctagcaccaatttatatccacactagtcatacataaaaaggacccattatattagctcaaaatagcagtgagtttatttgcacacattttaaaataaagatacaataaaccatagagccttagaaacgacccatttcaacttgcctgagagtaggaattagatatttctgatgcaagaatatcatctgtggtatccttcacagatgttcctcccaccccccgcataaacattttcaatgaaagtttatggattttatgtgtttcatggtggctaaatgattattaaaattttagggcttcccaaattactaaaggaaaatttgtcttttgtaatgttattaacctgtgcaataacctacagaaaacatctactgataatgggttctcaaaatgtaaggagttgatagaacttaaaaattcactcatgctttgtaaaagaaaaatatattgatagaatgaacaacagaaggagtaaatagcatttctgttgtttatttgtgataacattaaaaatactttcacatagataggcatgtgaaatatattatgtattaatatttcagaattattgtgaatatgaagttagcttatgtacataaataaggaaaatgtaggccaaggtagctaaatgcaaacacagaatatcagcattcatttacctcaggagaagttactagtgagtctttgaatttcatctgtgaaacaatttgtgtgataacatattttctgaaagaattaatcacttatttccctatgcataaaaacattgtccacaagtatccataggtcaagtctaaatatcattaaaatttgatttgcagtgagaagtctttatcgtatagttgataacgtctgttgaattttcattgatttggaaatgatgtggcttgtgtttggaattaagctattagaatattctgtcactataactctgcttcatataccagtgaagaaatcatcattcatttaagagtctaacaagatttgactaatatgaactctgctttgaattttggacatgttcctgattgtcacaccagaataccaccctcaaactacatagggtttgcagttgatcttcagtgtggaacttttgataagttcacgtttttacttgatcacatcgagcatatttggggttgatctttatctgtacgctatgctaatgcttaacataagtcctttatttacccttggttttgtattgaaatgttcacgcttatttcgacttaggttatttagtagtaagaaatatgacagacattatcttcatttgaaaaataagcatttgaaaatttaaattttttattttcttaaattttgcatattgaatttagctaccatgtcctttggactttttcactgagaccccagttttcccagccatattccgagtccagcccagtagagaatgtagtttggttagaacatagtgtgtaagtaattaaatttgtgccactacctaagtatgtctcagatagtcaaaaataagtgatacaatgtattcattatttgctatcagccatactattttctcccacattagtgtaggttattgattccattatctatttttgtcgcctcacctaggtaatgacaataaagtgatacatgggagagtttattcttagaaaaggaatgattttgggttactatttatgatgcttatctgaacaatgtaaagtgttacagagtcatattttaaatatacaaagagttcataaggaatactttgcggttcaggtaaaaataagctgtctagaaattaagtaggcttttgttttaaacttgattcatttatttgtactaaagtagcaggttcagtaacacaccatttatctggtcattttccagaataagatggaattttccaggtaactgatcataaattagttttccaggtaactgaatcttaaacttcaaggactgaaatcctataaatttaactattgttgatggaaatttttgtagaacatactttctaccttcttacttttctgtatcttttcaatcagaggatactcaataaaatttgatctgttttctggctcaggactactgttttttccacctccagtacctcttctttctcccttaatgagtttgctttttattcccagtggcttgtgaacccaaagttgttaggaattgttgtttctggtaagccaggatccagggaggctcagagtgagggtgtagggaagaaagagtattctttaatgttggtcttttttattagttgttatcaggcattcacatcttcccactttggttctggctttggcgctttgctctggaaggctgcttaatgggaggtcactgactcctggtacgttaggtctcacctggtagctttgcctcctcttcatggtggagtaaattgagccctgagagtatcatgggaatcactcaagctcacacacactaagtagtgatggaaccctgggtttaagacccaagtcttctgtctgcaagtctagtgttttcctactataactgtcatgttaactccaggtcattattaggaacatagttagtagtcttgataaataaagaaggctctgttatttcttagtgggattcttgcctctcactttcttacctatgttggaaactagagtcatcctagactcctctgcactctgcattcgaagggtgactaaagccttgtctagtttacagcctatgcagcctctagcatcttacctcctctgcgttcttgtcacatggccctctttcaggctcttttcgtctttagccctctttccctccttgttctcctccctgcctctggactcattgtcaaacacaccatgcatcggcactcagaaaaaagtagcaaaaacatggtagtggagaggagagactgtacaaacatgaacagctgaagggcagagaataagtaccaatgagtagaaaaatcaaaacagtccaattattctatcaaattatacatgtattagatcagaaagaaaatgattccagcactgtagccaacctaaaccatgtgattcaggtggagtttggtacagtgcaaaccttgagtgcatgtggtgtgtaacagagacatctctcttaccactctctgaagattaatgtcactcctgataagactctgattagaatcctatttccaacatgtggtgatgctaagtaaacagtactgacaaggctgaaggatgtgagctctactaagtgaattgaaaagttggataaaaagactcgctgataaagatgagaggacactgattactcatgaaaaggaaagaccaagggaggacttccatttgacttcaaaataacatgaattttattattctgatagtgccaccaaaataaatcctatgtattctccaggcagtaagggcttatgttataggcattgttttaaatgtaaatatttttatcaaccgaatatatttaagatgtgaaatcagttatccctataagtctgtaatgaaaaatggcagtactgggtactctgtttatccttaaaatttagaaattcatgttctgagaagtttttttggtattatttctttgataactttcttctctttttgtcttttatctcttttaagaactcttgctagtttcctgttgaatttgctggattgatcttcctgttttcatctatttttctttcatccatctctttggctgcttcccccgccccccattccttgtttcacgataattttttcttagttatgtgaatatattcaatatatttccttttgctttctttgttgcctgtttcatcttccatttattaaaaaaactgttattttcttgtaaaaacccttaacatgagatctaccctcttagcagattttttaaggtgtacaatacagtattgtgaatataggcacaatgctgtatagcagatctctggaacttgctcatattgctttattggaactttttaccttttgattagcaaatccctgcatttggcctccctgcccgacattgttctgttctctgcttctatgagtttcactattttaggaagctcattgaagtgaaatcatgcagtatttgttctctttgaccaggttatttatctccctgagcataagtctcaaccatcttgtcacatattgcaggatttcgctcttttttttaagttaatattccattatatgtatatactacattttctttacccattcatctgtcaccaggcatttaggtgcttctgtgtcttggctattgtggataatgctgcagtgaacatgggagtacagatgtctctttgacttctcagttcctttgggtacatatctggaagtgagattgctggatcatatagtaattatatttttaattttttgagaaacctccataccattttccataacggttgtacagttttgcattcctagaaacaatatatagcattcaaatttctccacatcctccccagcacttgtctttttttttggtggtcccatcccaacaggtgtgaggtggtgttgcactgtggcttagctttgcatgttactgcttccttttttatttctctcggtctctgcctttcacactagaggctttcctcggttgtttgtgatacaggtgttaagaaattacttaggtagatagtgagggtatggaagtcctcagtaaggttttccatttaatgaaaagcagccccaaatcattttcctttctaacagaaaaatctgtgaaatcaagctggaaatagatgccggcagttgtgccaatcatgttcaaaatggtggccccatcttcccttctctttatcagccacgtgtacatgtacagtaaggagcagacaagacagcgccagtcagtggacagctcatttgcataataagattagggtggggtggccagccttccccgtgggctgtgtaaatgtcatgcagtggctcactcctgtaatcccagcactttgggaggccaaggtgggcggatcacctgaggtcaggagttcgagaccagcctggccaacatggtgaaaccccgtctctacttaaaaatacaaaaaattagctgggcatggtgatacgcacctgtaatcccagctactcaggagactgaggcaggagaattgcttgaacccaggaggcggaggttggagtgagccaagatcacatcattgcactccaagagtgagactttgtctccaaaaaaataataaataaagaaaaagaaaactgttaggctataaagagtccctttgtttatctgttagcttaatttaaaagtaaaacatatactattctaattacatgcattaatgttgaatgttaccttcaaaagtttatagctcttatccctaatgccaacaacatctgattactttgcaccatatggctgcagtgtggtgtatggaaagaaagctggctggggacccagccaggctcagtcatactattctttagtagtgtgaccttatgcaggcttcttaacttctttgcttgaaagttttctcagctgtaaagcgcgggccttctataacatggtcccttagcatccttatatttgtaatattccctcattgtatgagaaactatgtctatattggtcgttctttttcagttagtaatcagatgttttctgtgtatgtatatgcgtgtctacatacacagcgtggttgaaaatacataaatacatgtagttaaaacaccacccccactcaaaatagatttaggctatatttgctaatggatcctcataagttcttgcagatattctcatccatgtgtcaatatttgcacataaatcattatccaggcactatatcattttttctcacatcttagaaatgcttttatgtaaacatattcctgaacatatttattactagtcaatatctagtactataatttataaattaataagaaatttaagtttttatttttttatctttttttaaaatctaattccccccctgcatgtttgacttgtgctggcagaataatttttttttttcttagacggagtctcactctgtcgcccaggctggagtgcagtggtgcgatctcggctcactgcaagctccgcctcctgggtccacaccattctccagcctgagcctcccaagtagctgtgactacaggcgcccgccaccacacccagctaattttttttttgtgtgtgtgtttttactagagacggggttgcaccatgttagccaggatggtctcgatctcctgaccttgtgatctgcctgcctcagcctcccaaagtgttgggattataggtgtgaactgctgcacccggccactagcagaataattttttaaaaaatctatgcatggggctcgttggctcatgcctgtaatcttagcacttgtggaggccaaggtgggcagatcacttgaggccaggagttgagaccagcctggccaacttggcgaaaccctgtttctacttaaaacaaaacaaaaaaaccccacaaaaattagccaggcatggtggctcacccctgtgatcccagctacttgggaggctgaggcacaagaattgctcgaacgtgggagatggaggttgcagtaagctgagattgtgccactccactccagcctgggcaacagagtgggactctgtctcaaaaaaaaaaacaaaaacaaaaaacaaacctatgcattgaaaagtgtctgaaagtaaataaagcaaatgttaacaatacttgtattcgttggaatttgaagtgatttttctgtgtatttaatatttttaacaattgatattttattgggaaaaatccattttaataaaagtaccatgctattatgaagtaattatgaatcagtagttgtttagttgaattataaaaccatattctttattgactattaaatcacacatcattaaaaatatttttttcttcaatctctctatttttttaattgaagtataatttacacatattaaaatgcacagattttaactataccctctgagtcttttacccactgtacttaaaatataaaacattccagtaatctcataaaattcccttaaatccctgttatccctcttaaatcagtccattccctcttcgcagacagctaccgatctgatacctatcatcatggattagtgttttctgtttggaacattgaataaatggaactatgcactcttgtgtctgactatcccattatccatttgatcactgcttacagatcttatgactgtcttaaaatacccattgttcttcttttcttaatgtctatgtaactggccctaagtcacacagctgggaagtgctagagccagggcctggcctcaggtccatgtgcccctgagctctttcccctaatcctgtgtgtgccgctttccaaggcccccgactggaaatccgcttgctggggagggttaggttggactgtaaatcactttgtcactctaaggaatttgttccttattcctcatatatggattctccattgtggcaccatgactctttggggttgaaaagaataacaaactgcaagcttgtttaaaaaataatccagtttttcttcagtgactattcatcaggcagcagctgtgagtcagatactgttctaagcaggctgctgactgcgccctggatgtgggatgatctgtctgtgctgtggagtccaggaacttgactcttgatgtgtcggcattttgaggtgtttccccttgagctggtcaggttccctggagaagactgtattcctcttctgcctagaaggtgatagcctggctgccagtgttcaggaagcagagttggggcctccgtgcacaaatccaggtaatctccctgttttcagtgaggcatcctggtggcagataccccagagtctccctctgcaaagagtgaacctccagtgctcctccagggtggagagggcagtcacctagtttgcatgtggggaaagggatccaggcactgatggtttttttcctgcctttcgtggagtctttcttattttggctctcctgggtgggaagacatgacagaccacgtggccttagtccccacattataaggaataaaatccagatttcttagcatgacatccaggatgtcatgggtgggtaggtggatggggtggggcagattttgtgttggcaattacattggccatttgtttgtcccattgccaactgcggctttgggcctcttgggtcagctttcacacctcccactgctgtgatgttttccagctgtccgcattttgtcttttcttgtgtttccacctttaaaagaaaatcctgtgctttttttttgtttttaaatcttggaaggcctttttgaaaaaatcagttcaggtataaatttcttttcattaattttgccttttaatgtatcctcttcactctgaggcaagttcagaaatctgaatttccttatttaccgtgaatcaatgtcatttcgactccaacacttgcctgtttccctgtcagcaaattatccttatttatgcttaaggtaaatctccccacttacctaggcaggccaatgctgtccatatcttggattccatgttaaggaatttgtattttattccttctaatgggagaactgaccaagtccacatggtttcctcgtgtctgcccacccggctacttctgtgccaggcttagggcacaggagtttatactctctatgcaaaccccagaacttcatgaacctggagtgggggcagaaaggcccattcaggcccagatcaagaggaagtcactctggtggctggatgacattttaagtaatagaagagggccaaagaaagtgttccaaaagcacacttatgctgtcggcatgattttatggttgtccacacaaagaggcagacggaatcttcttgaaagttttttgctggattccttttcttgttcctgtcccatcccccaaactggcatgtctcttcaatgcagtcactaactagtgtggctcagttcataggaaagagtgtctggttgttgtttgttgaatactttctgcgatcattatgcagacaagaagaccaaaagcagacagattatattagctctgtcttctttcctcatgccacctgtttgccaggttggtcatattttctatccccaagttaggggctgtggggagatggaggccaggggatctcacttggacctatcaaggagttggagcatggctataaatactttttccagttgctgcttagtttttagcaattccttcaaaactagatagagagagttggtgcttagtttttagcagttccttcacaactagatagataggtaggtagatagacagagcttaaaacaattattagcaagtttccatgggattttaatgggaaaaggagagaggaaatgttgggcctttgcctttattacctggagtacgcagaagagggtttcttgaggaagttttaggctagaacagctgagtttctgcccgccttgaaagtccactatcagagagatccctgctgcctggagctcagtggagatggatggacttgcctggctcattaagagcagggccgtatcacatctgtctttcaaaaccttgcatctgacataattcgtgatgtgtaataggtgctcaataaagggttgtagattgaatgactaaatgaggcagcgatcaccatggcagtcatccacatcagggtgagtagtggaaatgaatgaggttaggaagaattattgcattaatttttagggctcaccaactcagtgcttacaggatccaaatgaaagaataaacactgcccattctaggatgataaatgacagccgaaatttggcctcagtataggggcagagagtggcagcctggagggcacatgcctcatctgatgggagctgttgccagctgcagccagtaggcataatgacatacctcctaattttttttagatttaagtaaaactctggatggtagtgtgaaatatctttacttttcatttcaaatttatgatattttgagtcacaaaaaaaacacatatgtggatcacatttgattgaaggccttctcattgtcctctctggtaaacccaaaagaagagggaggccgggtgtggtggctgacgccggtaatcctagcactttggaagaccaaggcaggtggatcagctgaggtcaggagttcaagaccagcctggccaacatgacgaaaccccatcactactaaaaatacaaaaattagccagacatggttgcagtcgcctgtaatctcagctattcgggaggccgagacaggagaatcgcttgaacctgggaggcagaggttgcagtgggccgaaattgccccactttactgcagtctgggtgaaagagtgatacttcatctcaaaaacaaaaaaagaagaggcctgggttgctgggaaccttcatttaaggggcaagtggaagaaaaataatccttcaacaagactgaaaaggcgcagttaaagaaccagagagagaagtgactctgaatctaagaagaagactttaaggaaggctggtcaaggttgatggacatctgctatgatatgtgctatggggaagtcagagaacacagtgaattgcttatgaatgcagggagaatgcacattcacatgcagctattttgggtctgacacaagcatggtgcagtctgtgacactggtatcacttggaccaaacttgcttttaaagttgtttccataaggctctggcaagaaaagagtccaagatcatataaatttttatgttgaaagccatcattcgtatatctataataaaggactttaaaggagtatttaaaatatttcaaggaatttacatgaaactgtcaaggaatcactatttttatatcttcaccatgatagggtggaccttcgtcttgtcttttgggggaagttatgacagtagatcctattccaggaagttttattttactggaggaaagcccagttaaaatcccagtgttaatttcctgtcatgttaactaccaaagaacagatttccaaagtgtctcaaacatttgacacaatcatttccgttttctaaacttgatctgtgtttcttgggtgatacatgcattctgattcgaaattgaacaaagtatattcttaagtataactatatcctgtctaaggcagtggactcatggagtatgttttcatttttatgttaattgtcgagagtttataagtcattgtaaattagtctgagtgctttgtgtgagttagaaattgtctagtagagcaaaacccttttactaaactcctcctgtgtgcttccacttgctcagagccatgcaggcaacttcttacatgcagaggagggcgtaatctaagccatacgctggtcattgggtggacttccatgcctctatgcctttctcatgtgtgtttgcctctgcctgtaattttccatccattcccaacctcttttccttctcttccttcttatgaagtcctagttatgcttcagggatgatttaatatgtcagtccttctgtagagatccctaagaccttcttaccactgtacccatgaaactttatatataactatggatatggcacttatcaaataatatatttggtatttatttttctcttccacatgactgtgtatatcctaaagtccatgtcactaatttctgcatctaggcatgtatctgacataggggagcttttcagtaactgatggttgaattaggtggaattcctccaataagacatcaccccaatgcatgacttaggcaaataaggtattaaccctgtgtggtgttgaagaaccattaagcttaagagtattaaggagctaaatgccctcttatgttttgttatgtaatttaaacagaggaacaaaaaataaaattctttaagagaagaaggactagatatgtccgtaagccttgataaactaattataaaacttgtgggtgcagcacatcaacatggcacatgtatacatatgtaacaaacctgcacattgtgcacatgtaccctcaaaattaaagtataatgatagaaacttgacacaattatattttaacgtatttcacattgatttaaaatttaattgtcgataagtcatcagcggcaaacccaaactgtagaattttaattcccaatgatagatttttctaatctgtagtagatttcttattatgttatggcctgatacacatagcttagatgtgccttgagtaaaatcatgaccctgaaatctagcgactgtagatgttttacatattagaacttagggcataatttttctccccaacagcagggctggaaaggtgattacatttcagaagggtcctttcagcctgtgccttgtagcgatttggggcatgaccctttgctttacacctgcatagctggtgtggccttttctcccaggctcctgggctgggcctttcctctttcagagagaaggacccagggaagaggggctgaaatgggagacatcgttgtgtgccaagcataggatcatgcctggcctatggtaggttagcatttaataagtgtttatgcaatattgcttgattaaaatagcattgatcttttaatcaataacattattaaaataaaaatgttttaaaatgttaaaaatattttaatatctttacaataactattggctatgccttacagtactattgtctctctttaaacctctcttagaaactgtgtgttaggtttggttttattctttgattactagaagtgcttttaaagaaggtacagagctctaaaaagggcttctttcaagtgtagagagagaaattagaaaaaacatcaaagacaaagacttctaagaaggaaaataaaaattgatttaccttcgctttagaagcttcccaaaaggggagactaggaaaaatagcagaccagaccatactgaaggcttcctttattccctctgttgtctcattccctggtgccaagagcctctttggggagattacactttatggcaaggttgcatttgttgttattttgttctcatctccatctgggacaagcttaggcataattcctatttgtatttcaaattttcctgccaaaaacgtgttgacctatgtctccaaagtaacggaggttatgcatcatttctactctagttgtggaaatcgacaaaataatgtttctaccactagcaagaaaaattgagatgttactgtagagaacttgccattgaaatggcattagtgataggatttgacgttttgaaaaaatagatcccattcttcttggcttcctgttatactccttgcttaatttctgtttcatggacgcgatcactatctgttgcaagtgtgaggatgaagccacagatggctagactctgaccccataggggagccattcttactaaagagatggctcttaagaccaaatggagcactggtagaatgggtgccaggtgagtgggagagactgccttcctcatggtctgctcgtggctggtaatatccttgcaggggccacctctactcgtagggaataaggatgacacatagccacataaaggcaggtctggaaactcgcaagatgtccacctgcttacttctgagaaaaaaagtttggaatggtgcactctgtatgtttctcagcaggcagagcgctgggtttgttgagtgagattgtgttacacgtactcatagacacaggcaggagttacctggacttcatgtttacagtgtgttttaaattctattgatgttcgtatgttgtgaattccattttgggtgtattctgtacgaaaggatgatcttttcagagtatgtaatgaatattaacttcttagtgacttcagaagacccatttattggttacttgatagtacaaacaccaacagccatctgagttctgtaaattgttactgagatgagcttttttatttttgaaaaacgatcatttctctatgcatagattattatcactggccatctctactactgctcaactgaattccttcctcaaccataaccattgtgtagtttttatatttgattattttcctcatatatcgttatccttgactaaaggcctttctccttaggaaatgctttagactacctggccttatagcatcaatttcatttttaaatgcctgtggagacatgcttgactgcatatgaattttctagtagagttctgtaagaattcttcacctcccaaagaccatatgtatccatcttggttcccaacagtttataactgccagaataatttaaaagacattttccctttgcaagttaatttagaatagaacatattttgtcagagaaagtggtgtgggaaacagcttggatcaagcagccacagacctctagcgacctcacaggcagcatggggcctgtagagggcactgcaccaggagtctgatgatgtggcctgggtcccggccatgcccaaatgaggggcgaagtctttcccagtcacttctgctctcttggcttaagtttcttcacatggaaaatgagtcgttggcctaatgatgccccaaagtagcgtttagattttaaaatgtcattgattctagattttaacatctacaagttcaacatgaacgtcgacagctcatttagtcttcataatcctctttgtaccaaagcagattttgtgatcgcattctgaaaacatcaggaaaactaggatatgctacagcacttaccaaccataaaatcaggaaatctaggttatgctacagcacttaccaaccaagaaatctcagtggcttaaagcaagtttatttcctgcttagggtgcacagttagtgtgggttgagtgaggtgtcactgctcgtcacagttacccagggactcaggctgatggagcagctgccatctcagatgctgctgatagctgtcagagggaagcagtatggtggatttgtataaaactcacggactcctgagccttgtactgtaactgagtccctaacttctgcctgcctttcttttctgcagcaggtgaccatcactgatggagggggcaggagagtgtgctcctaccaggactgggaggagagctggtgctatgtggtgggcggcagtattggcaccacatgttacagagggctgcttctgaccaaagccaactttaggagagagttttaattgacgcctaacagacctttgctgggctcatttccatactgtgcccaatgagaaagaactatgaggaatggggaaaaggcctcaggtagaaagtagagaagagtcatgggattgatgcaggggtcagaaaaatggtggggcacaccaaataaacattttggcaggcggtcaaaaggcctagagttaatggctaaagtgaggccaagatgatattgaaaatgttcatctttcatgttgaaagactaatgtgcagtcacttctagcatgatggggatcgtggttttcctcatagctgtcccctgtagaagtctcagttactcctcatccttcaagacttaatgcaaatatttatctgcgtgtattttcttttcctactgaaatgtgaatgtttccaggacaaggagccatttcatcctagcacctagtttacaggcactaagtgaatattacatgattgaaatgaaaccacctggcaaccctctgctatggtgcccatgtgcctgccatcctctggctggttcagcattttaccaggccagagctgggcacagaattggttctgtagaagcagctaaagcaagatgacatttctgagacttctggccgctgttctgttaattttggtgctgtcaagcgaaagggtaatcaaatagtactttgaaatctgaaaagtgaaaagagaaaagtaaactcatacctaaaatataatttctgttctgtatattctagtttccttcttttgagttgctgtccatttagtgtagtgcaatcaagaatacctaaatcagtataacctcgtcattgaaagaaagactttagtaacctattgatatttctgtcttcattattttattattatgaaattgctgaaaataattacacaagtgatataacttttaatcgttgggatgcaaaacagtggttctcaagcttcagagtgcctcagggttgcctggagggcttgctggggccccactcccagagtgtgcatttcaggtggtctggggtggggcctgggagtcagcatttctgtggagttccctgaggatgatgacaccgcgggtctgggaaccacactgtaacgaacaatgatgtacaggaaagggcactggaaacagaaaagcatgggtgtgaatcctccatgctccctaataaccatatgacagtaggtctctcggcccctctaatcctctgtttccaccttgtggaacgtgaaggccctagttgacctaacagatgatcagatgaggttgtacactaaagccgtttttaaaaaaataaggctctctgaaggtatcttcttacaatatcctacagattgagaatcatggacacttgttttacattcagagtatacacagctctgtaccaggtagtggaaaacaggacatggaaagaaaaagagaacaggagaaatgtggcacatgccaagcaccaaaatgagtgatgtgactgtttaaaattaagagaaagacacgctgtggtgggctgcccaggggggacgtctcccaaactgtactgcgtaaagaccatcatttcacaaggaacctgtggtcactttgtgttccaggatggcttattgcacgggtagcgtcctggaatctagaaatctctcatattagtgcatttgggtagtttatcttttcttggactcaatctcaggttacctacccgttagagtttatgaagttaagagtttaaagttcctcattttgcaagcatttaaaagtcatcatctcaacaaggaggtgctactgtaaatataagtatcagaaagatctatgaagtcatcttttcacacttttgatttaactaattgagggaggggaggaaaatctgaaaatctcaaggaatttttaatcttaagattaaaaaatgtagctcatacatagttgaccagcactagcatttttcttttaaggtgtgtgaccttgtctacacttagagttttagataatttttattatgatttaaccctaatgttttaaaattacaattaatagtaggtttagaaattaatgttgtaagtaatatattaacatttttactctactttaagtgctttgatagccacatatttaaggttggataaaaactgtaatttaacagtcataattattataattgatctgaataaaaatatgaactaactgtattggtcaaagcaagttatgtggtaaataaaaattaacaataaaattgaggttttaaaacttaccttgggcaaagactgtatctgggtgatagattgagctctagacagtgaagtgtacctatggatactaactgccgttatgattaataaacacgttgttatacttcaattgtaatagcattttattatgtattatttttcaccaaagaatactaacaggccagttaccactgtgcaggttctgtttaaactcttggcattaaaaaaggaatcctcattcatacttgaaaaagattggaaatccctgacctagtccatgcttgtccatgatactaccctggcccttcatcttgactgactctgtagatcactgttaatgttggtttatgtatttcttacccttttggatagataccttttctaaaggaagcaatgatggaaaactggctgttagctaggttgagatgtgtgcacacttcattacactcttaacaggcagatacccgtcagccttaaaggatgactttttgccaccctgctttcctttctgcctggccatctgcttcttagaatcttccctgaccatgctgtatgttccagtaccttctttgttgaagaacgtattggaaagcatagtcagtgtcttttaacctgattcttccttctgttcttttgaagacagctttgattgtttctaaagtgccaatggaaaaataaatccaagaatttgtctccccagtttttgaaaaattgtagtgtagggcaactgtaaaacacatactatgtactataagtttcccacaattaaatcagtatgaatagttgttgaaatgcatcagttgaatagattagagattcaagtatatatgaagatctgaaatgtaatagacctggcaaaactcagttcatggaaggtggttgattcaataaatatcattgatataactgattatacatctggaaaaaataattgtaggaacccttcccacactgtatacaaaaattaattctagatgaattattgttctaaatgttctaaaaatacacaagtaatagaggtaggtcttaaacctgggtctgtcttactccaaaactactgagctacattttaaatgttaatagataatgcgagattacgagtcccaaagatgagaggagagaaacattttcttttgctaacatttgactttttattttttgtcgtaaacaatgctgagatgaacatcctaatgtctacattggtaagtggatacatgattattttctttttaacacattcctggaaatgaaatagctgtgtttgagggcacccaggcttttgaaataaacttccagattgctctccagaaaggctgtgctaaattagtgactttattcttttgtcatgtttaatatcccactatttttctcttcagaccatcttttgttatggagaaggattgtactcccatcttccttttatattggcaagtttctaattaacctagggcttcctgtgaaatagggagaagctgatattttgtatccttttatcatctatattaataagctcataaagaaagtatcactttgacctcagatatctccttctctagcattaatcggagacttctgttaagatccagccatatagaacaacaacagtagggttttactctccctactatcaatatattggctgtgctggaggtgaggcgccccccttcctcctgcagccagagagctgcatccctgggaagaacctgctcttacatgactttaactacttgccattcaatgtaagtgcagcatatttccaaactgcgtaaaaaatgagctgtgtgaaggcttcctcctgtctttgttatctttcatgcaaacagttctttttgatagaatttggaatttaccgaattcattccgaaggctgtgaaatgtgatctctatgagttatagtcttcctgtgaggatgcgttgtttttgtggaaggcaccaccgggttgacacagtattatttatttttctcccacatacttcttgtaccttcctctgtaaccaatatgagactgtattgaagagaaataatcttgccaagtatttgatatacatagaattctttgtgagttgctatcttaacttaaaaattttaatatgctaaatatccatgtgccaaaggaaaataaaagtaagttcttttcagagcagggacttttatgtcttacagtattcagtgtgaagtaggatagaggtatatcatcgatcacagtgcacaccagacagaatttagagtgtttacatctgcgatcagagttacctggtctcagggcagagcatgttttgttttttttccctactttttagcaaagacttaggctattgtaaataagctgaaaattatcacagaaattgttgaagttggctctgaacaagaatgcttgatctttctataaacagctttattaatgcacgtcaaggcactgttctctaccatttccttctgcttgttgcagaccagctaatgtgttaacagagatctgaatcatgacctttttttcccataggcataggccgactctttccttgagctaaaatttagccagaaaggaaaaaaaaacccattttggtgcatgtggcatgaaaatgaaacaatgcagctttatttagggtctcctttaacctacatcttaaaaatatattttaagtctgtaatatgcctattaaacattagcacagttatcaaaataatgatatttgtaaaatcaatgtgaatatgtgaaatttgtagctttatatacaaatcatatacatgggcatgcatgcatacatatttcaacatattaatatgtgtctatctcaatatatgcatatctcaaatttacatatgtatatcttatacatatataattgagatagcaccaattataaaggatttcttaaagaggctgcaaatttaggcatttgtcattaaataatcccataatatttcagtgcctgaaatcattctagcctttatattgtagtcatttgcgttttcttcccttttctaaatgtagtctccagatgaattaatatactcacaatcaacatactgtggcacgagtaagaactatgtgtattagacaagttcaaagcagtcctgacgctcacttgactaaggcatgtgcctcatgtcccctttaccttcagctcttctgggccactgctgggtgctcattgctgctcctgtgctgactgtctgcagtgtgtgccgtggaatacttctttgcctatttatcatatctttggttcctctccatccttaatgctgaacttttagagcatgtagaacaaatcagaagtctcttgtgctgattatatccatttgacagatgtgttcagaaattttcttgcactcattaaaatataaagtaaaaattgaaatgctttatatgatattaatatggatattactatgacaagtgatagcttacaatgaaaagatttcttttaagaactcttgccatatttccttctattttcatgttttgatatttctagaaaatgtttttactgtattcaagattagggttttgtaatttttagcaatactgctgtggagcctagttgaaattagtgtattactttagttcagactttcttcttatcattcttgattgttaaaagaaataaaggtttacacagaatgtatagcagtgttgagtgaactcaaccagcttttaatatattttttagaaggttaggagaaagattaacctatttaaggacctaacctacttttacatcctgcaaactattttttttaaattttaaaacatttttcgtttttgttcttttgtattttgtttattgtaaccgtagtttgtcaggagttacaacccggccaacaccgggggtggggggcccaacatcacacatctgtgtttgtaatgtagtatttattaatacaggtcatataacattaatgtgtcagcacctcatggatatgtgaattatttaaaatgagcatctgggtactattttttgatatttgaaataaactgaatttttaatgttcatatgttatacgatatgccaagattatcctggtaaagttttcatatccaactggggaatcagcagcaatgtttctccctcatttcttgggtcaagcaagcctaaagttggacacaacctttaaaatgagctgattatggacacatttatacatcattttgttaataagttgtgcatcagttaaactgaaagcttgctttgcttgcctcattggtttttttttttttaatttttctggaattaaaaccactgaaaaataagtccagaaacatcaatttggctgaccttagtttccccctaaatttagtagttttatacagcagaaaacttgtaaagttacttatttacagacaggctctcagtgtgtcacccaggctggagtacagcagcacgatcacggctcaccgcagcctgagactcgtgggttcgagcagtgtttccaccctggcctcccgaagagttgagattacaggcatgagccactgcacctggcctaaatttttttttgttgttgtttttaaggaacaattttctttacagaattatttagaattagaaattgtgaatcacattatcaagcttttaaaaactcttaatttaattgagaaaattaagtattaatactatggcctgggtcgttcgggttgtagtgtgatacaactcctaaacatgaaagattttactcttcttcttcttcttcttttttttttgagccggagcctcgctctgtcgcccaggctggagtgcggtggcgcaatcttggctcactgcaagctccacctcccgggttcatgccattctctgcctcagcctcctgagtagctgggactacaggcgcccaccaccaagcctggctaattttttgtatttttagtagagacggggtttcactgtattagcaaggatggtctcgatcgatctcctgaccttgtgatccacccgccttggcctcccaaagtgtggggattacaggtgtgagccaccgcgcccagctgattttactcttttgaaccctgtggttcctggaagttgaagtcctgtcccccagtagatgcttgttgaatgaatgctcactcagccactctttttgccagaggctactagtttctcacctacctcttctccctctcatctaggctgacatactctgaaagcaaggcagaatttgctcatatattcatttatgatccatattttttccttggaaataattattttcattttgctggaccacgttttagagagcctcacttctgttgatttgattctgagcaatgtttctgagctggactgaccacagagtaagatcttaccttattcatggctgtgaatcatattgagccatttgtcttagctgtcatgcaatttgctaattaggtcattctaggggttgagggaaatgaaagactttgaaataatcattaccttctcagaacaaagcagcagcagttaaatgcttttgcccagtcattttactctgatgttcaataaattcagaagtggaaggtaagttgggatcttactgttgcataattatgctttccagtttatctgaagattgtgcagaagatatttaaatcagtgtcttacacagttataagttgtatatttctgtttttcttattacattttttatcataaaactaaaacctattagttgaagaacatttggaaaatacagagaaatagtaaataaaaaatttaaaagtactcctcatcctaccatctagtataattatttgatggatttctttctggtctttcctattcatatatttttcataaaacttaattattgccttatattgtacaacaatagctgacattttctgagtgtctatttcatagcaggcagtgatctaagagctttaaatgcattatctacttaatgttcatagcaatctaggaggcagttattttccaatgatgaatctgaaacttaagattttgctctatgtcaaaaaatgagaaatttaagacttctagcttggacaaaatggcacagacctgtttctcccactttctcccaactaaatacaatgatagaccccagaaataatgcaagaaacagaaggagaactctaaaacttggtaggaagaagtcaagatggtttggggcccaggactaaaggactgacacaatggcagggcatctcacattccctcacccatcaggagaggcagacctggcctttcttgacctctgaactagcaaccgagatagtccagggaggctgcttcctttttttattcaaatggaagcaagcaagcagccaagggaaatactcttctttcttgctgagatacccttttccagtgtgtgatacctgggcttctgtgaagcaattgttagaaggatcccactgcaacaaatggtccagctgagtagcttctttgtcctcatgcacctaagaccaccttcttctgcccagagaggaataggtggttaggaaagcctaatccattctgtgggcctgaacaccaccactccttctactgagggacactgggcattaggcctggggaagtcccttcactccctcaggcagcatcagcagggacccgtgggagcccccatcagaaccagacaaatgaagcgggcacaaagaatgctgcaaaggctctgaaaattaagctggccctggaaccatagcccacaaaagtagaccaggacccacatactaagcctaaacagggtgactgcctagacaggaaatcagcaaggatgtagaaggtctgaacaacacaatcaagcaacaggactaaattgacgtttctggaatacttcacccagaaaccacagaatacatagtcttccaaagaattcgtgggacattcaccaagacggcgcacatcctgggccatagagcacttttaaacaaccaaactcatgcggagtgcactctctgatcgtagtggagtctattagaaatcagtaacagaaagacaacaggaaaaccttcaaacaggtaaaaatgaaacaacacactattaaataatacatgatttaaagatcaagttttaaaggaaataaaaatacataaaactgaaagcaaaaacagaacataccaaaatatttgggacgcaggtaaagcagttctgagagtgaaatttatggcactaaattactacattaaaaatgaggagagatagagaaagatagttcaatagaagcctccagagattgtactcactcctccataggatcaccaaattacccacagaaaaaatcatcttcataagaaccaagaatcaggtgagcaatcacagtacctggttttagcatcatactaaggaaagaggcactgaggagagtaggagagatagtcttcaatcacctaggccacctttccctcatccaaaaaatataactgataaacaaattcattatagttgctgaatacaaaattaacatccaaaaaggagtagtatttgtctatgccaaaaacaaacaatctgaaaaaagaaatcaagaaactaatcccatttacaatagctacaaaaaaatactaggaattaagttaaccagagaagtgaaaaatccctgtaaggaaaactataaaactttttgcaagaaattgaagaggacacgcaaaaaaatggaaagatattacatgtttgtagatttgaagaatcaatattgttcaaatgtccatattacccagggcaatctatagattcaatgcaatccctatcaaaatacccatgaattcttcacagaaatagaaaaacaatcctaaaatttaaatggaaccacaaaaagccaagaatagacaaatttatcctaaacaaaaagaacataacttgaggagtcacatttacatgacttgaagttatactacagagctatagtaaccaaaacaacatggtatgggcataaaaataggcaagttgaccagtggaacaaaattaaaatccagaaataaatctatacacctacagtgaactcacttttgacaaaggtgccaagaatatacattggggaaaggacactcttttcagtaaatgttgctgggaaaactggatatccatatacagaagaatgaaactagacctctatgtctcatcacatacaaaaatcaaaatggattaaaaactttaagatgtgaagattatgaaactagtaaaagaaaacattggggaaactctccagggcattggatggggtaaggatttcttgagtaatactctacaaatatgggcaaacaaagcaaaaatggacaaatgagatcacatgaagttaaaaagcttctgcacagcaaaggaaaacaatcaacaaagcaaagagacaattcagtgggagaaaatatttgcaaaccatccatctgacaagggattagtaaccagcatatataaggagttcaagcaactctataggaaaatatttaataatctgattaaaaaatggacaaaagatctgaatagatattttgcaaaagaagacatacaaatggcaaacaggtgtattaaacgtcattgatcatcagagaaatgcaaatcaaaaccattatacaacaaggtatcatctcactccagttaaaatggcttttatcttaaagacaggcagtaacaaatgctggcaagaatgtggagaaaagggaatcctcatacactatcggtgggaatgtaaattagggaaaccaccatggagagcagtttggaggtttctcaaaaaagtaaaaatagagctaccatatgatccagcaaagccactgttaggtatatatgccaaagaaaggaatcagtataccgaagaggtatctgtacttctatgttttttgcagcactattcacaatagccaacatttgtaagcaacctaagtgttcttcagcagatgaatggataaagaaaatgtgatacatatacacgatggagtatattcagccataaagaaaaatgagatcctgtcatttgcaacaacactcgttttgttaagtggagtaggtcaagcacagaaggacaaacttcatgtgttctcagtcatttatgggagctaagaaaagtaaaacaattgaactcatggagataaagggtagaatggttccctgaggctggaaaaggttggtgggggtgcagcaagtagggatggttaatgggtacaaaaatatagttagaatgaataagatctagtatttcatagtacaacagggtgactaaagtcaataatttattatacatttaataactagaggccaggtgtggtggctcacaccttgtaatcccagcactttgggaggctgaggcaggctgattatctcaggtcaggattttgagaccagtctggcgaacctggtgaaacctcgtctctactaaaaatacaaaaattaagccaggtgtggtggtgcacacctgtaatcccagctactctggagactgaggcaggaggcagtgagccaagatcacgccactgcactccagcctgggcagcagagtgagattctgtttcaaataaataaataaaaataaaataactagaagagtataattggattgtttgtaacacaaagaagggattagtacttacgtgatggatacccataccccgtttaccctgatgtgattattacacattgtatgtctgtatcacaatatctcatgtaccccttaaatatttacacatactgtagactcacaaaaattaaaaatattaaaaaataaggaaaggtctcaaatcaataatctaagttaatacctcaagaaattaggaaaagaagagcaaaataaatccagaacaagcagaaggaaagagataataaaagcaaaagtcgacaaaactgaaaatagggaaacagtagaaaaaaaatcaatgtatcaaaaacctggtcctttaaaaactttaataaaattgataaatctgtaacaaaatcgagaggaaaagaggacacaaatctgtaatatcaagaatgaaatgggacaacagtacagatcctaaagccactaaaggactcataaaggacaagattacactcacacattttccaactaagaagaaatgaggtcagtttgtcaaaaactgcaaactaatactcaaccaggatgaaatagataatctgaagagtcctgtaaccattagggaaatggagagagggtagtggctatggtcacaaaagagcaagaccaggggtcctgatggcaatagaaatgttcagtgtcttgatgtggtgatggacacaggaacccacacatgtgctaacattttatagaattaagtacacacctacaagtaaatatcaaactgaggaaatctgagtaagataattggattatatccatgtcaaagaaatcctggtcccagcattgtactaaggctttcaaaatgttgccattggggataactcagtaaagggtactcagaatctctttgtattacatcctataacttgcatgtgaatctgttattatctcagttaaattttcgattaaaaaaagctagcagcttgttactttaggagttgaaccctgactgtatgactccagagaccttgttctcattcacacgtctgcatctccatgttatgttgagacattgcattcctagtagttttacatgatcacatgtagatcataccatatgtaaatagaaaagtatgcttgtacattgtctttaacagcaattatcagtattagacaaagcatagttttgtttccctcccccaccccccgaccctgttcctgtctcatagtttgaagtttcccttaagtattcacagttatagtccccaaagactttagatgccacgtggcatgcgtaaagccagcatattctattgaaatggccggtatagttgccgaatcagatgtttttagcttacagaaatgacaatttcatatgacatttcttttcatatgttcaaagaaattacttgagcaaaatgggagatttctggagtaggccataggatcaaaggagttgctggaggggacaagagagctctagtatcctcagagtttggaacctaggacacattctttttatttccatctcatactttcttctccctggattttggcacatactgcctgcagtggaatcattggtggtttccagtatcttctttgaccagtcctgcagtctgaaggaaataacttctgtattccaggatttgtttgaaaagatcatagagaagattagaattagcctggcttggatcacagccctacacttttccagtcactgggcaagaggcagtgattggcctggtacaggccatgtggacagggagggagaggttattgctctgtgaagggagtaagagctgggagggggcagaggggcaatgcagacacagctgttagagcgaccgctgggatccagcagctgctgaagcctgtgtctgagattatcaagtcaagatatctaaatggcagttaaatcatgaacataaaaataattttcaaagtatgcttaattgttcagttttttaattcagcagaatttttctcctctgctaatgacaaggcagtctatattagagactgtcaaaattatttcttaagaagcatttaaacaaataatttttgtagactgctatatgcatttcattagacaaatgtatattctgctacaaattcacataatcatttttccctcactctactcaagactacttagattgtttgaaagaaggctttggctaatgggtattggaaggaatggctgattgttttaaaatatcctgttgcatacaggatgtatttttttgaagggttaagaatgaaaataggaagcaagcatgttccctctgactgaaattactttccttgaagccattagtgtgtaagtcagatgctgaacttacgatatatagatattatataatatgttacatatatacttgaaaataaaattccaaacagaataatgactgttgcatggatatataatggagtaatttactatgatgaagtctgacttgatagcacatcaacacagtaagcctcattttgaacagttctgctgtttcctttgtgaaatggtagttggaagtattgtccgcggttatgcagcatggtgtttatgaagacctttgtggactctgcttggatccatttccaggaaaaaaaatttctctgccagtgaacttttatgtttcttttgccagaaaatggagaaagatgaatgtttcaaatttttttttaagtgccaggatacttagaagcagcctggttcagtgccaagatgtagtaatcagcttcctcagatgtagtcattcattgacgctcttttctgattcaccaccagtgtcttgcaagagctttcactttatctgcctgcagccctgttttaacagtagtgttgacacaactcacctgtgtccatttgtgatttctaaatagtttttaaatcataaatatttgaacctcaaggtaacgctgtaaagtatgaatagagatgacattgtattttttcaaaaaaaaaaaaaaaacacaaaaatctaaacggaaacaagcacagatgaacttaatgtcagtgtaaattgtagattatagacttcacaaggctggtctttgttttgttcactgtatcccttgctcctagtatagtgcttgacaataaatgtttcaggatgattgatgttgaataaacttaaaaagtactcagcacctcacaactttgaagaacatggaaacacttgtattggcagaagacagaaatgtgtagccccaggagacaggagatagctcaaagcaacctgtcatgagcacatttctttgaagcctggtgttttatcttaataacccatacaaaattgaattcttctttgtattaggaatgtttgttttatcatagagattgttttaaatgttacttatcataaaatattatgcttccgcaaaatacactgtttatcttgaataccctagcgtatctttagaagtacgtacttctattgcttttgaaaaatacaaatgtccaattaattacattttattgatgtactgtctatatgctgatgatatccaaatgtatgtcttttatctttatttcatctctgtaattaccattttagttaatggcaagtgtgtttttccagttgattgagaaaaaaaattctaagtcatccttgatgtgtgttttgtttttttttaaacttatatccagtgtgttggatagtatcattgggtttgacttgagaatatatctggaatttggtcatttttaaccattcctactactgctaccaatctgccgccattgtctcttacctggattcctgcactgggtttttagctggcctgtgggttttcccttgcaccccacagcccagtctccacacagcgttggcacgatcctgtaaaaacatcagagcaggtggcacccttctcagcactctccagtggccacccatttaaacagagttcagacccacgtctccactgggcctggcagagccctctctgtatcctcctctcctactacccctccccagctctgctcttccagcctctctggcctctttcctgttcctccaacctgcccgagttgctgctgcttctggggtctgcatttgctcttcccgaaggtgtccagatggctgtttcctacacttcctttgagtcttttctcaaaacatttcaatgaggtcatccccattcattccacctacaatttcgcaccaacccccaaacataaggtcctttctcacattttttttcttttggcacttatcacatctaacatactatatgttttatgtggtgaggatattgaatttctttccttcccttcccccttccccacccctagtgcaatgctagattgcaagcttgatgagggtaggggagaaaggcacctgttacctaagagacctgccaggaaatctttgcttcatcctgatctgtctccacagttctattagaatccttcctttttactctccttgtttttcttcaagggcagggggttgatccctaacaccctcaaaagactgcctcttggctttaggatattaagccaactttttgacaaaaacacatctgagctgctttccttgggcgtcagggatggagcttttattgaagaaaagaaagacactgtctcctctctggtcacttgtttgttcctgggtttcataggtgtgtttctacgtgttagactccacaagcagtgaaactcggagatctctgagaacataagctttctcatgagcactgttttccctgtgggtaggccacccctaaggtggtggtggtggtgtttatttccctaaatggtagttacgggtcaggtgtgattcctggcacatggtaaatgctcagtaaataatttctgaatcaagactggttccctcaattttaatctgatgacttattttctccttatatggattatacttggccttcccattttaacattctgaagctgcaggagatattattaaaggccaggctacaaagagctcacgttcccttccagaatacactgtttctaacaagcaagctgaataaatttctctgaatctggatttaaacaaaattcattataagactggccttgcatttggaacatgttcttataaggaacctgtaagtcatgaatatttcactttcttttctaagttttcttttcaaatgcacatttgctttcattttcttgttaaaatggattgagaaagattaacacaaatgctggtgggaaaaaatatagaggaaataagcattcataaatattttaggcctccgtttttcaacaacccacagctgtgtgtacatagttgatctgggacagaatgccacgccttgtctctacaatgtgttgcctcagagccagtgttcacctggggaatagaacttggatgtttcggaaactgcatagcaccctagtgaaaaatgcttccaagtgcaagacagactcttatctccaaggattccagaccgtattctaccgtttccaaaaataacctgccatcatcagctttgatccctacctttaagataacattttattttctatttgttcaagtaaaacatgttcataaaaagtactttggccttttcttccatagattgtaagtgtaaaaatttgcctaggtttcggtctcagccaagatggtcaactgcatatactactgagttctgaataccatgttagctattgagaaagaataaaagctagagggatgcatgggtgctaaaaactaacaacaaaaatgctaggaaccccttgggagactgaagtgggctttagcttctgtatagtggctaagtagacgggtagctgcagcctgtggacgaggcagccataggtgtctggagagtctggaggaaactggtttttaaaactattttttctaagttatgataaagtatacataacataaacttaccatttttaagtgtactgtttggtggcactaagtgcaatcacgttaagttctgcttttgcctctcctattgccttccctgaattttatttccagcccaattgtcactcacacgtgaggatataagaagtatcttcagctatacaagaccttataaaagtttctatataaagagccacactgaaacatgctgggaggaaatacttaaatatgaagggaagcaaatacacgggcagctacaagagataggggaggtaagggggatcaagtcccctggcaaagttcattgatgtcttgaaaaagaaggctaggacataagaaaacagaaaatacatgcaagtaacccagagctaaacttctagatgttaccgttattgagtggaggagaaaccaaagacggtagggatgaagaaacatacagatggatctgctggggagacattgtgaaaatgaaaagcaagaggtgcagcttttaaaccagcagaagaaaattggatctagccaatcaaaaataggaaaggggaagtgggatggaaagaataaaacaaaaataaaatacagtaaatggaaaatatgaaaaaaagctggaaaagttcaagttttagagtaattacaacgtatattcctggattatccatcgtaaagatgtattctcagatggggcggaaaaacaagatacaaaaaataggttataagagacacacttcaaaagaagttggaaataaaaggatggaagagagagtacacaaatatgaaccaacagaaagcagtggtaacttaaatatattattaaagatgaagaggaatgctatatattgataaagggaatatgacaagaagatgtaaccataaaaaatggtaatctgcaatatagtttgaaaatatatccagcaacaattgacagaattgcagagagacatcaacagttgtagctgaaatttttaacacactgttctcagaaattagtaaatcctacagttgaaaagcaggcagaggtggagaaaacttgaaaaatacaattaataagcatgagctgttaggaatacacctaaaactgcatacttgagacaatgtgtattttttaagctcgtttggagtgattataaaaataaaccgtgtattatgccatataagaagcctcaatttcccaggaatgaaagcaataacaaattaggttcactcagtataatgcaataaaataagaaattactaataaaatgatagtccctaactcccaaaaaaccgcttgtggttacaaattaaataacatatttctaaatagctattgaattaaaaaaataaaattatgatatatttagaactgaaagacagtgaaaacatgacatttcagatttgtaggatgtagttcaagcagtacttaaaaggactttatagcttaaataaacatagtttattaaacatatagtttattaaatattaggaaacaagaaagataaaaaatgagccaaaaagttggtaaaaagaacacaaagcaaatttcaaggaaacaagatagaaaaataaaggtaagtacagaaagcaatgaaatacagaataataataataacacctgacatgatagagaaggttaaaatcaaaacttgattctttgaaagataagatagacctctgacagactcaaaaagaaagaaaagagaagctaaaaataaaatacaggacaatgctggcacctgtagtcccagctgctttgggaggccgagacaggataattgcttgaacccaggaggctgaggttgcagtgagccgagattgcgcaactactttccatcttgggtgacagagggagactctcaaaaaaaaatttattttaataaaaaatacaggacaatgacaaaaaaggaaatagctgtagaccaaagaaattttcaaatgattttattggaacaaaatgtatacttaataaatttgggggaaaagctaaataaaatgaataaattctcagaaaaaaatataaaatgtaaaaattatcctaagaaatacagaacatgatttcaccaatacatggtaaagaaatggagaaagtagtcaaaagctttcctcccagaaagcacctgagagaattttatggttgagttctactaaactttagaaagttggttcttttatgaactaatccagaaaacagtgaagagagagatgttcagcaattttctgaagttaatgaaacctcgattacagtacctgtgaatgtaacagtgtacattaaaagagtgaaggcaaaaatgcgattatctcaagcagtcactgtttaggagacaaatctggatttccaagcagaaggagatataatataggggatcaggtactttaaaagttgtaagcgttggagaagcagttttgggttgtggggtcggtggtaagatcacatgacaatccaggagacaggaagttgctactactgtcacttttattacttttttttttttttaaacctcacaaggggataactagacactggaatatagctgggcccagcaaacacatctctccagtcttgctttcttccatccgctgtagcaggaaaatggcctctacttcacctccctcttccggaggtcatgataaagcatctaaattgcatccagaaccttagctacaaaggaatctgggaaatatggttgttatctgtcagacctattcaacagagggagattgaaatggagtttgagagatgcactataaagtatgtaccacaaatgctcattacctctgctgctacttaacatagcgttttcattttatgtcctgatcagtgctatccaggaagtaaagcaagaggcatatggatctaaaggaatagataaaattgtcattacttatagaaagtatggtcatcttaacagaatttagtaaactgattactagaactaaagagtacaatgacattactgtgtataaacagtcatctcttggtatctggaggggagtggttctggaacctccctcagataccacaattcacagatgctcaaatccctgacttaaaacagcttagtatttggatataacctgtgcgtattctcctgtgtactttaaatcacatctaggtaacttatacaacttgatataatgtaaatgctatgttaagtagttgttatattgttcagggaataatgacaggaaaaagaagtctgtacatattcagtacaaatgcaattttttccgaatattttccatccacagttgatcagatccatagatgtggaacccacagatgcagaggatgaactgtacatatgatcaaactataagagtcaatttattctagtagtatccaattaaaaatgaataaaaacataagatacgacttacagcaacgaaagcaatataatatctatgaattaataagaatgtataaaaatctcttcagggtagaatttaaaatgctaataaaagaccaagattatctgagtaaatagagtttttattctcttggaggtagtcgtaaaaaggtgtcagttcttcacaaaatatttaaaattaaaccccagcatttttattgtatgtttttgggaacttgataaacttcttcttttttttttttttttttgagatggagtctcgctctgtcgcccaggctggagtgcagtggcgcgatcttggctcactgcaagctccccctcccaggttcacgccattctcctgcctcagcctcctgagtaactgggactacaggcacccgccatcacgcccagctaatttttttgtattttcagtagagacggggtttcactgtgttagccaggatggtctcgatctcctgacctcgtgatctgcctgcctcggcctcccaaagtgctgggattacaggcgtgagccaccacgcccggccgataaacttcttaaaaacataaagcagtagaggaaaattgatccacttgattttatcaccattacagattctgttcaatgaaggtatctgtagacagatgggcagatgacagaatggaaaatgatgtaggtgtatggaatgtccacaacttagattaacaggaaatctttgtctagaactgcaagaaactactgccaaaaaaaaaaaaaaaaagtgattgcaatccaaggagaaaaataagagatatgaccacacacttcacaaaacagtgaacgcaaaaggctaaccagcataggaagaaatcttcaagctcattattaccgagagaaataagaatcgaagcagtaaaatgatatccttattacactagcaagagttggctgaggatggtagatacaagtggggatgtgtgaacataggaattgtcatgcactggtggtgggagtgtagacttggcacctatactggagaacagaagttgctgaattaggcccagaaatactgatcccacatttattttcccgggtacgcatcctaggaacacttttagataattgaataagggatatgcctgaggtatagcatcattaaggcaagctgcccttgtcgtgaagtatttacattgttaggttttttaaaaacactgaggatttggtcacttttcgtgttatctacttaaggagaacagtgctttgatgtttgtttattagctttgcaacctcgacaggtatttatcctccattcctcagcggcttcgtgggttgttgtgagaatgaaatggcttgatacctgcaacaggattagaagtacttgtgagagtaaatgcctagtcagtagcagctattattgtggaattattcctagaagccgaagcactgagttgattggtatggactttccaaaggctcatcttactttgaatatttattgtgtgctactatgtgtcttgacgtttagactaagtggtcaaaaattcttgtcctggtgctagaaaactaccacagtaaatggaaaaaaggtaaatgaggtacatgctagtcattgctaacagatgaagctgcagttggagttaatggtaaatgtgcttaacttttgggttatctgatctgttttaattcttcgtttgtatcattccagaattgtcaggaggagatggtaaacctctgagggttttctttggttcttttttggttcctaattgagacaggctagagggctgtgcctttgatggctgcataacattctacatggttctttctttttattttctattttatttatcttttattcatttatttttcttctaaggcagggtcttgccctgttgcataggctgcagtgcagtggtgcggtcatagctcattgcagcctcgaactcgtgggcccaagtgggctgatcttcccacctcagcctcctgagtagctgggaccacaggtatgcacaaccatgcctggctaattttttgattgtttttttgcagagaccaggtctcactatgttgtccaggctggtctcaaactcctgagctcaagcaatcctcccaccttagcctcacaaagtgctgggattacaggcatgaaccactgtgtccaacctccgtggttctttgaacaatgatcattaagagatttgttgtttgaaccagtgtcattattgataatggataaatgcatttaatatgtagtttaatatgcatttaatttaatatgcatttaataaatgcataacttcatatgcatttaattgtagtcagctactttaggtaactgatatactctaatgtcccagcctccctccagatgaaaataatgttgttcttctcagtgttcccactgctctttttccctctattaccatagtaatcactgttcttctttatattgtggtatatgtatatttttttctcactagattttagtttcttctggccggagaccatgggtgattcacctttgaatccctaaaatgattaacattcaagaagtttttgtcaaattgaattccctccttcccccttggtatcatttgtgctctcttctgggaaatatttaaaatgtctccaaggttattgatcactacattctagaggacctcagaaatggttctcaccagccacccatgttaaagggcagacctgtggcagacagagccattataatttatgactctttctgtggtgacagatagatgtggcctttggtaggctccctgattcaaaatggtttatcctgagctgatgtcatctttgggagtacctgtaatggatctgatcaccggatcccttcaggcaccacacaaattccagcaagttttgcccctagctaggagcatatatttattctacattgctaatagacagaaaatattttcccaaaggaattataggcaatttgctttagtatctttatttactatgcaaataaacatttatttttagtttaagttctctaatttattgccgaatatttagtgtggcatatgttttttttttttttctagtaactcattaccatgagtggttcttgggccttaattttctcatctgaaaaattaacgagtctgtatttttttatatttactcatttaaaatttatatctcgcttagttttaaatgttttaaaaagtgtttaaagttagtgaaaagagtacagagaatacaaaaacaaatactatatccagtaagttagaagcgagaaaaacaaggaaaaacagaagtcggaattcaaacgagaaccagaagtaaggcagatagacaaatgctgagagcctggttcatctgccaggaccgtgcatgatttgagtgatctgctctctagcaactaccagggaaaaggaatcccagtcagtcacctggttcccaaggttcatgagataatctctgagaagtacaactaatcatggtgctgggaggagaaggatatttctcttgagaagtctggaggagagcactgtgattgaatgagcccgaggctctgcacttcacggcccctcaggcctggcagtatttggagatcctctgctgctgaggccagggtgtctgtgcccacggttcatcattggtgtctgctttgcattcttcaaggcaattttcacttccaacgtgatctacagaagtgctcacaagagcagaccctcaggaagtggcagccatgactatagaattattcctggaaatcaaagcactgggttaattggtatggattttttttaaggctcatcttactttgtttgaatatttattgagtgctactaatgtgcttggcttttgttaactttcggaggaaaaatttgacctcaggcttgttagagtctgtcctttgtgacacgcagttggtacgttgtttattttatggttaatgtgtccacttggtgcagcttgtgtttgataaaccaccatctccttttcctctgtctcccagaagttcagagtgtttttctctcactttggccttaggaccattattttctcttaccagtctgttttctttataattctaaatcacacacaccagctccatcatttgagagaggtggggacagaaacaactggctcctacttctctgtgtcaccaccagtgtccagttggtttgggccaagccttggactgcatgtttcctggctttttaagtatcccttgactcaacctttttggcatcaggactggtttcatggaagatagtttttccacagcccagtgggcagggaggtgatgatttggggatgaaactgttcagatcatcaggcattagttagattctcataaggagtgtgcaccctagatccctcacgtgcacagttcacagtagggtttatgcccctatgaaaatcaaacgccgcctctgacctgacgggaggagttgctcaggcagtaatgcttgcttgcccactgctcacctcctgctgtgcagctggttcctaacaggctatggacgggtacccgtccacagcccggagttggggatccctgccttaactaagggatccctttcccccaactcttctctgcatcttgctggatgaggaggtttcccatttactccattactctttcaagaaagtctccaattctgtcttatctggaaatacttcttgttttctaatgataggttaattcataacaacatgatcattaacttatgtcacagtcgcagatggcagtggcccggccatatcctgcagtctcacgtaacgaggcctgtgagagtcggtgtaatttactgcactgatgggtccctaaaggcatttcaggctttgctccacaaagtactctcttttagcacaaattaatgttctttgttttgttcagtgacttttgtcaatatataaatcttagaatttattataatcacagtttgcttgcttacttttcatgcatgcttctttaatccagggtgatttatgtgtttatgcatgaatttttctgtcagaatatgaactgagatatttgcacttaaagtacacacgtttgttttacattttctcacagagctaatactttgttttcccaaaatacatttacttaatgaaattcggatcttcatgttgagatgttcatttttaaaatttgactttagttatgttaaccaagtctgcgttacttaatttaatttggagtcgacttactgaagttgataatttacttaaatgtaatagctgaactgcgtaaattttaaaaacttatcctagctatttgatattaccaatctataaaatcttgattttgatgttgttgttcttactgtagattatctttgttattaagagagcagctttttaatttttaatttttttttgagatggggatcttacattgtcacgcacgtgggggtgcagtggcacaatcacagttcactgtaacctcaaactcctggattcaagtgatcctccagcctcagcctcccaagtagccggaactacaggcccgtaccaccatgcccagctaatttaaaaattttttttgtacagacagggtcttgctgtgttgcccaagctggtcttaaactcctgagctcaagtgatcttcctgccttagcctcccaaagtgtgagattacaggtgtgagccacgacatctggcctgaaagcagccttttgttttacagtttgttctaagggaattcaaagctccacatcttttaacgattattactatttgatctaaaacctttttgaagtaatctgctttgaatcatgtgaggagctcaatgaatataacattcttggtaatcagagaatgggattaaatttttaacttggatggagcagttccagcatgagttatgacgaagtgtctagtgacctgttttctaaatgttgaattaaatctgctatctgtattttaaaagctaatcggtatatttctacctagcccttaaaaagccatcactcatactctctttccatcccatcccatcccttctcttacctaagttacttacttgctatctgctgttaggaaaaattttaaaatccacttattgaacatgtacgtacacaagattacttggctaactatcaatgccaaacagtcagtgaaaggacaccctttaaaataagacttttacatcagcaagaaatgactagtatattttattcaactcaacaaacatccactgggcacttatgttcaaagtactgtgggtgatagaactaataagttagtagtttctacctggaagtaactcacattctttttaaaatttttttggtctgtttctttgtcagacctttagtttgtttaatggaatgtcacaaatttcggtcaagtaaggtgtttttgattgatggcagttctaggcaaaaacgcctcagtgaagatggagagcccatttgggatcaggatcatccagcccctcagagcaagagtatggagatcatattcacagtgggtaccaagacctaggcttggcgtaggcatcacttctgactggggaatttcctataaactgcgcagaccaatgaatgaccacagaggagatagctggcgtgtgcgagaaagagcaaagattaagtgagcccaacataagagtgcctagcaaatcgtctcactgtgtgtgagcccaatgcatggtggcttctattattattattttattctgacgagctttactcagtgaagataggcaactattcagtcatctatttgtcaagtgcctgtaatgtaacaggcgtgatactaggtatagaggatttaacggtgagctaggcaaatccagtcattgccttcacaggactttcacttagcaggggcttcagacaagtgcgtgggctaaacagttgagtaaacgtaaacatggtgaaaaatagagggtgctattgaaatgtattcacctgaagaagggaggaagagattcctggaagaattccattggaagacatgtttcagttgaaaagtaagtaggaattgattagaataggaggtggagagagaggtggacagtgttgcaggcagacggagcatctggggtgaccacccaaaagtgagggacagtgccaggccccaggaactcctttatgcagcccaggcacagccaagtggggcttggtgtgggccctgaccctcagtttgctatgaaaatgtctgggctttatcccagagcagtggggtgctatagttgagttttaaatggggtgcttatctgatgaaatacttaggaagattaccctggtctcagagtggagactgtgctgggagggtggaggaagagtggcagaataaaggcattggtgggacgatggctggagctgagcaagggactgacagtatggcctgcacaggcagaagaacacatgtgattacgcagaggcggggccggtggggccagagagagcctcagggggctgagcagagcacccttctctgctgggccagccttgggatgatttatcagcagaaaactggatggatctgtttgttcaagggcccagggaagacaggctttggggagcccccatcacaggctgaggacaacagatgcagctgccccctgagaaacaacagcctccacgtgtgcacctcgggaagaagtgagtcacagtcttctcagtcacacccagcacctgcttaatggccacttcttccagagccagcctttgaatatgaaaaaacaataatcaaatgatcttcttcccaggagttgagtcggtactcctgattagctcagggccaacactaaaactagaaagctggaggctttctgggagccaggctgcgtggtggctgatgtggccacataacattgtgatttttgacccttccttttctaagtcatgctgagaacccttgaagccccctgctgttcttctgttttccattttctccttccagtactcattaaaaaataaataaataaactgaatgtgtaattaagcactatgttttgtgtcctttttatgacaggttcatcaattctacatgcatttactgaatgcttactaaaggcagggctgtattttacatatcattctttgtgaagctactgttttcacttcggttctgcagataggttgggtgttgaagaatttgtagctgaggatagactttgcctctgcagctatccttcctgatcagactagacatatacctgattttttttttctttttttttttgagatggagcctcactctgtcacctgggctagagtgcagtggcacaatctcggctcactgcaacctccacctcctagattcaagcaattctcctgtctcagcctcccgagcagctgggattgcaggcgcctgccaccatgcccagctaattttttgtatttttagtagagacagggtttcaccatgttggccaggctggtttcgaactcctgacctcatgattcgcccgcctcagcttcccaaagtgctgggattacaggcatgagccaccgtgcccggctcacatacctcatttgaccctgtggtgtgaagttgctattcctactgttgttaactgatggcagaacgtaggtttaaggtaaccaacggggctagcatgcttgttgctgaagtatatgaatgcgggaaaaactcctggcctccccactatgcccttggctctggtcagtgctgggtgcagcgtgcctgccatttgcaaagcaaaacctgtaatcccagtccgcatcattcccctccacgcatacattttatgcagctaaagtagtgtataaagtagctgatggaatactgtactgcctggcttcttgaaatttagaaggaaaacatttcatttaaagttacgaaacaaaccaactactcaaaggcagaaataaggagacagatgatgaaaggtgacagaaacttgactgatatgaccatgttagaattacagaattaagaagagaagtaccaattttacaaattacacgaaaggcattttctctgagttgtagaaagtgagtgtgagctgttgtgtgggagcctcttggtagctgtgaagtacgggtagtcatgtctggagttaccctttctgccccacttccagttgctggaatcatcacagcctcccattcctgtgcagcctaaagaatgcctcctttgcctcttacaagacagattcttacgttgaagttgacatctgccacctgactgccataaccaaataccctagactgggtggtttaaggctgggaaatcagagttcaaagtgccaccagctgagtttctggtgagggctcccttcttggcttttgtaggtggctgccttctttctgtgtcctcacatgcctttgcttggtgcatgcatgtgggaaaagggagacagcacgcatgaattctctggtgtctcttcttgtaagggcaccaattccatcatgagggcccctcccttaggacttcttctaacccttattataatgcctcccaaaggtcctatctccaaaggccatcacatcaggggttagggcatcaaacgaatgaattttggggggacacaaacatcagtccctaagaacatctaatttgatgtttttatttaagctaaaagaatgcattttaacattttcgggttggggtgaggggggacacccacattggctgtagatagtgctttttgctgggttttgatttttcaggatgagggaaaatcgatctagagagaaacaatgaaatttcattaagaacttcaaagggactgtcttcataaaggcaatagatgtgtttagagaaggtttgggggatcaacttataaagagcattcaaactcttcattttttttgttctcccagatttatgggaatgtagtagaaacaggcttcccagtctatcatgtgtcattgaaacgcaaaacacaatagcgtttgtcttgttacaaaccaggaggctgtaaatctattatttattttttattaaaggtgcaagttccagagtgaggctcatgaatagcccagagaaataggagatgaagcctttcatctctgttctgttcttccccatgtgagccaggtcaccagtgattgaatgggctttctgctcttgtgaaatatgtttgtttacctggactatgttcaaaaggtaaagaaacaagaaaagggaaagatgaggaaaatcacaaacctgactttacatttcagatccagtttcaaattgtaattagaaaaagcaacattatttccagctgtcatcagaattttctactagaccaggtgtgctttggatctcttaagggatattataaataatgtagaataataatgctgtgccattcagacttctcttttatgctcatcacccccaaataggctccttggcgtcaccgttgtttacggagtgctgacagtggccacacccaggtgaaagcttctggagttacactgtgtacttctgtgtgactctgagctaggtggggccatctgcaagtgagataagctgtgtgttacctggttagagaaagcctgtgacttcctcaggggagtcgcaggtacacaaaacattgagcaaagaagtccccgtttgcagtggtccagttagagatgtcttgctccttgctatgtttgccttttgaggaactgatctagttcatggctatccagaaaataattggattttttggttgtactttagtaaatctgccagtatctttaatttcctagaaaaatgtaagtcataatatattctgtcatttttctccagtgtaggcaacgttatcgatacccatgtgacttatgcatggtgtgtatgtggctgcattttgcctgtgttgagccacgtgcacaaactaagaagtgtttcttatttgctagaaacaggagcttcagcattttgttcctgatgcttccttgattcaggcagaaggtatttacttgtaaattatatacagtgcatagtctctgcaaagcagaagttggttactatttgccgggactgcttaaacctgccctttagagtagcagtttagtttcctcatagctggtcgggcacctgaagaaatagtagacttttgatgtgtatccttttgcacttcaccacggtggatggacttccatcatttttcatcgatgcccttgtggccaccccctgacatgactccttatgcccaatccaccttgcaaagagaggacagcacacacatcctcctggagcctggccatactggaagatttcgcctgcctctgggccccattctaaatgaaatccacacacactcctccatctggaatcgcagacctactgcaagacccccatagcccacctttttattccctttccttacactactctacaaatcatcacatggtcccagtaacaatgagaatagctaatagcagcgctctgagattggttctgttatttacaccattttacagacaaggaaacagagacttgaaggataggtatccaggccaaggttttacggcctgagcgtcatagcatcagagtggcccatgatgtctgaccatgcaggtcttcactgagacgtgctccctttactgttgcccctggacttcatgggctttcatgccctacaggatggctcttttcatgctcttccctctttcttcattgtttgtgcctccacctcaagggtaaccttctgtgcagtaggtccatgatggaacctccctccaggtaatcctcatggaactcacttttgcttctgctctttattgaacctgttttgtgtcagatactgtgctaggagctgtcaatgtctgttaggttaaattacaaggacataaactgagaactgagcccttgaagtgctgtgaggaaggcattttctgtgttagtaacgagtgcactggcttgcattcagcttttgtatggtcatattgtcccccaaccatgttagaagcttcctgagggcagaaactctaacttcctcatctcctgcattgcctggcagctcctgtcatgtccgtacgccttagaggtgtgcggtgactgcattgctgatgtggtttaaaggaacctggagctcttagagaaatgattagaaggagcaagagctgagagactagtgaaatttattctttccactcaacttacagtgagagaggtggcaatgtttctttcttttcctccttcccttgtttttttgtattcatcttgtatattttctctctctaatttgcattattttttatcaggggaacccacccccaatatttcaacataggttctttctattttccattagcatacaaagagaggaattttacagttgggccgccgggggtgacatcacatatcggtaggaccatgatgcccacctgagccgcaaaaccagcaagttttattaaggatttcattaaggattttattaaggattaaggggagggggtgcaagaacagggagtaggtcacaaagatcacatgcttcaaagggcaaaaaggagaactaagatcacgtgcttctgcggaaacaggacaaggcaaaacagaactactgataagggtctatgttcagctgtgcacgtattgtcttaacaaacatcttaacagaaaacaggattcgagagcagaaaaccagtctgacctcaaatttactagtacagggtttcccaatcctggtaagcctgagagtactgcaggagaccagggtgtatttcagtccttatctcaaccgcataagacagacactcccacagcagccgtttatagaccaccccccaggaatgcaattcttatcttagggtcttaatattccttgctaggaaaagaatttagcaacacctctcctgcttgcacatccgtttataggctctctgcaggaagacaaatacggctctttttgcctcaccccacaggcagtcagaccttatggttgtcttcccttgttccctaaaatcgctgttattctgttctttttcaaggtgcactgatttcatattgttcaaacacacatgttttacaatcattttatacagttaacccaatcaaagtggacctgaggtgacatacatcctcagtttatgaaaataacaggattaagagattaaagtaagacaggtgtaagaaattataagagtattattagggaagtgataaatgtccttgaaatcttcacaatttatgttcctctgccgcggctccagctggtccctccatttggtgtccctgacttcctgcaacaacttttcctatataaagggggcttatgaaagtactatcttctactgaaactattccaataaattgaggaggagggattcctccccaagtcattctataaggcagcatcatcctgatagcaaaacctggcagagatgcagaaaaaaatgactttagccaatatccttgatgaacgttgatggaaatatctgcaacaaaatacctgcaaaccaagtccagcagcacaaaaggactccaccatgatcaggtaggcgttatccctgggatgcaaggttggttcaagatatgcaaatcagtaaatgtgattcattacataaacagaactaaagacaaaaatcacatgattatctcaataggtgcagaaaaggcttttgataaaattcagtatcccttcaagttaaaaactctcaataaactacgtgttgaaggaaaacctcaaaataataagagccatctatgacaaacccatagccaacatcatattgaatgggcaaaagctggaagcattccctttgaaaactggctgaagacaaggatgccctctctcaccaatcctattcaagatagtgttggaagtcttggccagtcctggttgtggaaacaagggaacacttacaccctgtcagttggaatgtaaattaaaccatttggaaagcagtgttgcaattccccaaagaggtaaaaacaggcaaagaaagggcatccaaagagagaggaagtcaaagtatcctttgtttgcaggtgacatgattctacataaaaaaactgggtaaagtctgccacacccagaggtgccttgggtgagtcatcatcttggcccaaagtgttcttcagctgataaacaatttcagcaaagtttcaggatacaaaatcggtgtatgaaaatcattagcattcctatacaccaacaacatccaagctgagagccaagtagggaatgcaatcccattctcaatagccacaaacataatgtaatacctagaagtacagctaaccagggagccaagagatctctacaaggagaattacaaaacactgttcaaagaaatcagagatgacacaaacaaatagaaaaatatttcatagtcatggttaggaagaatcagtatcattaaaatggccataatacccaaagcagtatacagattcaatgctattcctatcaaactacccataacattcttcacaaaactggaaataactattttaaaattcacatggaaccaaaagagagcctgaatagccaaggcaatcctaaacaaaaagagcaaagctggaggcatcatgttacctgacttcaaattatactgcagggctacagtaaccagaacagtatggtacttgtacaaagacagacacatagaacaatggaacagaatagagtacccacagataaggccatcacacctagaaccatctgatctttgacaaagctgacaaaaacaagaaatggggaaaggattccctattcaataaatggtgctgggataactgactaggcatatgcaggggatttttttacaccatgtaaaaaaatcaactcaagatggattaaagacttaaatgtaaaacccaaaactataaaaactctggaagatgggctgggcgtggtggctcacgcctgtaatcccagcattttgggagactgaggcaggcggagcatgaggtcaagagattgagacgatcctggctaacaccgtgaaaccccatttccactaaaaatacaaaaaataggctggatgtggtggtatgcgcctgtagtcccagctactcgggaggctgaggcaggagaatcgcttgaactgaggaggcagaagttgcagatgagccgagattgcaccaccacattccagcctaggttatagggcaagactccatctcaaaaaaaaaaaaaaaaaaaaaaaaaaccaaaacaaaaccctggaagacaatctatgcattaccattctggacataagaactggcgttaattgtatgatgaagatgctgaaaacaattgcaccaaaagcaaaagttgacaaatgggatctaattaaacttaatagcttttgcagagcaaaataaactatcaacagagtatgcagacaatctgtagaataggagaaaatattggctaactatgtatctgacaaaggtatatccagtgtctataaggaacttaaatttacaaaaaaaacctattaatcgaatatgataaatcagtgctatgaactaaacagatgctaatcactattattaattagtgggcaaaggacatgaacagaaacttttcaaaagaagacatatgcagccaacaagcatatgataaaagctcaatatcactgatcactagggaaatgcaaatcaaaactacaatgagatgccatctcacattagtcagaatggttatcattaaaagtcaaaaaataacagatgtgggccaggttgtggggaaaggggagcacttacacaccgttgtggggagggtaaattagttaaaccattgtggaaggcagtgtggtgattcctcaaagagctaaaaacagaactaccattcaacccaggaatcccattaatgggtatatacccaaaggaatgtaaatcgttctacgacaaagacacatatacatggatattcattgcagcagtattcacaatagcaaagacatggagtcaacctaaatgctcatcaatgttagactggataaagaaaatgtggtacatatacacctcagaatactatgcggccatgaaatagaatgagattgtgtcctttgcagggacatgggtgaagctggaggccatcatccttagcaaactaacacaggaacagaaaaccaaatatcacatattctcgtcagtgggagctaaatgatgagaacacatggccacatagaggggaacagacaccggggcctacttgagggtggaagcctccctcaggtaggcctgtctcaggtagatctgtctcaggtaggtctccctcaggtaggcctgtctcaggtaggtctccctcaggtaggcctgtctcaggtaggtctccctcaggtaggcctgtctcaggtaggtctccctcaggtaggcctgtctcaggtaggtctccctcaggtaggcctgtctcaggtaggtctgtctcaggtaggtctccctcaggtaggtctgtctcaggtaggtctccctcaggtaggtctgcctcaggtaggtctccctcaggtaggtctgtctcaggtaggtctccctcaggtaggtctgtctcaggtaggtctgtctcaggtaggtctccctcaggtaggtctgtctcaggtaggtctgtctcaggtaggtctccctcaggtaggtctccctcaggtaggtctgtctcaggtaggtctgtctcaggtaggtctccctcaggtaggtctgtctcaggtaggtctccctcaggtaggcctccactctcaagtaggccccagtgtctgctgtggagggtggagggtgggaggagggaaatgataagaaaattaactattgggtactaggctttgtacctgggtgacaaagtaatctatgtaatgaaccctcgtgacatgagcttacataacaaacctgcacatgtagccctgaacctaaactaaagtaaaaaaaaaaaaaaaaaaaaaaaaaaggtaccatcagggctagtctgagacttcagggacttaattcctcattgtaattttgcaaataaaggaaatagagttccctttcacgttctccaggctcttcagcctttagtcttccccagcaacccctacctgctgttttccaactcagagcgtggcaacaactttatcattaagacctcagagatgctgagtggaagagaagtgtgtgtaggaaaaggggggcagataaccaagcaatcgtataggtaatgatcatgcatctagaactccgaagtgtgctgcagagtgcattcccaagtccttccttctgtgacccaggtctagtcctaaatgcagagggcaggggtagggatgggagtaaaagcatttggacaaggaaactgatgttggagaccggaggtatcggtgtcaacactctgcaggcctccagctggttcctgcgtgtaggccatgcagcagctcgaccttgtttacagctctcgggctaatgaggattatcatttatgcctgagagtatgtaaatttggcagttcctgctctaaaataacattctccatctttccgggagtaaactgctttcttagtaaacaaattttcagtgcattatgttaccatttagaaactttcctcttccggtgccaaattgctcttaaaggtgagtgattcataaaggatattttatttaccttgaactcagcttctgtttggaacagtattagaacacaaggagagtcagtaaaccatcgctggaaatatgtgaggagctaagacattggaatccacatctgtatttagatcttgagaggttgcatctgtctagttcatagcactgatttctttatcattcactgagtaactagtaagtacaaaaccctctacttggggagttccttgagatacagaaatgaataacatatcagtctctggcatctgtgcttctacactttggagagggaaataaaacaagtagtaagaggcaggagtcccaggtgccccctgagaggcatggcatgccacagaaggcattggcaggaagactgcgtccacctgcttgcagggtcctgtgaatgccaccgagagggcggcatctgcaacagtagaatttatttcactggagaaagaaggtggcaggcatttcaagtggagggaacaataagagcagaagaaagcatgggactttgtggagcacagagaggccttgtttgcttggagtgaaggtcccgtatcagcagaccaggaaggaataaggctggaaccccagtttggggtcagactccaccccaagtccacaccattctgggagggaacggaatgccaatctaaggtgccagggagaagtgtttgaagtttgtacagcaggggaaagacatcgatttgaatactttttcccttagtatgtttttgcaaacctattttggggtattgtaaaaagattctgtgcttatatgaatttgggaataaacaggtgcttgctgtaaggcttcttagggcccttaatatgctttgtgactgtaggaggggatatgttgtgtcatctccaaacgtatttgaccatgagatctatttgaatacaaacctaatgcacctctttggatttccttggcttcctcctccttgcctggcgttccctgtctagtttcacgtgaaaccccatcccttcaagccccacatgacccttcattctggaccttattctgattgagctttcacttcgtttctggacttggataaaatgctgcaaacagggttgctaagcggccaccaagggctgcctggccccacctgaagtcccctgtggggccgctccttgagagttgaacctttatcaatgggaaccaggaaggatcctggccaggtgctttcccattctttgttgttccacggactgctccaaggtatgctggcttctgagagaactttccagagaagtcgcacgtgcttgggcgtgtccgctgagtgagctggtgtgtttttgggtctgtgcccttgctgaaattggggtgacccatgacttcacgttattttttttttttgagatggagtctcgctgtcccccaggctggagtgcagtggcgcgatctgggctcacttcaagctccgcctcccgggttcacgccgttctgctgcctcagcctcccgagtagctgggactacaggtgcctgccatcacacctggctaatttttttgtatttttagcggagacggagtttcaccgtgttagccaggatggtcccgatctcctgacctcgtaatctgccctcctcggcctcccaaagtgctgggattacagacgtgagccaccgcgcccagccaacttcacgttttgagtgatccactgcctcacatttttccttgcttcctgtgcctgtttccctacatcctgctgccctagttttgtacttccgaaataaaacatcagcatgtaatccttgcctcagcctctgctttccagaggacctgagcaaagatagactctgactgagtgctagagacgggtgtttcacagactcactttggaaaatggctacgtaggctgaactcagacattgagctttaagagtggctggttttgtaatagaccagacaagaaataaaataaggagaggaaacaggtagttgatgaagtgaatcagaacttgtaataaagctagagtaatggatttaagagtaggtctcatagagataattgatgaaagaatgagcgtataggctgcataagttgaggggataggtagaaaaaagagatgacaacattaagcatggaaagagagagaaggaggcgctcttgataaaggactgatggtagctggaggagtggagtgccagggcacaaagctgcaagagccctgaagaggaagaggaagagggtcatgaagaaggaaattgatcagggtcctggattcctgaggtacatggtcagtggtaacagagaacagagggggcatacagcaggtgtgctgaggtggctctgagagacgggagtttggtaggggagggaagaagggtggttgctagacagtacatcaggattgagcacagcataagagatgaaacgggggagaaatctaaagacaggtgtgccacttttgcctctaaacatgtggtataatttttgtcagcgaggaaataaatctgtttctcttttccattttccaagaagggagggaaagagattagaagtaagactgacatctcagggcctctaccatttctttgttgctaaaggagacacagtatgtggctctttgtttcagcaaaacactaatcagctttcggatatgcaaatatgggctgcagagctgattgagtggaagagagctacattgctgtgctaagtaaaggaagaggaattgcctttgatggtggggctggcccaggagagaagcagggaggtgtgtagagtcgctgggggagagagcgctgagggcttcaccattgcctaactctcagtgaagtgtgccacacccagaggtgccttgggtgagtgtcttggtggaaaggaagagaggtaggatttaagtcatacaaaatgggctaagttactgggtcaacatagacctccgaaagagcccgccctaggccaggagtcatgagtgggaggaagtgcacccagtggaggtgaccttgagaatgtgtttcttaggaattcacagcaaattgaggagggctcgagaccccccatgatatatagaaatagaggacagggccgggcgcggtggctcacgcctgtaatcccagcactttgggaggccgaggtgggtggatcacgaggtcaggagatcgagaccatcctggctaacaccgtgaaaccctgtctctacaaaaaatacaaaaaaaaaaaaaattagctgggcattgtggcgggcgcctgtagtcctagctactcgggaggctgaggcaggagaatggcatgaacccgggaggtggaggttgcagtgagctgagatcgtgccactgcactccagcctgggcgactgagcaagactccgtctcaaaaaaaaaaaaaaaaaagaaatagaggacagaagcaattttgttacagtgtctaaggacagagtagccttaactgtcatctgggtatcatgtgggatgtctttatgttttgggggcaaggggaaagcactcactgaagacagaagctgccacttgagcagggaggtgacatgtgctggagctgttgtgagagccagcgtattaagggttctgtaagagatttttttggtaagcgttgagagtgcatacagagtgagcaggcattgtggtgaagcagacagcatagtgctaacttgaggtggaggaggaggaggaaggaccctgggcacagtgcagacatctgggctttgggctgaggccctgtcagagagtgattcttgggcatgtgtgaaaacctttgttgaaagggtccagaaacaatggctaagtcctaacagaactctgctgtggacctagggaaaaggaaagaactaagaatttagcggtcaatttgaggccaaagacagaggagaaattgagggtcagaggggatttagagtttgagattttaaacatttgctgtttgtattagtcaagattctccagagaaacagaacgtgtgtgtgtgtgtgtgtgtgtgtgtgtctaaagagatttattagaaggtgttggcttacgtgattatggaggctgagaaggcccatgatctatcagctgcaaagtggagacccaggcaagctggtggtgtagttcaggagtgttagagccagagagccaagggtacaggttccagtatgagtctaaaggcctaagaaccaggagtgccaagtacaggagaagattgatgtccccgactgagctgtcaagaagagagaaggcagtgtgaatccaactttcctccgctttttcagcccccaatggactggacgatccctacctacatcggggatggccgtctgttttactcagttcaccaattcagatgctgatcttctccggaaataccttcacagacacacccaggaatgatgtttaattaagtatctgggcaccccgtggcccactcaagttgacaaaagtacactgccccttggcctttcctgagtgttatctagctttccatgggtagacatcagctctccacatctaaattgtaagctgctccagggcaggggccagatcttctcctgtgtgttctcagtagctgacacaattgccttccatgtactaaatgttcagtaaacatgtgttggatggttcattgatccaatagacttatgtctatgccaatacaggcttgctcttgaaaagctgcgggtaaatcaattctttgtaaattgaatcttatttcaaatgtagtagggatgttcagcatttcaaggaatcctaggtcaatctttggtggatctacgagccctgtattctgccattctcgttttacaggtaagggagctgagttacagagaaattaagtgacttattataatctgatttgtcagtcaaatataaggtttcttcaagcaaaacatacctgttacttaggtcaagagggatttggtgaaaagcctagctatgaaatttataacatcagattaataacgttatattttcagaagcatttatttttagtctgcagatatttattaagtttgtttacaacagtcttttagttgtatactaatgagtaaaggctatgctaaattgtgttgcagtttatgtcagattagaaacaaaaaacaacagacacaaagtttctggttcagaaaattcacctctgaaagcccccagctcgaagtgtttagtttttcttctgtgaggtgtgagaggatgttgaatgtgctggacaggtgccaggtcctgcgatcctgcagggtgcgttcctagattcattgttgaggtgatgaaagtctcttcagtcagtggcttaatgttaagtgtgagaaagatgttggaaaagatttagggagaccttttgggcacctcactgatggaattattttaaattgagcaggttttatcaacatctgtattgggttgatttagtttctccttgctatcagttctagaataaaatagtttattatatgtgagaaaattgataaaagtgtaaagctactttgcatcactactttggatgatccaaataaaggaaataaaagaatcaaagcattggatttactctgctttcctttctcttcatagtcatttttatgtgttttggcttatcaaaaatgagatcaaagttgttatatactacaaaagaagctgcttttttatttaggattttagtatcttgacatggagcagtgaatcagatgtggggacaggagataatttgtattcatattagatcaatattagctaacagctgttttacggacatcaagtcaattctgcaactcagcagggagaaattattaccccctttttagagatttggaaactgacttcacagttaatgtgggccttttgacgtcagtactgatctcacagttggcgtggagcttttgacgttggtactgatctcacagttggtgcggactctttgatgtcagtactgatctcacaggtggtgttggccttttgacgtcagtactggtctcacagttggcgtgggcctgttgacgtcagtactgatctcccagttgtcatgggccttttgacatcagtacttatttcacaggtggtgtgggtcttttgatgtcagtgcacagactcttcccgtgcaccagcaccacctccatggcgcctccccatgtcttttaggttttgcgtatattactattggctgctgtgagcaccatttttggaagtacattttcatattgcatgaagaaatacctgagactgggtaatttataaagaaaagaagtttaatggactcatagttccacatggctggggaggcctcacaatcatggtggaaggcaaaggaggagtacagacacgtcttaaatggaggcaggcaagagagcatgtgcagaggaactgccctttataaaaccatcagatctttgaggactcactgtcatgagaacagcatgggaaaaaaccacccccatgattcgattgcctcccactgggtccctcatgacacatggggattatgggagctgcaattcaagatgagatttgggtggggacacagacaaaccatatcagaagacagttataatatttgcataatacccagactgtgaggaataagccaagtaataagcaataacagatggaatattgaggttatgcagagtctgtgctgtgcatgtcacagcctgcacttgacctgagtcatgtgcttcctgagctctttacagggtgctaggccaggatatacgtgagagttacagtgattggaaaattagttttcctattagtgtaaatacgtatgtgttaggggatagatgatacactattacagacttataaaatggaaaactaaaattggaatgtaaagcttatagcaggtagcctcaggctgtgctcccaaacctttgggttcagtttctttatgtttcttcagttttctgttacggatactggagcagaagttgaattttagtggatttgatgtaaagaaatgggtatatttcaactttcacctcctttcctgttcctttttttttttttttttttttgctttgaagtgtgaatgaataatactatagacaaaatacaatagcaaagacaaattatggataaattggaaaatcaaactctgcagaacaaagattttttagttttacatcatgtaacaaatttaatgacaaactataccaacaagtgaattgacgatttaagatatttcatttagcttccaaaatgtgaatgctaataagtttgaaatcactaaatcacagtaattccttgcattgggcaacagaaatctattaattaaaatgaaaagtctaaagatattttggggaagattgcaaatttcaaataactgtatgtggtatcctccagttccttttaatagtctcatccttagctgcgcatttacttcacaagggaaaccttaaaaatactgataacagagcctcactgctggacctttagatttaatgggtctgcagtgagggctgagtatagcacttttttttttttttttttttttaaggcctggtcttgctctgtcccccaggctggagtgcagtggcatgatcgtagattactgtggccttgacctcccaggctcaagcgatcctcctgcctcagcttcccaagtagctgagactactggcatgtgccaccacacgtggctaatttttgtattttttgcagacatggagttttgccatgttgcccaggctggtagagcattttaaaaaactccccaggagatcctaatgtgcaaagttaagaacaacggtttatatgataatcattctttaatcatattatttgtttaaaggtagattcctgtattttaacattttaactttaaggttgtgatactctgatgaaggcagctcctatcaacctgtaggcagttcaaggtgttaacctttatctttaatgtttttatgtgtcagatggcagttagtataaggattacctttttccttttgcagtgtcataatactgagtgccaggacctaagtttttgaaacctcccagtagcccctttttaaactgctctgagcctgcagggcacagcatgacctagctgttaatttagtactttcatctgattgacctgggaaggatcactggccgcctaggggagaccttcccattattaattcctgcctggatgtcctttatgtgtctgcacagaggtttcggctttggccacgttgtgaaagtcataaaattaaagaaatattttgcactggctgttcacattgacattcagaaaaacaaattgcagtaatcactggggcctcttcctttgaaagaacatgcgaccagtgcctttttagtttatatcttggtagatttgcagtgggtctgctgtacgttgatgggtgggaagtgttaatgatcactgtgggcccatggccgctggaagctatttgtattctttgcactcgtgtggggcatgtgtgtatatgtgcagaggtgttcatatattgcttttgtttgcattttaaacatgaagctcatttttaaagtacttgcaaaatttatccaatgggaggcaaacctttaaattagtgattctcaaactttgagtgcataaggatcagatacagggaacctggggtggtgtctgaagtttgagaggactggggtcaataaatttccacaaaaggtgacttctcttagatgcccggatacagatgacaaacaaggctacagatagttctatacagaaacaaatgaatatatttttaccatttgtggaaattacagttttgaaactgggaagccctttgtatcactatcagctctatttttggaagtaatggaggaagtatttcaacctgattactgcctgtggagtgaggaatttcttagtgtttgactgaccgcctgctgatactttatttctttagagctcctcaagtcattataagaatcacccaacagtgtgaaatcaaaatgatttcttactataaaatgtcagctatctatcgtaaaagattatgtgccatttaaaaatataattgccgtttctcccctctcccccaccttacattcagatgttccagaataacagaatccctgcaaaatgagaaggaatccctgcaaaatgcaaggatctagcctgtgcaaatttcagaaaccgccttctactttaagtcttttaatagtccagataattatcactctgctcactgcccttttctttctctctacctcctcgtcattcttgcgacattttaatgatgctgtttgtgtattgctgctgatgaattctgcccagtgaaggttatttatttatttttccctgagctggattttaccctctgtttacttatgttggtgttctgtttcctttcctaactgctaccagacattcgtttccatgcctttgtataatgcacagcaggctgatgaagcgtggggactcgcgctgtgggaatcctgcttgggtaaatgtcaccgctttatataaagaactttgctctatcgtagctccagaatctgctcagattgccacaccttaacatatgatctgattattaggaagtatatgtttgttgtgttttgaaacactgatgggtttttaatgcactgctgattaatatgtgaaagtgaaaaccagccagtgaataacctggagtccttgtcctcctgccctctgcaggcttgcagggcattgggcagctgggacttgtacctaggacaagattacccatctgtggaaacgcattgctgacacctggacaaaacgagtgttgcaagtggaaatcagtggagatgcagaagagaattttgcctctgtcctgctaatggggaacatatttaacttggtgcagtatctgcagtaagctagtgtgttaggtactatttgaaggagtcttactcatcatcaagttaatttcttgactttaagaacgtatttatgcagcagcccttttctcagcacctctggacttttgaaaagtggccttttgtcttatttctacatagaagcactgcccctgtgcttccctttctggtgtagggcgcatggagcactggggacaaggtggggctgtttctcaaatctcctgcccccaggtctggggatagtatgtgatgcacatgagcttcaccatgcatcagctgccccgttctccaaacctagctttactcaaagaccttggtggtttggaagtgctcagctcatctttgtatacttctacttgttttggaacatcattcctttgaagaaaactttgaagacagcttctcaagatgtttgtctttcctattgccgtactgcattgactagcctcagctaaggacctggactaaaagataggcacccatgcttactggggaacctcttgagtctttaagaatgtatatgcaagcttcaatcaactgatggatgattcccctccaatctcccttcccttcctcctgctcactggccactggcgacacccccaaacaaaaagctgtgtatacgcaagagggcatatggcacagtgggtgagaacgtaagctcttgagacaggttccgggttctggctttgccacttcgcagctcttttctctttctgaacccctgtgtgcccgttttctcatttgtaaaagaatgaagataatagcacttaccatgcctagcataaactgttgtttcctaaatatatcattttaacaactttattgatatataatttacagccatagggttcaccattttaaagtgtgtaattcatgatttttaacatgtttagggagttgtgcaaccatcatcataatctaattttagaacatccccaaaagaaaccatgtacctactaggagtcactctctatctcctcctgcctctctgccctgcttccctatttcccaggtaatcactcacctactttgtatagatttgcctactagggacatttatattaatgtaatcatacatagacggtttttgtcactgacttgtttcactcaacatagtgttttcaaggctcatccatgttgcaacatgtgtcaacacccaaattcctttttattgcagattaataaagtgtgtggatataccacatattgcttatccatttatcagttgatagacatttggattgtttctgctttttggctatcatgaataatgctgctatgagcattgataatacaagtttttgtgtggatgtatgttttcgtttctcttgagtatatacctaaggatggaattactgggtcgtatggtaacttgatacctaacattttgagagaccgccaaaccatttccattttacattgccgccggtcatgtatgagggttctgatttctccacatccttgccaacacttgtaattgtttgtctttttgattctagtcactttactgggtggtttgggtgggttacctcattaattgtgactttgattttaattttcccagtgactaatgacattgaacatttttcctgtgcttattagtctaaatatactattgattgtaagaaaaattgcttactgttttagagataatactgatataagaaccatcagtccctgctttcattagaggggcaagagtgaggatagttttaaaatcaagcatacttaaagaatcatacctgcatctcattaaaagaaaatgttatttctaggtaaagctaaatcatcattaatgtatagggtttactgtttttctagtaggtttatgtgtagagcactcattttgtttggtttaatctctagttgcttttatgttttaatttaacaaaaatgggtgattggaaagatggaaaatacccttgttgccaccacagtgagttccaatttgatttcagcaacgcgtagaagattgaagtcagatgcagccaattttctcccgattactttttttttgaatcttgcctgaataatgtgagctttttcagctagctaattaacactgtttttttctgccatattggtgactttatgatattttgcttgtaattatatatatattcatttatatacttctaccctattcgtaactttatgatattttgcttgtaaaaaattatatataaattcatttatatacttctaccctatttattaaatgtcccctgcatgaaatatatattaatagctactgcatggattatctttgattgcttttctaataacagttatctggactttgcttggtcttgggtaagaggcatatttgtatgtatattttctcatttttgaaacagaaacataaactgttgcctccgatatatttaataaaactcaccagcactactgataatatttaattatgcagttataattctattcatttttagtttacattctgaatcttaggggcagtgaggcagagtgacatgatcatggaagtatttgtaccacaggggtttgaccttgactctgccacttcctgcgtgactttgaactagtcaaagttaccagttcaaagttagactttgaacgagtctaattgttagagaatggcatgaacccgggaggcggagcttgcagtgagcccagatagtgccactgcactccagcctggtcgacagagttaagacttcatctcaaaaaaaaaaaaaaaaaaaaaaaaaaaacaacaacaaaaaaggaggttacagtctgtttatgttgtctagttactagtcaacactaaccactctggctcggtgttttaacctgtctaatgggtattttttttttttttttaagtcataccatctacctgatgcggtcgttgtgagaacatttcagatagtatttattaaaatatttcctccttggtatgaagtagatgctcaataattgttaggtagcacagattaattatcctttatctaaaaattccaaatctgaaatgctccagtgagcatttcctttgttggtgctcaaaaagttccgcattttggagcgtttcagtctgtcgttccaggggtagtaacagaagctgtcatcttgctggctcttccatctggctgggttgcatgagagttaaacagtaataggagaaatgaaatttcagtaataggcagtctccttagcacaataattggtacaagagagtaagtctgacagtgccagtgaccatcagaacaaaccacagtcattgtggtaaagttgctcgaggcagtgactgaggaaagtgtgtctccatttctgtaacaatgggtagatgtctgctctaaggatttttaattgaggtaaaatgtacagaaagcatgaaaagaatttcatagatgttaagtgcataagccggtaagttttgacaaacgcatggactttgtgaccacctcctcactccagatgaacgtctccatcacccctgcaagttccctcaggcccttccaattaatctccatccctgtaggcagtcgtttttctgatttcttttcaaatagataaatattacctgtgcttgaatttcatatgaaggaaatcaaaatgttaaaagaagaacttcagacaaaggaaatttagcagagtttaattgagcgaagactaattctggaatcagaagcccccaggctagcctaagttcagagtaactcatgctgccacatcatcagataacacttatgaacagaaaaaggaaagcaccataaaagatagaagtgaggtacaggtacagaaacagctagattggttacagcttagcgtctgccttacttgaacacagtttgaacactggccgcctgtgattggccaaaactggtataagagtaggttacaggctgagcgaggtgactcacacctgtaaccccagcactttgggaggccgaggcaggcggatcatgaggtcaggagatcgaaaccatcctggctaacacggtgaaaccctgtctctactaaaaatacacaaaaaattagccggatgtggtggcgggtgcctgtagtcccagctactcaggaggccgaggcaggagaatggcgtgaacccgggaggcggagcttgcagtgagcccagatcgcgccactgcactccagcctggtcgacagagtaagacttggtctcaaaaaaaaaaaaaaaaaaaaagaggatgttacagtctgtttatgttatctagttacagttcactttgtactgagaaaacttctccccttttggtcaacttctccattttcacatcactctttcagtgtcataaagagactgaaacctcaaatcccactgggaaatagcagaacagtgggttttgtaagatagaaacaggacacagaacaccggcggcggggaggccacctgttggttacttcaggttgctttttcgaaagtgttagagagaacttccttattatgctggagtgtcccattttaggaggaaaataacctgctctgttttgagattgatctgtttccttacagtcttagtttgattaggtcgcatttagctcagtgacttcattttggtttggtctggtctgtcggggcctaggggagaggggctcagtgcagtgcaatggcctcccataattttgttggacaatacagtacagacagttttgtttttgacttttttcacccatcaaaatgtctgtgagattcctcgatggtgctgagtttaccagtttgtttctttttattgatgtacgtctctgtcgttttccatgtagggcactataaataacagtactttgaccgtttataaaaaattactcgtgtggatgtatgctttttttcctcttgggggaaatatccaggcctggaacttctggatcattgtgtaggtatttaattttatgataaattgtaaagcctttttctaaagtggttgtaccatttttacatgttcaccagtaatgtatgagttgcagttgctacacctatttgcctacatttagtgttgtttgtattattcaatttagccacttatagtttctgatgtcaaatgatgttgagcagcttcccatgtgctcgtgggctgtttgtagatcttcctttaggaagtgcatgttcaagccttttgctcattttatttatatatttccatttgtcttttctatcattgatgagtaggcattctttatagactctggatataaattcttgcaagatatgcattatcagaatattttctcttactctgtggctttcttattcaactcaacagtgtgtttgttctaaattaagctttttatttttattttattttgagatcattgtagactcaaatgcaattgttagaagtaatacacagagatcccgtgtacccatgtagactctcccaatggtaacatgttacaaaagtataatacggtattacagccaggacaccagcatcagggcagtcaagaccagaatatttctgtcagcacaagatccctgcattgccctttaattgtcacaccttcctcatttcccttgtccccatccctggccctggcaaaccctaatcccttctctatttctatacttttgtcatttcaagaatattatataaaaggaatcacactgtgtgtgaccttttgggatcacatttttgtcactcagcaaaattcactgcaaatttatggaggttactgcaggtatcaatagtttgttccattttattagtgagtagtaaaccgtggtgtggacatataacagtttgtataccattcaccttttgaaggacgtgggctgtatttagcttttggctgtcatgactaaagctgttacctaggaaggtttctgtgtgaacatatgtcttcatttctttgggataaatgcccaagagaacagttgctgggttgcatggtagttgcatgcttgcttttatcagaaaccaccagtctggtttccagagtgtctatagtactctgtgtagccaccagcaatgtgggactaatccacctttttttttttttttttttttttttacatcctcaccggcatctggcgttctcgctgttttttactgtagccattccgatagatgtgcagtgatatctcatggtggtttaatttgcgattctctaatcgttaatgatattgaacatcttttcatgtgctgatttgccatctgtagattctctttagtgaaatgtctgtttatatcttttgctcattttctatttggattgtttgtttcctgctactgatttctgcggattctttgtatattctagatgctagttctttttcagataatgtggtttgcctgtattttctcctaatctgtgtctgtcttctcatctctccgtagagtcttttgaagagcagaaggttttaatattgataaggtttaatttgtcatttttcttttgtgcattatgctttttatgtcaggtctaagagtctttgcctggccccacattacaaatattttctcccatttttttgaaatgttttatggttctacgtttaagttcctggtccattttgatttaatttgtatagaaggtgtgaagattaggtaaatgtttgattttttgccttctaggtattcaattgcctagcatcatttgtttaaaagtctgtccctcctccactgaatttttcacttttctcaaaagtcagttggctgccttgtgttgagtgtttgccagctctctattttatgtctttgatccctctatgaataccatactgtccttattactgtagctagatagtaactttgaaatcaggaagagtgattcctcatattattttgtaaaattgttttagatattctacttccttttttcatataaagcttagaataatcttgtatatatctataattaaatatgctggtatttggacaataattccattacacctgtgtgtctggttgcatagattttacatttttactatgttgagtctttaattctatggacatggtgtgtctcctcatttaattcagtctttttgatttctgttaccagcattttataattttcagcatacaggtcataatttctaaagtttatacctaagtatatcattctctttggagtgattgtaaatggtattatgtgtttcattttggtttctaaatgttcatcgtttatagaaatgtgattgattttgtgtgttgatcttgtatcatgtgaccttgttaaacacattagttctagaagggctgtgtgagtgtgagtgtttagcttctttgggatttcctacatagacagtaacatcatctacaaataataacaattttagttctttccttccagtatgtacatcttttatttatttttattcagtggcgagaccttcctatactatgttgaataggagtgatgagagcagacatccttgattcattaccaagtttacggaaaaatcgttttgtctttaactgtgttaagtgtgatattagatgtagtttttttttttttttttttttgagatggagtctcgccctgttgcctaggctggagtgcagcggcgcaatcttggcttactgcaagctcccgggttcacgccattctcctacctcagcctcccatgtagctgggactacaggcacccaccaccacgcccggttaattttttgtatttttagtagagacagggtttcaccgtgttagccaggatggtctcgatctcctgacctcatgatccggccatctcggcctcccaaagtgctggaattacaggcattagccaccgtgcctggccaatgtaggtttttaaaaattgatttttaaataagattgacagaactcctctctattcctaattcggtgaatagtttttaagatcatgaatgttgtattttgtcaaatgctttttctgcctcaattgatagctcacctaatttttttccttatcccattgatgtggtagattctttctttttttgttttttgaatgttgaaccagccttacatacctagaagatactctacttagttgcatatacgttattttaatacattactggatttcatttgctaatattttgttgaagatttttgggtctaagtttatgagagatactggtctatagtttacttttttgtatttgtcaagattttatatcaaggtagtaatagtcttcaagaaatgaattgggagatgtttctttctctactgttttctggacaaaattatgtacattggtgttgattcttctttaaatgtttggtagaattctccagtgaaatcaactgggtctggagaatttttattgagaagcttttaaattataaattcaatttctttaattgcttatgggactatttggactattaatatttcattttggctgaattttagtagtttgtagttttctaggaatgggtttctatcttctaagctgttaaatttgtgagcttaaagttgttcatagtattctttttttaatgacttcaatatctgcagtgataccattgttggtgttgatgatttgtgtcttctctctttttatttattttagtcttgctagaggtttatcagtttttttctcaaagatccagctttcttatcaatttatttatttatttaaattttattttattattatactttaagttttagggtacatgtgcacaacgtgcaggtttgttacatatgtatacatgtgccatgttggtgtgctgcacccattaactcgtcatttagcattaggtatatctcctaatgctatccctccccccttcccccaccccacaacagtccccagtgtgtgatgttccccttcctgtgtccatgtgttatcattgttcaattcccacctatgaatgagaacatggggtgtttggttttttgtccttgtgatattttgctgagaatgatggtttccagtttcatccatgtctctacaaaggacatgaactcatccttttttatggctgcatagtattccatggagtatatgtgccacattttcttaatccagtctatcgttgttggacatttaggttggttccaagtctttgctgttgtgaatagtgctacaataaacatacgtgtgcatgtgtctttatagcacaatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgctattctaactggtgtgagatggtatctcatagtggttttgatttgcatttatctgatggccagtgatgaggagcattttttcatgtcttttggctgcataaatgtcttcttttgagacgtgtctgttcatatgcttcgcccactttttgatggggttgtttgtttttttcttgtaaatttgtttgagttcattgtagattctggatattagccctttgttagatgagtaggttgcaaaaattttctcccattgtgtaggttccctgttcactctgatgttagtttcttttgctgtgcagaagctctttagtttaattagatcccatttgtcaattttggcttttgttgccattgcttttggtgttttagacatgaagtccttgcctgtgcctatgtcctcaatggtattgcctaggttttcttctagggtttttatagttttaggtctaacatttaagtctttaatccatcttgaattaatttttgtataaggtgtaaggaagggaatccagtttcagctttctacatatggctagccagttttcccagcaccatttattaaatagggaatcctttccccattgcttgtttttctcaggtttgtcaaagatcagatagttgtagatatacatgcagcattatttctgagggctctgttctgttccattgatctatatctctgttttggtaccagtgccatgctgttttggttactgtagccttgtagtatagtttgaagtcaggtagcgtgatgcctccagctttgttcttttggcttaggattgacttggcgatgcgggctcttttttggttccagatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcatatcccttgtaaggtggattcctaggtattttattctctttgaaggaattgtgaatgggagttcactcatgatttggctctctgtttgtctgttattggtgtataagaatgcttgtgatttttgtacattgattttgtatcctgagactttgctgaagttgcttatcagcttgaggagattttgggctgagacgatggggttttctagatatacaatcatgtcgtctgcaaacagggacaatttgacttccttttttcataattgaataccctttgtttccttctcctgcctgattgccctggccagaacttccaacactatgttgaataggagtgctgagagagggcatccctgtcttgtgcccgtttttaaagggaatgcttctagtttttgcgcattcagtatgatattggctgtgggtttgccatagatagctcttattattttgagatacgtcccatcaatacctaatttattgagagttttaacatgaatggttgttgaattttgtcaaaggccttttctgcatctattgagataatcatgtggtttttgtctttggttctgtttatatgctggattacctttattgatttgcgtatgttgaaccagccttgcatcccagggatgaagcccacttgatcatggtggataagctttttgatgtgctgctggatttcggtttgccagtattttattgaggatttttgcatcgatgttcatcaaggctattggtctaaaattctcttttttggttgtgtctctgccaggctttggtatcaggatgatgttggcctcataaaatgagttagagaggattccttctttttctattgattggaatagtttcagaaggattggtaccagctcctctttgtacctctggtagaattcggctgtgaatccatctggtccttgtattacttttctctgtccctttttactgattctgctcttacctttattattttcttccttaaatttattttcactttccttcttttgaggtaggaaggtgggttattgacttcaggctttccctctttctaatgtaagcattttagtgctatacattttcctctcaacacttctttagctgcatctcacacatattttgatatgctgtattttcattgttttgtatattttcattgttttatttattttttatttaattccagactttttctttttcttttcttttctttttttttttttttttgagacagagttttgctcttgttgcccaggctggagtgcaatggtgtgatcttggctcactgcaacctctacctcctgggttcaagtgattctgctgcctcagcctccagagtagctgggattacaggcatgtgtcactacggcaggctaattttgtatttttaggtgagacagggtttctccatgttggtcaggctggtcttgaactcccaacttctggtgatctgcccacctcggcctcccaaagtgctaggattacaggcatgagccacggtgtccagccccaaacattttttctctgacttgtttatttttaaaaattctgtcattcagtttccaggtctttggagatattcctgttgtcttttggtttttgttttctagttttattctgttaatactatggccagaggatacactctgtataaatttagttcttttaattttttttaggtttgtttactagtctaggatgttttctatcttgattaatgctctatagcacttgaggaaaaaaaaaacaagaaacacacacacacacacacactaggtgtgatgtctactgtataatgtaattgttttccaccttgtggttttggcatttgaaagaacagttaaataatccaaagggatatattgtggaattttaggctgtcaggaagtttttactgtataattctatctgtaaggagaaagcatacgtagctcagtgcttattagattgttttatggtttgaagaaataatgtttcacttaaggaaaaatattctcaaggaaaaaatgcccacagtcgtcagtgaactgctgagtctcatctacttcattgctcaggcatgtaagaccttcctgtttactaataatgttgacttttccttcttattgggaaggaagctaaagaacagcttgatggtttaaaatgatgcacctaaattattgattccattatatatttaggcagtacatttttctctcttgaataatagaaatgtcacctactatttaattttcctttttttttccagagtaattttcactatgtctgattacataattagatttgggataccaactgggtatacttggtaagaaaatgagaattaaaatgtttcagagtaaaattatttcagagcttttgcaaatctttattttagataaggtgatttctatttttaggtttgtttttgaaatagtctaggacatttaaattttaacttctgatcaaattaagttgttttggttcatttaatttgtatgtttcatgtctttgacaaaagttttttttttaattgatgattttttaagataaaatttatgatttggaatgatccaattatctaattccagatgttacttttgaaagatattaatttctaaggtgttaattttgcatttttgtgaaaataacatacacttcatgaatctaactgctaatttaacagctctgtgtggatgtctagtgggtatttcaaacatcctaagttcaacactgagctcttgttcttttcctctgagccagctccttccatcatgagttcccatttcgggaaatgacaactacatctttctggtttttctggccagaaattttggtatcatcattgattcttctttttctcttatgcttcacccttaggccccaggtctgatcaaccattgccacctttactgcaaccagtttaccaaatgaccgtcctttctcatctggattaacaagatggcctcctgagtggtctcccggcttcagcacttgtagcccagttgcatcagggttgagtgcggagtgaggtagtgaagtcagaacttatcaaacttttgctaaaatttccccattggcttccattgtcccttataagtccagggtcccataagacttcttcctcttactttttaccctcatctgtcatcccccgcactcactgcacttcatccaccctggtgtcactgctggtcttagaacacagtggactgactcccacatcagcgactttgtacttgcttttcctgctgtcaggaaacctgagtgcatgactctcttcatcagctgcttccctttcttactcagataccccgttctcaacgaggcctttttaaaacaatcttccttgttgaaaattgccacttcttccccagatttcttttttcctcttcttccttttattttttctatagcattatcattacattatataaaggtgtttctgttattattctgtatgtgtcttcctgaaaaaaaaaatctgtgaaatcataaaccaaaataacacaacttatgaaaaaagttatgtacaacactgaaaaaagtgttatgtacaaaccttcaaaaatctatggaattttgcaatcaggacactaataaagaaataatactactagtaactttcttcattgatttgctgttttgataaaaagagaaagggcttccaagatgcaccttcaacttctctcaatagtgtaatgtcatagaaagtgaagtggtttgtgaagcccctaaactggccactagtcactacctgcactacacaaaggaaggccctttttttttttagtttttaaaattgtaatttgttgtgctgctgctgctgatcatttccttttattttaaggctcacctttgggttcagtgataaagcttgttcataagcaccttagatccttaatattccagggggaaatcatacataaatcactacaacttctgtgttatacaaatatcagttcctatctctcaaccacatatgaagtaatttgaataaaagaaatatgtgcgttagtaaaaccgactatactatatattttctttgtttcctgtttatctccctaaactagaagataagctccatgaaggtgtgatcctattctgtgttcctttttcaaaattctcatttgtgttcccatttcatagacgtttactaggtatttaagaaatatttgttgaatgacagagcaaataatcaaaccaatatctagacttctctagaattctgaagtaattgaaagtatgaatgctttcttttctttaaattgaacaacttctttggcttaatagttagtgacatttaagacggtggcctgatttatgtgtgttatttagaaagccaaaagtaaatgtgttgtggatgaagttcaagatccagcattctgtaggaagatgcaatttcattctgtgacaacatgttttaataggaactaacacgtagattgtgcttttctagcaggtgctggcgtaagcattctgcacacattgggtaatttaatccttgagacaagtctagagcagcagttcccaaagtgtggttcaagaacctgtggcagaccctgagcccctttgcagggggcggccacaaggccaaaatcatttcatcagaatagacctttgtactttgtccccttgttgagcttttggcaacgatttaaaagcagtcgtgagaaaacttctggcacctgagcgcgtatcccgaggcagtggtgccaaactacaccagctggtgtgttactcatccgtgccacacacctatgagtaaaaaccaaaatctagctctctcaaaaatagccttaaagtagtaaaaattattaattctattaagctttgactcaaataaaattattaaaatattctgtgtcgaaatgtgaattacatataaactcttctgctgtacgccaaaatgtgccggttgtctcaaggcaaaggatttgggaggttgtccgagctgggagttgaactggctgcttttttgcatggcaccccatttttacttgaagtagtgactgacagaaaaactatggtaatttagacttgggtattttgcaggattttcttgaaaatgaagaaaataagcttgttgcatcaatgaaaacaactgacagtatttgtggctaaagataaaaattgagctcataagtaaaaattagcattttggaaaccttgaatatgcccaccatgagcttgacactttcgcattatttaaggaggtgtctgatgagataggtagctgtgttaatttgtgatattttttacattgtataatgaaacgtgtcaacgtttggaaggtctgcatcactcagcgaaccaggaaagacatgtgtatggataagatccattccaagtacaggacagtctgaaagatgttaatgtaacaaagcaccaaagtgtcatttatgcggtttcagagtccgcgttgcaactaacctttatgaaactgacacttgtttagttttactaaagtattaacaaaaatattcacagctgtttgaaaaggcaattaaaatactcccctcctttccagccatgtatctgggaggctgtatgttattaatatccttcaactgaaacaacatattacaagagactaaatgcagaagcaggtgtgagaatctagttgtcctttattaagctagacactggaaaaatttgaaaaagggttaaacagtgccactcttaagaatttttagttttcttttggataatatagttatttttcataaatgtcttttgtattaataatgtaatgactttgattttttaaggaattaataactttttaaagttcacaggtttactctctaatatgataaatacagaaagaaataagtcacataaacaagaatttaggtgtccttaatttttttgtatgttgcaaagggatcctgagaccaaaaactttgagaactgctgctcttgaagaagttggtgctattgctttgttgattgagaaacccagacataggggttaagtagattgtccaagatcacagagctagtcaggggagagctgggatttttctttttctttttctttttttgagacagagtctcactctgttgcccaggctggagcgcagtggtgtgatctctgctcactgcaatctctgcttcccggtttcaaacgattctcctgcctcagcctcccaagtagctgggattacaggcacgtgccaccatacccggctaattttttgtattttcagtagagatggggtttcactgtgtttgccaggatggtctcgatttcctgatcttatgatctgtccacctcagcctcccaaagtgctgggattataggcgtaagctacggtgcccagcctccccaccccccgccacccaagacagagtctcactcccttacccaggctagagtgcagtggcacgatcttggctcactgcaacctttgcctcctgggttcaagcgattctcctgcctcagactcacaggtagctgggaccacacgcacacaccatcatgcccagctaatttttgtgtttttagtagagatggggtcttgccgtgttggccagactggtctcaaactcctgacctcaggtgatccgcccacctcagcctcccaaagtgctgggatcataggcaggagccatcatacctggcatagagctgggatttgaacccagggctccaaagtacttgctctaaactcaaatcacatattattacttcttgagaaacctccatggtttgtaactttgctaaaatcaataagctttggttggacttagatgtcctttcaagttattttctcatgtaatttcttgatataaaattaaaccttcaccatgtggatatctgttacatctcagtttttatggcagtacatatttgccgtaaactcaccagcaaacagataagcaggagaaggtaaatcatatttgagattcttttcttggacctttcagttttttatttaatcagggttgatttcttaagattattcgaaagaatctttgaaagaaatattgtgccatattcaagaataatgttggttatttctgataaccttactcttattttggttggtcatactttttcactacaaaccatagaaatgacagttcagtatacttctactttgaagtaaaatattggagagctggaagcttatttcagtttggagaaacgggaattgtatttatcccactgtgtcttattaatttatatactgaaatagattagcacagtgcaagataaaactagtacataaatatagccatatatgtttctaccatcagcttcaattgtggattaatctcactggaagcttgaatggtttcttaggggaaaatattggaagggtaggtttacccccagagttcccttaaatatggtgttaatttgcattgatttcagagaaaacagagaatcagtttgacttccccactggctgactgcataggcaaactattcacagtgctgtttaatggaaatctcagggaccctcctgctttctctgttttcacatggactgactcaaatatggagaggacaccagggacaaattacttggagaaaatcccacacttgttagtcagatttttgagtacaaaatgatgactttgtggtgagatcaaggaatacgcagcacaatctttgacttgtgttagtttttttgtttgaaataagagatatattctttcaattgtagctgcctttcatcctgaaatgtctgacatttattttacaaggcagtagtagagagagataaggtaaaatacagagaagttgggtgggtaatttatttatttattttttagattgacagaagatgatggtacatctaagtatatttgaaagtctaccactgggaagtatttagaaatatttatgataagctaaagaaacaaagcctgggaatttgctgtgataatagagccaactcttttcactggagggagaattacatagtttgggaattagtatgtaccattcgtttatgtcctttttctcctttctcctcctgctcttcctcctcttgcaccgccgcctctagttcacatttaataaccaaacgacttacttgggtggtgacaaaaagggcagcctgaactgccctgtcctcactgccttttctcagcttagcagatagaggactttgtcctaaaacaatcataggtctctttttcgtgtaatgccttcttttcctctgggtagatacccaggagtgggattgctagatgaaagggtagttctactttcagttctttagggaatcttcacactgttttccatagtggtcgtgctagtttacattcctagcagcagtgtaaaagtgttcccttttcaccacgtccctgccaacatctattattttttgatttttgaaaaattatggctattgatcaggaaaatgcaaatcgaaaccacaatgctatgcctccttactccggcaaaaatggccataatgaaaaaatcaaaaaataatagatgattgtggtgatggggtgaaaagggaacacttttacactggtggtgagaatgtaaattagtacgaccatggaatactattcagctctgaaaaggagtgaaataatggcattcacagctacctggctggaactggagaccattattctaagtgaagtaactggggaatggaaaaccaaacattgtatcttctcactcctaagtgggagctaagctgtgaggatgcctaagaatgatacaatggactttggggacttgtgggaaagggtgggacgggggtgagggatacgactacacattgggtacagtgtacactgctcaggtgatgagtgtaccaaaatctcacaaatcaccactaaagaacttactcgtgtaaccaaacaccacctattccccaaacacctatggaaataaaaaaattaaaaatcctatcataggatcctcttacagcatcataatgtggacctgtctatatttgcatatttaactagagtggcacatatctagttatctatttaaacctcaccccagaagtacatttgaaaatcataattgttgtccttaaaaagattgatattactattatgaagaaagcacattgcactgtgagattaaattcctggcttcaataggtatacataatgaactgccagcagctgaaatttgaatgactacacttaccagaaaaggatcttctacccacatttctcagaatagttgttcacaaatgatacattctgccctgtgcttttgtttctccctggaatttgaaaaataaaacttttcgctcatggtaaattcataagcttggggcatgaaaatgtttgaatttgatataaaagaagttttgaaaggaagattagtggtttaaactgaaagattagtcgccctgggaaattcagctgtggcaaaagcggagttcagtaataacctgccctggctgattactccattcacactggcattctggtcctcccggctggactcgcacctgattgacggtgctgattatgatggcttaatacagctcatcgtcacttcaccgggacacgtggactttgtgggcttcacagactaccccccaccccccttgtttgtggtacagttgattcttctgctaagtggaggttgattatttctttattcattatctctttaaaatgcaggagaaaagggcaaattatcaaataggtgatgattatcctagtggaagctctcttgggcagagtcaaaagaagaacttgcagttcaacttgcttgatacctcatagttgattcctattcattctgccgttgaagggtttcagatgatacgacttaattttagctgttgtggaacagcaatgaaaatccatcgcaagaccccctttcttgatgttagggaagccgggggacgcaggatgaggtagtaggctccagctgctgcccatgtgaatgatttttcctctgcagatagatgggtcatggtccctttctagatgagcagaagattattctcacattggagaggtaacattaaatacatttacattggatctgaaaaccttaaatgtttacttagggaagtgtcatcttcacataaaattatgatgttgtgtaagccttcctttttctccacaacctctccagcacctcttattttttggcttttgagttacaggcattctaactggtagcttattttggttttgatttgcatttctctaatggtgggagtgtaaattagttcagccattgtggaagacagtgtggtgattcctcaaagacctaaagacagaaataccgtttgacccagcaattacatcactgggtatacacccagaggaatataaatcgttctattatagagacacaaagacacatatgttcccaatagcaatgacatggaatcaacccaaatacccatcaatgatagactggataaagaaaatgtggtacatatacaccatggaatactacgcagccataaaaactatgcagatcatgtcctttgcagggagatggatggagctggaggccatcattagcaaactaacacaggaacagaaaaccaaataccacatgttctcctcctataagtgggaggtaaatgatgagaacacatggacacagagaggggaacaacacacattgagtcctgttggagcgtggaggatgagagcggggagaggatcaggaagagtaacaatggatactaggcttaatacctgggtgatgaaataatctgtacaacaaacccccatagcacaagtttacctatgtaacaaacctgcacatcctgctgaacctgaacttaaaagttaaaaattatgatgttgtcttgagacaatgttaagtctattcctgtcctttgggcagaccttaaacctatattatccacacagatgagactctctctttcataaatgatttatgttctattttaagaatagaacactttctatatgaaaatggaaatttcacttttccttagtaatttattctagggtcttctaatgttcgttgttagaatacagaagtattcctaacgtctgctcattttcctgaggaagggaatgtctattattatttgaaatacacacacacccttcaaagattaatatgtgggccattggcttttccccaggtcagagttttataactttaccttagaggcaactcaatcattttctttatgaatcatttcaggatgttctctttcccatttaaagtatgtaaagatcaaatgcttttgcagggcatctgtgcagacttgaatactgatccttctttctccctttctgtccccaaagttttgtgttttgttaccttaatgccctcttttaacttgtttacctactgtatgtatttcaatggtaaatagtgctgggctcagagaagtgctattccccaccttggctaatctatgtcaaaatacgtgtcgttatgattttaatttgaacgcttaaaattccagggtgttgacatattttcccttcccttctccttataatgaatgttagtgtctgtgctaaccataattttacggccatttggatctcgagatatttgcttgccagctatatgaaaccattctttaaaatgagctttttttttcctaccagctcacagtatccagccttataatttgtacatggtataggcatgtttgtttaactataaagtccatgaaaaattgagttgtagtatcattttaattcaaatccgttgtatactatattaaaatgatgatgctctatcaatagcaaaaccaaattcagatttttgagtttctatctcgaagcttttccctttcgaaaagatgtatgttttctatgactcattcgtgtaggacactggaaccatatgaagtggcatttctttttctgttgttaaacagagtgcaaatggccagacattaataaagcctgtagctcagtaaatcccacaggatcaaagctacctccattgcagttcagctttattagactgtttgggtaataagaggagatgatttttgctgaagtacataggaaaaaggaaattggacacatggctacattcaaatttaagaatgcagttgatatacagcttaacgcatgtcagttgcagcagaagcaggcagaactcttggaacaggacaaggctcgacaactcctgactttgagttacatgtgctgtcacagcatctaacactttactgcttacattcctgcatcagacctagattataagcgcttaagggacagcgactgtgtcttacactttgtattctcaatgctgattacagaggctggtacatagcatcagtgcatgtttattgaacagaaagttgtacaagtcagagacataagaatccttcttgacatctccctctccctcacatccataaccaatctatcactgaatctttttcccacctaactattgctttaaagcggatcactgcagtggcctctggactggtgtcctcccactattccacgccctctttttttccttctcacattacagccagaatgttcttttaacaacacaatcacacaacctcttcaaaggctttttgctgtctttttttttttttctgagacagggtcttggtctgtcacccacactgccaggctggagtgcagtggcacaatcacggctcactgcagccttgacttccttgggtcaagtaatccctccacctcagcttccttagtagctgggactgcaggtgtatatcaccacactggctaattttttaaaaaactttttgtggagatggggtctcactgtgttgtccaagctggtcttgcactcgagctcaagcaatccttccgcctcagcctcccaaagtgttgggattataggcataagccaccacaactggctgtccttttgtagtaagagctaatcatcatcatcatcatcattatcatattgacagtactttttacaaggttataaatagggtgatcacacacgttgttaatactcggacacttgaatgtgaggtgggcagcatggacagtcacgcaacgatgaggtgggaaccagaacacgtgtggccctgcctgcaaggccctgcacaacctggccctgctcatcccacttccagtcactctctttgcacctgcagaaagtcttgctgttcactctttcgtactgcccaagggtactcgccatgtttgctcccaccagagggcctgcttaacggtttggagtgctgccaacacttttgttctcagctcctgcatttcatctcatcgactaggttaaatctcctactgtaagttcttgccgtactcatagatgcaatttaatatttatttatttgaatgaataaatgaataaatacttgtgagaggttggtaatattgtattactaatataccaattatgatggaatatagtgatcaacaaaatgacaaaataacctatgtatttatatttaaattctatatattcagtttatacactatagtttaatgtgcaactagtttcagtgttaacatttctaatgtgctacttgatgtttattaaatgtacagtagtttataagaacagcttagtaatgtcacaaataaattaccaaaaatttaaagttgagtatgacttcttgaaaagaaattttccgtattaaggaaatatgtgacatttggagtcaaaatatatagaattggtagattctggagctagattatctggatttaaatcatgacttcactgcctactgactgggtagcattgagcaagttatttaacttctccatgcttctgtttattcattcttaaaatgggtataatgatgacatctatgttatagggcttttgtgagaaataggttaatatatatataaggcatttagaatggtttccagcacaaagtaaataataaatactagctattgctgatattagtgttattatatttattcattcaacagatatttattagctatccccttagttcctggcattgttctaggtgctaggaattcagaagtgatcaagactaatgtactgtagagtaacctacaaacactttaatttcagtatctgataactattgtaaatggaataaacataatgacttgttagagcatattgtgcaggaggagctttagttaacctgaaggatgagcaaagatgagcatgcacagagcatcctaggtagaggaaagaccaagtgggaaggccccacagtaggtgtctcactccgttttctgctgctgtaacagactgggtgattcaaaaatgatggaagtatatttgactcttggttctagaggctggacagttcaacaacatggcagttcatctggggaggccctttgtgctatatcatcctgtcatggaagtcagaaggtcaagggagtgcatgagacagaggatgggggcccaacttaccctttttattaggacccctctcccttgataactaactccctcccacagtatcagcattaatccattcctgaaggtagagcctgcatgacctaatcatatcctcaaggtcctgcctcttattactgttagaatggccatcacatttcatcatgagttttggaggggacattcagaccgtaactctaggaaagagcttggcttgggtttaaatgtgcaagaagtgaagtgtgcctggagtgctcggtgtgagcagagaggggaggaggcctgaatgaaagttagaaagctgattatgcaggtggatcttggggacttttgtagaaaaatgacgagtcatataatcctgtttattttgctgataaagaaacaaaaacctgtaagtcctgatgaggatcaggtagctaattagtgatgctacagctagaagccaagtgtgctgcatccatattaaaaaatgttattgaaacagatctacaaaacattgacaaatcatatctagtattctctccattttcacaaagtaaatgtacctttgtaaccacatcaggaaataaattttgacctgcttttcataagccatcccattaccttcacccccgtcgctatcccatccctcagaggtaacccttatccttaacctctgacaccatagattagttttatctggctgtgaacttttatgaacttttgaatagtagcacatgctataagcttttttgaaaattctgtctggcttctttcactcggcttgatgtgtgtgggatttacctgtgttgctatgtgtagcaattgttgctgcattctcgctgcagtgcgctgttccattatgtgaatataccatgagtttcctgtgttgtatcccattgaaagtcaccaggagagaccatttccacgtgtgtatgaaaggaaagctaggttgcgattcatgtcgtttatgtatgtatgtcaatcttgcttatcttacttttttaaaaccaattgaaggttatagaggaaacttctcttttatagcctgcatacacttgactgttttctcgcaaatagattgcctagttaaaaccaaaagcttgtatgtacagggattgtccgatatgtcccttcaataagctattaaccataagtggaaataacttggatgaacctgtcagatgctttcaaatgcgggtatcattgagctttcagctttttgaaatattatctggggtattgcatgtttccagggtttggtaaaggattatttacttcttaattgggccaaacagccatcactttcattttaatattacgtttgtttaaataatagatttattaaattagatgagtgccactttcatgcgtacttcagttttgttttgttttgttttttaatatttcagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtaattgatcgcttgaaaaaataagatcccatttcagttgatgtgtttggaatacttgccttactggtcataatagcacaatgagtgaaaatattggattgaatttctaatgcattcaagattaaaggaatagatttgaatatgtaattagaatgtgatttactattctgatataggttgtacttacacctaggaagtctatcattatatttgtaaaagtaagcccattagtgaaattatcagtcaacaaaaacctatggttacagagcaatgccaataacagctttggtatgatacatttactttccaagggcaacagccctacccacaagtattgctcctgtctaggcacaaatgtttaaacagatctttagtatggtagcttctggagctctgagtagtcagcaaaagtctttcctagctgttttcaagtggagatagggatggatggaatcatggagaatgggcatgcatacagcctgtatattcagcagcaataaaacagtatatattgaagtcctgccatgtgcccagcactgtgccagtcaccagggatctgatgcactggggtggacatgatgtggggacagagggcctgaacctgtggcagagcacaagatcagggtaagactgaggtgtagattcacctggaggcagtagcacagcctttggagcctcagggtcttaccacgcttcagagctttccaggggtatacttttgaggatgataatattacatgctgcagttctgtgcaggatggagaactagcatgccagaaaagtccaggaggcctcaccatcagcaaatcagcaaaatcatcgctgccatgcttttctttagatgaaataagaaagagtgggctgtatagaggcattttaagtggaataacaagcttctcaaatggggaatagcccacccactcactctctttacctctgaggttgtgatacggtggtccgtggaaccacactcagcctgcccagaatttatgtgtgtgtcagttgtctgtgtgtttgtattttaaaaatcaattaaaaaaaatatgagaatgcttacagcattttttttttttttaatttgagacggagtttcactcttgttgcccaggctggagtgcagtggcgcgatcttggctcactgcaacctccaccttctgggttcaaatgattctcctgcctcagcctcccaagtagctggttctacaggcgtgagccaccacacctggctaatttttgtatttttagtagagatggggtttcaccatgttgaccaggcttgtctcaaactcctgacctcaggtgatctgcctgccttggcctgccagattgctgggattacaggtgtgagccacagcatatttttttattagctgccaacatttgacagttctaagattttctgtaaaaaccttgcttcccagcctctgcagaccagtcagaaggcctggctgcctggtctgcagccccaatcaggagcaggcggctgagcagagctgcccccatcaaaggcatggacactccctggttctcctcggtgctctctggcagccccgtcccttgtagcacctcacttgctctccccattcccattacccacccacactttagacaagtgagtgtgtgactgcttacattattgggcctaccctgttggaggatctacactcgaggaaaagtttatcatagtagatcatagcatgttgaaatcaaacagtcctgaatcctaggactggcagaattcagctccaccacacctgagcaatggtgttataactttaggcaggtgacccatgagccctcccctcccgtaagtgaaaagagagtgacgtaagcgtttgcaaaatgggaaagatccctcctcatttgcagtgttgtgagcattgaaggctctagtgatcgtaggcagcattatacattattaccatgtgacattgtaaggctcagtttgttagaaggggtgtaagaaagcagaaacagaaaaagtgaacttagagttgagaaccatgtttgagtagtgactgataacagaagactggagttcagggacttgctcttcaacttaccggtgtgactttggacaagttatctaatgttgatctttttccattggaaaaatgagtacagtaaggcccacatcaccctcatttttatgagagttctcttaaaaattaaattacatagtgctttgtatgccccagaaagaaaggaatggagtttcaaagaacccagattgttcttcctaataagaagtaggcatgatgtggacagtgtgtgacagtggcctggtggccaggctacacgccttggatggcgggaaaggaattgtttcctagatcttcagtttccacatggatgttttctgaaactgaattccccaagaacaggcctttgtgtaggcaccaagccatttctcttttccgaccacctgtaatagtggtttctcctccatcccaggagaaagcgcacctgtaccttatctgagtcttcctgtggaactctctctggggggtgcaagagtaagacagagtaatatcaaagttcccactattaaagaattcttttgatttttaaatggataatatgggtctcaaactattatttgcaaatcgttgaatatacagagggtccccaacttacgatggttcaacttaacaattttttgactttacgcagttgagaaacccttctgttttttactttatagtatttaataagtcacatgagatattcaacagtttattataaagcaggctttgtgttggatgattttgcccatttgtaggctgatattagtgttcggagcatgcttaatataggctaggctaaaccgtggtgtctatgagggtaggtatgttaaatgcatttttgacctagggtattttcaacatacgctaagtttattgggacataacaccttcataaggctagcagcatttcaatttaaaacaattttgtaggcccggcgcagtggctcacacctgtaatctcagcactttgggagggtgaggcaggcggatcatttgaggtcaggagttcgacaccaccagcctggcaaacatggtgaaaccccatctctactaaaaatacaaaaattagccaggcatggtggcgcatgcctgtaatcccagctacttgggaggctgaggcaggagaatcgcttgagcccaggaggcagaggttgcagtgagccaggatcgcaccactgcactccagcctgggctacagagtgagactccatctccaaaaacaaaattttaaaaaaatggtgtaacggctttattttaaatgccaaagtgtacaaaaaactgttatatatgcaacctttcagaattataagacaacttgcagtcaacttaaaactgcaggaagaggtggaacactctttgtattcttaagagcccttgcatatgtatttgttcattggaaacacaagaagacaaaacgttgttggttgtattgaagcaagattgagggagtgactcgttatatgtggactattaaaataagctatgtgcttcactactatgacatgggaaacgtaaggaggaatgggtgattctgaagcaagaattgtttggggtatttgtgataaattatattatgttccacgagggcctcagacacttagatgggttatcaggaatctatcatagcttgcttttttttttccccatgatataaaacctgtctaaaaatctcatactattttttcaaattactctttcatctacttccttccagtaagcatgttcatttatcatatgttagccttcatgagacctttgtaagtttcaaatgaaaaaaacatggatactttatgaaaaaggtagttgtttcccaccttaacaggacccttatttttccccactttggtgtcagttatgaaaatgctaaccctgtaaagagcaaatactacacatttactttttctagctttgacttaaaataacattttctttgctgtgtgcgttacacactgcacagtgaatttcaagtgttgtatttcttttttttttttttttttttgatgtggaatctcactctgttgcccaggctgatgtgcagtggagcgatctcggctcactgcaaccttcgtctcctggtctcaagcgattgtcagcctcctgcgtagctgggactacaggcatgtgtcaccacgcctggctaatttttttattattagtagagaaggggtttcaccatgatggccaggctggtctcacactcctgacctcaagtgatctgcctgtctcagcctcccaaagtgctgggattacaggtgtgagccgctgcacccggcctcaaatgttacatttcatattgatgctcatgtctacattttggtggcacaggtgactacattagcaagttgacggtaattcagcaattaaactaagtttgcatagatatcttaggtggatttgtattctttccagaaagcatttagtctaaattattttctactttggaatgaaaaaatcttttctaattatattcaacatatacatacacctaagccgagaatttcttaatgctaggcacaatatttattattgtaacagaaggaataattgtatactctaaactcctaaaaattttatagttttcttatgtaacctgcctctgtggttcaatttctatgacaatataaaaatagaaatttgatggatgtttattcttgctttattccagggaaaataagaatggttaagggaaaggttatttttttcttttgttttataaaaaggcaaacatttcacagtatcaataaaaattatgaaatacctgggaataagttttataagaaatgagtagaacccacgtggaaagtgcgtaatgagatataaaagatgatacttatgtaggaaacccacttgctataaaaattacagttcctttgaagccatcatagaattttagcctaacatcagtagaacttttcagaaagctaatatcaatagctgattttattttgctgagatagggtctcactctgttgcccaggctggagtgcaagtggcctgatcatggcttacttcagattcagcctcctgggctcaagcagtcctcctgcctcagcctctcaagtagctgggaccatgggacccaccagcacacctggctaagttttctattttttgtgcagatggggttgcactgtgttgcctaggctggtctcaaactcctggcctcaagtgatctgccagccttgacctcccaaagtactgggattacaggtgtaagccaccacacctggcctggatattttaataaaaaatgccaatgggattttctggggaagtaactgatgaagtttttctaaagctcatctagaaatgtaaacagaagaataccaacaaattttcacaacattaagtgaataatggggaggaacttttttttctaaaacccaaggcatattagaatgccataataagtaacatgttaatagtataaaattaaacaatatgccagaggagcattttgaaccagaccattatatttataaaaaatatatgatcaaggccaggcatggtggctcacacctgtaatcccagcactttgggaggccgagggaggcgcatcacctgaggtcaggagtttgagaccagcctgaccaacatggagaaaccccatctctactaaaaatacaaaattagctggttgtcgtggtgcatgcctgtaatcccagctactcgggaggcaggagaatcccttgaacccgggaggcggaggttgcagtaagccaagatcatgccattgcactccagcctgggcaacaagagcaaaactctgtctcaaaaataaaaattaaattatatatatattcaaatgagttctcaaaccaatgctaaaaacaactttttgcaaacattcaaaatagatcctcattaaacatcaaaataaattttagatacaatgaacaattaaatataaaaaaatggaaacataaacaaagggaatatttgaatgatctcagattataccaggagaaagtacaaaagcattgagaaacttcatcagaaaccgatcacagataaatttacaaatatttacaagttttgtataaaagatacaaaatttttaattgcccatttgcttaatcttataagttaaaaggtaagcaacaaactgggacaatatttgcaacaaatcagacagttctgtctctaataacttgggatctcctgatgacagtggtggagacaaagcttggctctccttctttgtttgtgaatgtcatcccaggaagcaggtgtaaaggcaggggaatgaagcagggaggaaggaagcaccagtgcagggatcccttatcaagttggcagtcactctaagtggctggagctcaatcttgtttgcaacgtctatggagtcttatgaaatgcatctcagaagtgcccactctaatgggtgaaagaggaaattatttatcagctcctgtacttggctgataaatatgggtcccatggttattagccttcatttctaattagctcaagcattggtaagcagctaaacctgctggctgtggtgccagagaatccccaggacaggaagcaagaaataggaggcatgggttgaggcaaagtgatgccagctgcgccaccataaagctactcagggctgcctggaagtgttgaccacagcagcagctcaagtaaaaggtagagccagaaggatttttctttctttcttttctttctttttttttttttttttgagggagagggtctcactctgtcacccaggctggactgtagtagtgtaatcatagctcattgcagcctggaactcctagactgaagtgatccttctgcaccagcctccctagtagctgggatcacaaatgggtgccaccacaactagctatttttttttttttagacacagggtcttgctatgttgcccagcctagtcttgaactcctggtctcaagcagtcctcctgccttggtctcccaaagtgctgaggttacaggtgtgagccaccacttccagaccgaaaggatttttaaaatagagagtaagaggacaaaattgagtctattccttgaacccctcagtgtaacttgtacctgctgttaagtctaattcatgaaagagtcccttctaagaagatagtcagctatagtttctaacaaggactttattcaagagagttagtagaacaagctatttttcttactggaccaagtctcaaggctataattggtatttatgttctcctgcccattttaggtatgcataactctcagcctgctcttcagctagtcgaatttgcttggtgctgggtggcccaggccctcatctcaccttttagttgccttgcctttgtagggccatggattctctaattacaactggtcttgcgagtactaagagataccccattgacttctctcctcctcacctctgctgtgtggcaccagccctagtgtcttagagtgattagagtcatttacctccatcagtgtagtaacgcctttctttttcaccagcccactggcatgaagttcacaaagtgagtaggatgaattagagtcaaattctctgggtccctttttcttctataggaaatctcccccactgagaactcagatctgtaatccaaaagagcctaaagttgggaaaaaaacaaatagatggccagaataggggccaatcatatcttgacctcaggttcaacaatttttttttttttattttgagacggggtcttgctttgttgcccacgctggagtacagtggcacagtcatagttcattgcagcctcgacctcccgggctcagttcatactcccacctcagcttcccacgtagctaggggtacaggcacacaccaccatgcccagctaattcttttatttttctgtagacacagggtttcactatgttgccgaggctcgtctcaaactcctgggctcaaatgattcacccagcttgtcctccccaagtgctgagattacaggcgtgagctgccatgtccagccaacactaccaggcattgttccgaatcctattatcctattagtgtggctacttccaggtgatgtaatagctactaggactaccggatcctctggggaaagtgcctgttttcatacctccttcaataagtacaatgagtccctgatctgggacaattctgtgcaggctgccacgtgtataggaggtattcatgcttccagattgcggtgctggcctagtcaatgagcagagaaggcagatccatatccagaggagatcctgagtttgattaggaagagtcactgcatgtttccgtggtagaaaggtcaaatataagcatccagtcccaagtggccagcttgaagaattgtgtcgcactgagggctcagcatcagtctctgccgttgccacgtttggcatctggcattggcaaaagctagattagctttggtgaggaggagctgttgcttttggattcattcatagcctcagtccttgccaacatgaccgattgatgtcccattttattagttgagaagaaatctaaatgacacccacagttgagtcatcctcttcaactgatcgatgagtgccttatctgaagtggatgctctctagtgatataaaaaatccacatattacacccacccccattgggctatttacatatgactttcttgtttctgaatttccagtcctgtttctcccaggcctctttcccatcagccaagccatttgttactgcccaagtgtctctttatatccattctcaagccatttctttctcaaatctctccctattcaaagttaaggaccaaaggtactacttgcagctccgtctgcttggaaggctcttccttaactgcgctccctttggccacgcatgagtaaggccatagtgtgacatcttcattttccggatcaagttgactcatgtataatcccaggcctgagtgtttaactgttctatcaattggtgaggcctgtgtataactgagacagtagtcttactcttgtggctacatagttctgttaataattccctcataatgcttatctccagttgcatattttctttctttcaagatagaatcttgctctgttgcttaggctagagtatatatatatgtatatacaaaatatatatattttgtagagatgggatctcactgtgttcccaggctggcatattttcttaatacctatggggtcaggacttcagtttgtcctaaggacatcagtgtatgtagttcccttctgcagaaggcatgatcttattccaggaccttatggatgcatgtttgactcttctttggggctactagagactccccacaacatccttatccacaacagatatctctggcaacattctatatgctgggatacgtggcttatgtgaaagggcagcttctagaactattgtctaattctatggctgagtcctgtcttcctctttgtctccctaaaaactggcaacctgggtcaagataaagtaactgggatctgatttactgcctcatttgaaacaactgtaaaactggacaaaaatatgaacagttgttttcaagacattggatatcaggcagtgaaagattgtgatcgctgagagatggaagacaaacaaggtgagccctatgtttgccctctgcttactgccttgaggggatttctaggctgtggcacagagaaggaaaacccaggcagaacctagaggaccttctgagttgaagagagctgagagtttggaaagatcaaggcagctagatttcttagggcagggtactggataagagagcactacaggccaagcgcagtggctcacacctataatcccagcactttgggaggcggagacgggcagatcacgaggtcaggtgattgagaccatcctggctaacatggtgaaaccccgtctctactaaaaatgcaaaaaaaaaaaaaaattagccgggcatggtggcgggcgcctgtagtcccatctactcgggaggctgaggcaggagaatggtgtgaacccaggaggcagagcttgcagtgagctgagatctcgccactgcactccagcctgggagacagtacaattctcagtctcaaaaaaaaaaagaaaaaaaagaaaaaaaagaaaaaagcactacacagagaaagaatgctggaatcctccagagggtccccctttaatatttggcagaatattcgtcagcacattcatgtgagaaaactaccccaggcaagggaaaggactatccaagaagattagaggcaatagttccctgtgcttacacaggactcggcggagtgtctgttctcaccagccaaatcgtaaaacctcatattcatgagtttatcagatagcctgcacagaggtgtcttgggtcaggagaatgattagccctagaccaaatactgctctggttctgcctaacaagtcttgaaaagcaagatccaaaaggatcaaactgttgctcaatatcttcacagtatcagagaacaaagttaatgaatatttataggaatgcaaaaatttccagtacccaacaagggaaaattcacagtgtctagaatctaatcaaagatcatcaagcatatgcagatgcaggaaagcatgacccataatcaggagagaaatcagttgattgaaaccaagccagaactgacacagttattagagttaacagagaaagataatgaaacagttataactgtattgcatatgatcaaagtagagacacgaaaaacacaaaaaaggcagaaatctaacttataaggatgaaaactataatgtgtgagataaacattggatgggaccatcaggaaactagacatcacagaagaagatattaataaagctatagtgatagaactatccaaaataaaaggcagatagaaaaaaaatcaaacataatgaaaagggcacaaatgagttgtgggaaagcttcagatggcctaatagatgtgtagttggaatcccccaaggaggcagtcagaggaaaaatatttgaagaaataattttttcaaatttgcaaatcccaattactggagttaccagccagtgcaataaggcaagaaaaagaaataaaaggcatccagattgtaaagaaagaagtaaaactgtattttcaagttacatgatcatttatgtagaaaatatatacttttaaaaagctgctgataagtgagtttagcaacattacaagatagaagatcaacatataagaattaattatatttctgtgtactagcaaacaaatctgaaaattacatatttaaaaatttaaggtaggatgggcatggtggtgcatgcctataatcccagttagttgggaggttgaggcaggagaatcccttgaacccaggaggcagagattgcagtgagccgagattgtgccattgccctccagcttgggtgacagagcaagactccatctcaagaagaaaaaaatttaagatagtacaaaaaaatctgaagtaaggataaatctgacacagggtctgtaaggtctttacactgaaaactacaaaacaatgctgaaagagagaagaaaaagaagacctaaatcaatgggcagatacactgtgtttatatatctgaaggcttagtattattaacagatccattttttccaaacttatcccttggtgatattctttaggcccgagaccctgagacaaattacataactaaaatctaaaattcatcactaagctgtggggaagatttctctacaagatttttttttgtttttggagacagggtgtcactttgttgcccaggttggagtgcagtggtgcaatggttcactccagcttctgccaccccagctcaagtgatccccccatctcagcctcccaagtagcttgggactacaggcacatgctgccacgcctggttaatttttgtatttttaatacagacagggtttcaccatgttgcccaggctggtctcgaacttctgggctcaagcgatccacccaccttggcctcccaaagtgctgggattacagatgtgagccaccacactcagcttctaatgctttctgttttattttcttttaatctattgagctctctctgtactcaccaagaagaaagtctattatatttaattgagaactcttttctcagttggtttcctcatcacccaacctaattgtgtgtaactcccatctacatcttcgtgaaaagggcttaatttctctagttgtccatcttgatgttcagctttcattttcctaaacttggtttatgtcagctctctttttctagttaactcctctttgctcctgtcctctatgaattgcctagctttcaacagcaaggacagcaggtgctatcttatttaatttagatccataatattaatgcggtgtgacctcatgttcatattctccccacaaagttgagtgtttttgtatttctggcttcagtttgactgctttttggaactctgtatggtcataacagatatgaatgtttatggagaatctctgaggcagaattagcattaggctttttaaggttctcattggtaaatgatttggatttagataattattggttctttgtttagggatcattgtggaagctaagtgaagaccttgccagaattgaccaaactactctgtaacataattcattgttgacaaatactcccgagtgagacaagtgggagcttttaaaatttatatttttaatttgcttatgcttataatgtttaatagagtggtttaggtcttttttccattatgcgttggaatggatttttttgattatgtagaaactaacatttgccttcatactttaatccttgatataatggtccccaacttttatgttcatagagaacctggcattataaagaattaagtcaacagacatgcaataaaagatttttatccctaagaaaaggcaatgtcctctttcctgaaggttttctgaaattccttttttaccgacttgagagagcaattaatgctcacagtagatttgacagacggttctagtcatctgtgcttcactaaatatggattgcacattttctgcccctgatttaataaggaaaagtaggaatgaatgacgaatgcataatccccaaagcattgtttattttagagaaaatcacataaacgggaatcccagaggaggagtcttgggaacatttcaacattaattcttaggtctttggattggctttcataactattaatgaagataaagtttaaatgtagtcattcatggtatggcatcaataaaaagttatcgaagattaacatctaattgataccaggagagcttatattcattcaccagatttatattcccaaaaccagtgctacagattccatagaccctcccacacagggacctgtttattgcccttctcaagttaatatgaattttgaaataaataatacacagattaaataacttttacaaatattgtgttccctttgtatagcttccatcgttaccatactgtttaatttaacttcatattgattacttcaattgttttgaaagaactaaaaacataacctcagcttgcctgatgcctagggcctattagtgagctgtatacaccatcaaagtcacatatatatctctctcttaacaaatttcagtttgaattgtccttgtgtttttctgagacagcttgttatggcacagtctgggtttttcatttcattattttgctttaggagaaaacctgctatagactcatcccactttggattttttaaatttcatgtagaaaacttacaaaaataaaattgaaaacaattatttatcatgccattccaaaaagagaattgatgtatttccaagaaggacataaatggcttacagttatttttaccttaacccatatttttttttcattttaaggataagaataggctttggtccaaggtatgaaagcttattatagaacttggttgcttattttcatggaaaatagatattttcataccagcataaaaattaaagttgtggagaatagtcttatctaaagtgacataaaatggatattgacagtccccccaccactgaaagagaaaaatcttacatctaattttaacaaatatgcagatttttttcttatgaatcaaattaagttccctgaccacctaggggaagtataaatgttctcctctgcactgacgctgtggttttggcctgtaacaggtagattcggtcatatcatctggcagtgcttggaaaggactgctgaacagtattctaaaatagtattttgttagatgttttctaaaattttagtggctcatactcaagagaacttcttataacaggtaaatgtgtcccagtttaaggggattctttatcttcccatgatttttagtggtttaccaagagccatgtttttttgtttattttttcttttttcataaaaaaagaaatgattctacgatatattatttaggttttgctatgaccgtggtgagcacctagtaactttagaatatatttcagccaaaattattttggctatgttctagggtgtggaattttgaagggttctaaaaccacagaaaccaactttctcttgtgtgagctgttgcatggatggatattggggtgcccttagaatcagcctggagattgggcaggaacagagtgagccacagtcactctggaactggtcctctgagggtcctgctgctggccccaccaaatactggccatcactgcttgagccactgccctagttggcactggacactcccctactcccctggactagggctccactgtgcccccaccaccgctgctgtcagatgagttctcctttagccctcttcctgggcatcaccaaccccagatttaaaaatccagagcaaatgtgtctaattggccatgctgtgtctcagagctggtacctgtagaggcaggtgagtggtctgggaatatccagatgtggtcttttcagcctttaatttgagataagccccatctccacaaaagctcatagggtggcagattctccaaatacagggaagtggttcagatcctaggtagactgaaaatgtcagatgactagtcccagcagttgttcctgggctgagatggacccgatgctgcctcataaagaaattctagggttggtccagtggtccactcagagatgcaggtcacaactgaggctttctcctattagcagaaatggacatttaagcctttggtttttgtttggattttgtgttttattttctttgccattcctgataatgaactggtcctggaaaacactgtgttagttgagtagaattctgccttgatagagtgaatgcaaacattccctgctgtgttgatttgaaataggaacaggcattttctatactttagtggcatatggtgctaagattttatcatactttcttataaagagccaggaaactttgcctgcttaaaaatgtgtgtttataaacaatagacttacaatgaatattcccatctgttaggtgaacataatttgtgtaggaattcccataataggtggaggactttgcaactttcttcatattttttccttggtgagacattagactaaagagatggtacaaaacagcatatgcttaatattcaattttgtctctatttctgcttcttgtttgaaagcagttctatttttgggcgttagtacggaggattactatagaaattcataagaatttaagacctatttaggtattgaaaaacaggaaaaagtagaatgagcaatcatataaatatggttatgttgcagtgataaaactgtctttgtaatgtttcaaatacatactgcaattacttgtgctatttcttcccaaaaacttttgttgactttgttttaagctaatctcacagctcccctctgttgtaatcacagcatgtaataatcaaagccgcacatactcctggtctggatttgtaatttaaataaatggcattggctctttgcattcaatttgacattattgtgattgtattcaataattaattttgttttagatgaaccattccacataaaagaataaaaattttaagattaaaactcaacaatattttttctctttataaaagattttattaatccttccctaggagctcaagaagattatcagaggggaaaacatagtttgattaatttttgtttaatcttgaattacctgtgttgtccaaatgttttagtcgcttaaaattatgcctatcagttcctttttcaggttgcctaattgtgcatacttgaataaaaacatgagcaattagttgaatataagtgattcaagatatgcttgggaactgagcaaatacagcgtagcatacactttgtcttttactcgattttgaaaaagtttctctggttatactttgtaaaaggaaatacttttaaattgtggacaagtattactggaacatctttttgggtgggtaaagtgtaccgtcactctgttttcttctcccctttttggaaaatagtcttttcctatttgagctccttttcttttcttttttcttgagacaggatctggctctgtcacccaggctggagtgcagtggcacgattttggctcactgcaacctccacctcccggggtcaggtgatcttcccacctcagcccctaagtggctgggattacaggctcacaccaccacacttggctaatttttgtattttttgtagagagacggttctgccatattgcccaggctggttccttttctttcttacggtagacaccttcccatatgtgaaaagcatccaatcctcatgtcttactcttttgttttttgttcaaatatgatgtaccttattcaactgcaatgtgcatatattcatttttattttttaatacgatcaacatagaaaaagctgtacatatctaatgtatacagcttgatgagttgggagataattatacgcccatgaaactttcaccactatatgtggcataaatctctccatcacctccagaagtttcctcctgccctcttcattattatttttgtgtgataaaaacacataaaacttaccctcttagtaaactttaaaatatgtgatacagtatgattcctgtaaatgctatgctgcacagaagctctgcaggactcactcatctcatatggctgaaacttcctgcccttggattcctccccgcttcccctcccctgtacccactagtggccaccatttcacactctgcttctatgaactggactattttacattcctcttataagtggtatcaggtaggatttgttcttctgtgtctggtttacttcacttagatgaacctgcatgacgtcatgctatgtagcaaatgccaggatttccttctttttaagactgaataatattccatcgtgtgtatacaccaccttttctttcgccattcctcagcagactcctgggttgtttccatctcttggctaattgtggataatgctgcagtagacgtgggagggcagacatctgagattcttctttcagttcttgggaaatatactcagaagtgggatttgggggtcatgtggtcattgtgtgtgtaattttgtaagaaacaatttttccatagtggctacaccaacttacattcccatgtacagtagttcctttttctccacgttgtcagcaacatgtgtttttcatttttcgatagtagccatcctaacaggagtaagatgacatctcattatggtttgggtttgcatttccctgatgattagggacattgagctctttttcatatacctgttgaccatttctgtggctttggagaaatgtctgtctagtatctttgccttattaaaattaagttgtttttttaagcttttttttcctgatgcagagagagagagagagagagagtgcgtgcgcgcgtgtgtgtgtgtgtgtgtgtgtgtgttttgagagagtgtcttgctctgtcacccaggctggagtgcagtggtgcaatcttagttcactgcaacctccgcctcccgagttcaagtgattctcctgtttcagccccccaggtagctgggattacaggcgtgtgccaccacacctgctaatttttgtatttttagtacagactgggtttcaccatgttggctaagctggtgtcaaactcctggcctcaagtgatctgcctgcctcggcctcccaaattgctgggattacaggcaagagccaccacgtctggcctctcctgtattttggatattagctcttagctatatagtttgctcacaccttactcttaatttgtctgtgaacgtggctgagaactcaattactctaccatcttgggcagcttagaagttgtgggctccggagttgtaagacgcatttcgagtggcggttggttacctatctttacttgctggtggattttaaaacatcctaatttacaaaaccagcagtaaacctaaggcaaggcttttatagaaactgtatcttttaattatttttttcctttgaaattgtactaaaaaatttagacaggcatggatttgaaggatgattacttacagttacagaagtggaaaatccaaaggaaatgactttttaacctctgaaaaagtttttaaagttaacatcagggaatacgtggagaagtaaggaaaggaagtgaatacattgtgctgagagatgtccacattggtgactggagagagacgccctgatggcattgctttctctgccttgacgagttctgtatctcatcctgaaagtgttgtttgcctcttcctgtggagtgacacaagacatcgtgttaagactgttgccagttctaggaatctttggaaattctgatgttctacagagagagaattataaacgatttttgattgagagggctagtttaaatgcagtgacttttaattatataacctttctcattcaaccagttgtgagttatatctcctgtgtgcatggcactgtgctagataccatggttacagtgatgaataagacagaagtagatcctagctttgggtgatatttaaagcccagttggggagacaggtatcagtgcgataatctcagaaataaagaaataccatttgacccagccatcccattactgggtatatacccaaaggattataaatcatgctgctataaagacacgtgcacacgtatgtttattgtggcactattcacaatagcaaagacttggaaccaacccaaatgtcccacagtgatagagtggactaagaaaatgtggcacatatacaccatggaatactatgcagccataaaaaatgatgagttcatgtcctttgtagggacatggatgaagctggaaaccatcattctcagcaaactaacacaaggacaaaaaaccaaacaccgcatgttctcactcataggtgggaattgaacagtgagaaaacatggacacaggaagggaaacatcacacaccggggcctgttgtggggtggggggaggggggagggatagcattaggagatatacctaatgctaaatgacgagttaatgggtgcagcacaccagcatggcacatgtatacatatgtaactaacctgcacgttgtgcacatgtaccctaaaacttaaagtataataataataaaatttaaaaaaaaaaagaaataaatggtggttctagttagtgtcatggttagggaaggattgcacagatactaggttaccaaaaataaaatatttgttgagcatatactagatgagatgccagtgctgtttgataaaatagcatctgatggttagatataaccatgaaacactggatataagcattaacacttctttttgctattcaacaggtacattattccatctttgcagaagctcgatgctgggttttaccgctgcgtggtgcgaaacagaatgggagcactcctgcaaagaaaatcagaagttcaagtcgcatgtatgtgtacagtaaggagatgtccaaatgttaaagaacaaagtgtcgctggggagtcaatcagaatcacttttcaccattgtaggaactgagagtttatctttggttctattttgagtagaataattgcaaaactcagtgagagataagtaagcagccagcgtggctggccaggtgaggggctgttgaggcaaagggcacttttcttcatttgaaaagactcaggaccctaagaggccctggggaggacgaaaaagtgaatggggtgccttctgttttaggaatcagctgctcttagcttgtactatgtttggattcaaaatgtttttaaagtataaagttcaacccaattaggtcaaagttcgtcattgtcagttctttccagtgacgatttgtttagaaatcatgctgcaccacaaaaggtacatggatagtgagcgtccccgatggcattcatgtgatagtgatttattaattctttattcagcagatccattttggagaacgaaacttttaaaagtaaacaaaggagatatcaagaatgcaggaagcttaaattttcatgtagtcttgaggagaaacaggagagcgaacttggcctatgaaagtatttagtcctttttctaattcaaaatctatgaagagtaaaaatggactgtctgctttattttatgtacatatgtgtatatataatagagacataacatatataattatatgtcatatatatgttatatatataaataaatatatgtttgagatagggtctatctctgtctctcaggctggagtgcagtggcacaaacatagctcactgcaagcttgaactgggctcaagtgatcctccctcctcagcctcccgagtagctaggaccacaggtgtgtgccaccatgcctggctaatctggctaatttcttttgtttttggtaggggagggatcgcactgcattgcccaggttggtctctaatgcctggcctcaagtgatcctcctgctccatccagccttccaaagtgctgggattacaagagtgagcttggcttgttttactatattttgaatgtattaccaaaatttctctttgtttaaaagtaagcaaaaaaatgttataagatgttaaattacattttaatatatcattataaactttagagaacaaaagagctcctgagttgggctgtactatttggtgatgacagaatttcctcatttgtcattttaaccccaattaagtcttgtagctttcagtgtgagtagatgaaataaaataatatctagttattttaccataagcctaatgactgagtgaagtggagatgctatacatgtttgatgctttttaaaatcactaggaaggcttaaatttttctaaattgtgatgccgaagaatgttgcagaataattgagaacttttattcaattgaatgattgaaaatgtaatcattaaatagagtgaagacgaatacctaaattatattttaagaagagcttcaaaattattaaactctgttttataaaactgaattttgcttaattatgtttttgtttctgttctgtatctctagctcttcaatttttttttttcttttttgagacggagtctggctctgtcacccaggctggagtgcagtggcacaatcttgactcaccgcaacctccgcctcctaggttcaagtgattctcctgcttcagcctcctgagcagctgggattacaggcacccaccaccacacccagctaatttttgtatttttggtagagatcgggcttcaccatgttggccaggctggtgtcaaattcctgacctcgtgatccacccgcctcggcctcccaaagtgctgggatgacaggtgtgagccactgtgctctgcgtttagattttttttttttaatctttcttttctcctttgctttgataacaaatttcattttcttttgaaaaaactatgagtatttttctaatctgttttgttggtttgtttcatcttttccctcaagtattagacactgtcacatagaaaatgtcttttgactgaagaagacattgataatagagcacttctgtggactatttcaaacttatttatgtttaaataaaaatacactattttgccatatctgtttgtatatatatttacatctgaccataatatggaatcttattcaaaattttcaaatgttacaaattttaaaattagccttttatacctacattctaatagctatgttttgtcctatgaccccattttttaaattttttttatcagtagaacaaatactggaacaaaagctagttgccccagattaagtcaacagtatgagagtgggagaatagtatatagactcttcagtggttaggaaatattgctcccaaaagatctgtgcaggagacagtgacctcacaaatgaaggaaacaagctgaagagagcaagggccggtgccgggctggaacgagtttgaaagatttaggagctaggagatgtctggacacattttctgacagtttctgagaaaactgcttcacgtggctctaggatggcttcagcatttcatttcagtgtcacagacagttgcagacatttccttgtattgtcaggtaggacaaagaccatgtggctttgctgaggaatgtgcagcgtgggcgctttggaggcgcgtggcttgcccggtgcttcactcgcaagcagatccgcgttggtcagcgctgccgtgcagtctcgctcgtcctggtgtgaaatgtggcagcatcagtgactttactgtaacacttacctgtttccatctgtgaccccttccctcccccaaaaatgttttctagaacttgaaagcacttctttttctctgcagatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatgtaagttgctccaaacgttaaagcttcaaatacaattgtaatgtcacttgctggcaccatctacacagtaagtgtaccaattaaggttaccgatgatttaaaaagagcaaactagtctaggagtcctatcctaatttttaataaacagctatttgaggactggcttgaatatttttaaccagtttaagcaaataactgtctaatattattcttcagaatgttgcatgccctaaaactaaagcagccttacccaactttgcagtccatttttttcttttctgagtgtactttttaagatgtcattgtcatccctgagttgggtttgcctcctagtactaatttaatgagtgctggtatttacttacagtgctgtggggttttttttccccctccttttattgagccatgtttgatactgctttctctgacgataaaacagtaattactgcttatttctctttatccttttatcctaccatgacagttttatttctcttcatctaattagtggttcacccatctattgcagaatagttgctttgtgattagttaggcaagaacatcttgaaataatgcttatctcacattcaagatatttatctaatgcccgacaggttttcttcacttggagctttaagtgattaaaaagaacacttggtatatatttcataactggacattttacaacctaatttaaagacaatattccaaacataaaggtttcaaggctgaacatttccagaagaatcatgaaatgctataagcttaggccagaagtcagatatttatgccatccagtggttgcactcagataaaaattcatcaggagcaaatactattgttgtgctttttcaaaaagaatatgtgtgaggtcatttgccaaatagattttacatctaactgtgaaagtcactgtgggaacccacctgctctctcccctacctgagcatctgtggaatcccttcccgaagccttgtgattctcatctccaaccctacctgagcatctgtggaatcctttcgctaaatctcatgattctcctctccacccctacctgagcatctgtggaatcccttcctgaaggctcatgattcttgtctcccacccctacctgagcatctgtggaatcccttccctaaacctcatgattctcatctacctgaacatctgtggaatcctttccctaaacctcgtgattctcatctcccacccctacctgagcatctgtggaatcctttccctaaacctggtgattctcgtctcccacccccacctgagcatctgtggaatcccttccctaaagctgttgattctcgtctcctacccccacctgagcatctgtggaatccttcccctaaacctggtgattctcctctcccactcccacctgagcaactgtggaattccttccgtaaacctcgtgattcttgtctccacccccacctgagcatctgtggagtcccttccctaaacctggtgattctcctctcccacccccacctgagcatctgtggaatcccttccctaagcctcctgattctcttctcccatccccacctgagcatctgtggaatcccttccctaaacctcatgattctcatctcccacccctacctgagcatctgtggaattccttccctaaacctggtgattctcctctcccacccccacctgagcatctgtggaatcctttccctaagccccatgtctccagtcttctagttctggaccaggatctggctggaacctaaataataataattattattattactattaataattatataatacttataattaataattattattttgagacagagtccctctgtcacccaggctgaggtacagtggcgtgatctcagctcactgcaacctttccctcccaggttcaagcgattctcctgcctcagcctcctgagtagctgggactgcaggtgtgtgtcaccatccccggctaatttttgtgtttttagcagaggtgaggttttaccatgtgtccaggctagtctcgaagtccttacctcaaatgatccacctgcctcggcctcccaaagtgctgggattacaggcatgagccaccacttaagcttatttcacaaatgtttctattttggttattgggaacaaaaatttatatatatatatatatatatatgcatgcagcatattttaaaattctagtaaaaataccagttaccttagaagatgggataattgctatccttttttctttatttaattacaagttacttaggtatccacctttatattgattccaataataaaagatgcctcgagtttcgatgaaacaaaaatgaaggatcaatttttcattcttagtagactgttaggctttaaaaaggcaggtaagggccatttgcggtggcttgttcctgtaatctcggcactttaggatgctgattgcttgagtttaaagcaatctggagtttaaaaacagcctgggcaacatactgaaaccttatctctactgaaaattaaaaaaaaatagctgggtgtggtggcacgaacctgtatttctagctatttgctacttgggaggctgaggtaggaagatagcttgaggccagaagttggaggttgcagtgagctacgatggtgccactgtactccagcctgggtgacagagcaagaccctgtctccaaaaaaaaaaaaaaaaaaacaaaaaacaacaacaacggcggggcagggggtggcaggcaagatacattcttgtataaatattctagaagtttccagtgctgaccacagtatgaccaggcaaacttaggataaatgttgggggagaattggtaccagggatggggggagttagattgaattaggctttcctctcaagcactggagcttttaattaacgtcagtggcagcaaaattcatggtggaagaattctttcaacttagcagcaaataagtctgtattaatctacctgttaacctgtgttctcactatatgcatgagacagcacttattcacgagtatgacagggtatagaatgaaagaacttaatttcataaattttttaaacttgcaaatacatgctaaagcctgtttaattcctggtgagctaataaagtaaagatgctagaagggctttaacttggtgtaatatcaaacaaatggtctgcttacaagcatgaagctgttggtaaatctctaatctcaggaaaataatgcagtataccattttttaaagagatgagatgaggctgattatggatatttacacttttacaaggccctttagtttcgtattttccacctcatcatcaccccaagtctattaagtacctgctgtgcaagattacataaatcagtatggatatgtgtttttctccacaaatttatacatcgtccaaagacatatagctttcacatcccaagtacactgatttgatctttacaaattatatgaatattaaatgatcacatgtaccctgaaactatgtacatctattatgcactaataaaaagtttacctgtttaaaaattaaaaaatctagatgcgaaaacccaatatattgctttccatgtctaagaaagtacagtttttgactgaagatgggagggtatctctgcattcctcgcacccacgggattggtagcacaagtcagatggcatcatatttgttatatacccacagagatgccatttaaaaactagagcatttgactcaaggtgcttcccacatattgaaatgcaggtgaagtttctgcacctattttttttttatttttattttttgagatggagtcttgttctgttgcccaggctggagtgcagtggcccaatctaggctcactgcaacctctgcctcccgaggtcaagcgatgttcctacctcagcctcctgagtagctgagattacaggcgcaccccactatgcccagctgatttttgtctttttagtagagatggggtttcaccatgctggccaggctggtctcgaactcctgaccttgtgatccacccacctcggcctcccagagtgctgggattataggcgtgagccaccacacccagcctttctgcacctatttttaacctccttgtgtgagtttggttccctaatacgtgcacctttgtcatgtggtgaaagcagttcattttctctccccacctccatgtttaaacattacctcattatctgcctttaaaatgtgggctttaggcttataattaaatgattttttttttcattttcaagggaaacagtaagtctaatgttttctaacttgaaaaataagttgaatatcctattaataatcttaacaggagctattatttattgagtacctactttaaacatatcttctctaatcctcacaattgccttctgaggcaggtataattagctctatgtatagttatcagaatggaagattatggatgttaaattacttaccccagggcccccagccaatacacacagagccagggttcacacccgggtctgcctgacactcagtctcatgctcacttctggatcagcctgattctttccactttattggctgataattttttatgtttttgattattttttccatacattgctctagtctttctcatcatttagaagaccagctttcaacttgaaaagacatggattaacctgggtttgcatagaggggttgaaaagtgtcagaggctggtatgttttgaaagtagagacaatctacaattatctcagatactatgtttaattaaaaataggtggaaaaggttaaataccttatgattccactcacacaagataattagagtagtcaaattcatagagacagaaagcagaacattggttgccagggacttgggggaaggagggagtggggagttatgtttaatgggtacagagtttcacaagatggaaagatgtgctgaagatggatgatggtgatgatcgcacaacagtgtgaatgcacttaatgccactaactatacttaaaagtggttaaaataattaatcttaggccacggatggtggctcacacctgtactcccagcgctctgggaggccaaagcaggaggatggcttgagcccagtagcttgaagctgcagtgagctgtgatcacgctatagcagtctagcctggatggtaaagtgagaccctctctctattttttaaattatattttaccacgattttaattgtctttttttttccaaaacaaaaaataacgtcttccaaagacttcccactgtgtacagattaaaatccagattccttcccacattctggggctacagggccagagtctcttgcagtttagcaaatacatcaagctcttttctgttttgaaagttggagacagtcttgctctgtctcccatgctggagtgaagttgaagtggcatgatctcagctcactgcaacctccaactccagggctcaaatgattttcgtgcttcagcctccagagcacctgggattacaggcgtgcgccactatgcctggctatttttttttgtatttttattggagactttgtttcaccatgttgcccaggctggtctcgaactcctgacttcaggcaatccacccgcctctgcctcccaaagtgctgggattacagaccaccgtgcccggccagttttaggtggttttgaccacctaaaatgtttttgtttttctacctacatttggcctcttggtatgcataggagatacacagtgctggaatggctggatgaatgaatgtgaagaaaagtcgtgtaatgtccacagacatcttcagcagaaggggaaaaaaaatgagaacaaacctcaaggaaaaacgctgttgatgaggcagaaaaaatatcttggaaagacgaacagtatattgagagaattgaaaataagttatattcagaatttgaataggtaattacaggttttatctgagaagttgaaaaccccatacatttatttttctgatttactgagtccaaagtttgctatctttgcatatcaaagatgagcttagctttgtcatataaatacagtctaatttgataataaaattgttctgtgttattttggtttagatatattttctttatttccatttatttctcaaaatatgaaatgtgaatatcgatgccatgctgtacttctctttcctccacgacgttatttatgttggtagttatcagattagaacacaaaatcttaactctgtacagtgccattcttgtgcttaattgcaggttcttgtgctcaaattgcatcctgtagcctacctgacaggaatgtgcaagcacaagtattcttgaatgtttttttcctggaaatgcaaagtttatagatgaatgtttcaaaccttcagtcagctttgcaatagacaacttgccagtaatgatctggattgtgaagtatgggcagtaaacagcatcccaggtgactcagaaacagtctgattcataattgtccatgcttaaatacttgaacatccattaacttattaccatttcatttcaatttcttcaagaaagatttgtttaaattagcgcttgcattggaagtcacaacttaatgctcgaatgaagtagatctggttgtaataatgtttttatagttaactaggctttcaaaataatgtgcttttaaaattttatattttataggcattttgtgaatgtttatagagtatatgtgtgaaccgagccatatttggtataagtaaaacagacgagtagatacgggttccaggcctgctttcaccgtaattctgaccttgggaaaattacttattctccctttgcctccattttgccatgtcgatgaaaagggttttctaatcacttctgcaatcctttctggtattaatgttcagtgctgctgttaaggaagggggtgccatggcagttgttcttcccctccctctctttcttccttcatgcatccatggacatttcctgagcacttaattagtgccagccactgttctgcttgccagggacagaaaggggaattgaggcatcccacgtgtgcccctcagtgggtgtgttctgatatgaagcaggtaatacacaggacactttggggtgagggtcgtgctgccacgctgagaagacatggatgggtgggaagagagtcctaagctggagggggttgaattgagtgactaaggacaggtcctctgtggaggtgacattttaaaaaacaccttatagagttataatttgtatataacaaaatgcgcattttcaaagttcatagatggatgaatttcaataaatatgtgcacagaagaaattgccatcccaatcaagagagttcgtgggcccctcctgctgttggtatgcattcctgcagctctgccctcctgcttgtctaatttctattactgcaggctagatgacctgctctagaatttcacacaaatgacatcattgaatatgaaatcctttttctagcttcattcattcaacatcatttctgtggtattctcaatgtgatccttaataataataataattaatgatttttgagtgccaggcactgttttaaggattttatttataacaattcacttaatcttcacggcagcccagcggtttagtactgttattatcgtggctttcctgatgagaactaaggcagagagaggccagcagttggccggcgtgggagccacttgactcctaagtccacaccgttccaccgtgtatatgaggctgttctcccaggttaatgtctgcaagatgggaaggagccagccctgtagagccccagaggatgagtgttctaggcacagaggccagaaacagaaaagagcttgatgtatttgctaaactgaaagagactctgaccctgtatcccctgaatctgggaaggaatcgattttattctgtacacagtgggaagtctttggaagaggttgctattttttgttttgaaaaaaaaaaaaaggcaattaaaattgtggtaaaacatagtttaaaaaaaatagagatagggtctcactttatcatccaggctagactgccatggcatgatcatagcccgctgcagtttcaagctcctgggctcaagccgtcctcctgctttggcctcccagagcgctgggagtacaggtgtgagtcaccatccctggcctaagattaattattttaaccacttttaagtatagttagtggcactaagtccattcacagtgttgtgcaatcatcaccatcatccatcttcagcacatcttttcatcttgtgaaactctgtacccgttaaacataactccccactccctccttcccctagtccctggaaaccactgttctgctttctgtctctatgaatttgactactctaattatcttgtgtgaatggaatcatatggcatttatccttttccacctatttttaattaaacgtagtatctgagataattgtaggttcacatacagtcaaaagaaataatgtagggtgattttatgtaccttgtagctagttttcctgagtgttgagatcttgttaaactgtgttacggtatcacaaccaggatactgactttgatacatcaacaaacagaaggtttctgtcaatactaggatttctcttattaaccttttatggccataactactttcctcttgccctcatccccttcttaagccctaataatcactaatctgcttttcctttctaaagttttgtcatctcaagaatgttgtgtagacagaatcatgcagtatgtgacctgtggggattggttttttttttttttttaacttagtataattccctgattcatccaggttattgtctgaagcctagttggtttcctgttgttgttgtctagtgtttcttggtgtggccataatgtgtagtttataatcattcacctgttgaaagcaatctggattgtatccagtttttggccatgatgaataaagttgctataaacattcttgttccttttttctgtgcatgaacataagacttcattgtgttcatacacacacatgcccaggagtggaatgactgggctgtatggtatttgcatgtttagttttagttttttttttttttttaaatgccaaactgttttccagagtggctgtaccattttgtaatcccaccagcaatgtacgaatgattgcgtttccctgcttcctcactagcatttggtgttgtcatgattttttattttagtcattctcataggtgtataatgatatcttcttgtgtttttaaattttcacttctctaatggctaatgatgttgaacatctcttaatgtgctgattttaaaaagaatgaaattagaaaaaagcaaacttcttgttgtgagaaatgtgttcatttatttgaaaagtcagttgaatgggtgaaagagcagacaatatgcagctaaagtgagacttattgttctgatctgaagaaattactcagaataaaacacagaggaaaaaatatggaaaatctagaaggaaggccaagagatctagaggacagagtaatcaatagacgtccgatggagaaaatgggggatagatactatgcagagaccaatgctatgacgtttcctaagatgatgactcttcacagtccagaagcagaatgagctccaagtaagataaataaagtaaatccaaatctatacatattatggtgtaactgcagaacatcaaagacaaagaagaaaccttaagacaaccatacatgtaattcaggttgcctcagaggaacggcaatcagaagatagctgagagcagtaatagagaacagaggggaatgatgtcttcgaacgccaagggatggaactgctgccatggagttccgtgtcagctaagccaacgatcccaagtcggggagacaggacggtattttcagacaagcctgagaatttatatttccgagaagattgctgaaggatctatgaatgagtttgaggaagaaggatactgaatctagaaggcaatgcagggttagaaatattggcctccgttttatgttctctagttaggaaatatttagtaattggagtgtttaaatatttagatattagatgaggaagtggagacagcaagttgagacaactctttgggcatttttcttgtgagcggctgcagagaaaccgcgcgtgtctctgaggacacgaagtcaagagagctggttttttcttaccatgggggatcccagctattatttatgtattaatggaagttctccagtagagaaggagaatgtgaagagccaggagagagtgaggatgccagggggaacaaagtcctggcaaatgtgacctggacatgcacagacaagcctgggaaggagggcctggagtcatgtggcacggccttcatggtggcatgcggtggcccctcatggcctcacagcttccactctaacaggacggagccagaatatgcgcacggatgcatgtggtttggtaaacgtgcttgtggaaaattgagagatttctcgtggatttttattttctctatgaatatggggatgagtttagaagtttagagtgagggctggtgtgagaagagagagtattaggttatcattcagacagtcagaagcgaactagggaaacatgccagacttatggggacttttgagagcaagggcacagttgcagtttgtggtgatggatatcttcagtaaagtttggaagttctgatgccactgtagagaaggcagctgattgggttcacacaaggttgaagtgtagcctaactaccatgtggaattcagaagcgagggtcatgttgaggctgtctgcaagggagtgatgagtctcgattgtctccgagctttataagagaggaggtgaaggatgttccagtaggatagaatcagaagactgcaggagtctattgactggaagaataattgcagtgggcaaagaagtgggtggactgagcacctcacgtcctctcttcctcactttggctattccattcagtgccaaacagtggacttctcccccacttggaaggaatctggtgacgcagatgagaaaagtcgcaggcttaaacttgtgtggggtgagcttgaatccttagggaatcagcgaatgcttgagtgcaggtggatcagcagacagattactgacgccaccccagctgactgttaggtgacacatagcttcgtgcagcctctctgaagtcatcctgtgggtcacccctccttcctctgtgctttccccttccctcctcactccagggtccacgtgtaagctgttgtaggcgttctgttttcttgaaaaactcggttgtcacttggggtatttgaaatctagacttagaatggcacttttgttgggattgacaaggtttagggagagaccatgaggatgggggccaagattgcatggaggggcagatcagtggtggtgagaagtgtaagactccaaggccacagtgttagagtagatggtaacatggatgtaaagccaccagggagggtggcaggagaagccagtggaggaaggtagggattccagggctacagtcctcaggaaatggagagggaaggaggaattagaacctcagtagggaacagcattgagaataaacgcatcccaatcacatgggcctcagaggaactgggatttggaaggtggaagaggagaaacgggttgggagtgctggctcacagctgtgatgagggtttgctctagctagactagacaaagtgaaggccttctggagctgctcctttgggtatttggctgcaggaccttgcagcttagaatctcacctagtgggtttctgctctgttgcacttcagcttcacttatgaagcagagaggatgatctcttcctcctggagcagttgtgagatttaacagaagagaatgagcaagaaagtggtttgccaagtaatgttcagagatggagagtatatgctatatgccgcccctcaaaaaaggtatgcaggggtgttcaggtaaaaaacgttcatctttctgtggctctctggctggcagtgcacgtagctgtctctgtaacttagagaggacgtgggaggaaggaccctggtgtagagaatatgctggagccatgggcagcccctgtgccccaccgtgcttctgtaaatgtcacactgctcctccaaatgctggtttgtaaaatctagaaagttcttttcgttgttgttctcaccacatccaggaagatggggcacagcgggagtccccttgtctgaactgctcttatcctggggcaaattagtgtccctcaacgtgagtaagaagatggaaagcgccacattgctttcatgaatagtctgcagactgctgatgagctccctgtcaccgcgctttattccagagcctcaccgtgcagagcgagaggtggactccgatgcttgtgaggatttcgtgttttctttcagattgtcaggtagtgcgataaagggttaccttataagcaataataggtcaggatatgggctgttgcccacagtaagtttgacatctacaccatcacatgacgcagttggacttaatgaaggtcactcaagtgtcttctcttttggtgatgcttgttgggcacctgtctgcaggtagatgacactgtccctgctgcttcaggagaaagggcacatcacagatagagaaacgtttctgtgccaagtgaatagcccaagagcatgggggatggggatcgtagaattgcttggttccattcgagttggccatgtagtatctaacttaaatgacaggagtttaatattctatgtaccaatttttcactggaaataaaatacttcatttcacatgagcatatcttgtgacaataatgcatttctttaccaatattagcccattatacatctgaagtcagttgcacataattgcagttcaccaactctacataatactttaattaaaactaggataattaaaatacagttttaatgaacaataaattctgaagttgccaggcctggaatgtgttagttgaatcatagcttgctttttttttttttggctcttaaatctgtacccacattatattttgaaatggcaatgatcacaatcaagaggcattttaaatgcatataatagtatgtactaaaggccaggcaggtgactcacacctgtaatcccagcactttgggaggctgaggcaggcagatcatctgaggttgggagttcaagaccagcctgaccaacatggagaaacactgtctctactaaaaatacaaaattagccagacgtggtggcgggtgcttgtaatcccagctactcgggaggctgaggcaggagaatcacttgaacccaggaggtggaggttgcggtgagccgagatcgcagcattgctctccagcctgggcaacaagagcgcaactgtctaaaaacaaaacaaaacaaatatatatatatatatatatatatatatatatatatatatatatatatatatatatgtatgtatgtatataaaatgtgctagtaaatcatatctttcctatggctgtcttatatatctgtctatccctcttacatacacttgcttatttgctgctaattgtaatcccagaaatgaggaaaaggttttatttttgaaggcccagcaacttaaaacagcacctggtcatactaagtagtgaatatttattgaacaaatagataagtgtttcttggatgaatatataaataatagcacatggtttgttctggggagatggtgtgagactaagtacactagatcgagactcagaaaacaggtttcagtcccggccctgccacgtggtcgctgtgtgaccttgggaagatcagttagctattctcaaggaagttgagataagggtatatatcaaatggaaataatgctggccacctcaccagtgtctgggaaataggattgggtgcgtttatttgataaattgaatatacatgtggaaaccctgtctaaaccgtgaagtacgcatggtgtggtgggattgtgaccccacctctgctcacggtgttctccaattgtctacatgagcacacattagtattcacagccagctgtttctcagctcatttggaactttgtatgttttaggtagtttttgcataatgaattttcagcccttggttggtgataccttgtaagtagatatgccccctccatccttcccttctcctttacttccatcccatttgtaatgtccttgggaaactcaagtgagtcccactgctgttggctcctaagagagacatttttgctgcctgtgtatctgctagatagtttgtttcacagtcaaatataagtgacttttactagcttttttctggactattagtgtcagtgctactctccccaaacacaggtcatttgttcctctgacaaatacctccttgcactgacattttcttctggaagtcactcccgaagtgcaaaattccctcaaaagcaaatgtactttggactctaagggggtactgctggagtcaaaaattaagaaaactttgtaatgctgtttaattcatgacccagacccagggcagggtccttaagagctgcttctggtgacactgcaggatacatctcacctgtacccctgtggaaagccaagggtcagtgggactcaacccatacatgctccttgggaactctctctcatgacaagcctggtcttatctggtcttatctcagggtgttttggtggaaatctttttttttttttttttttgagacggagtctcgctctgtcgcccaggccggactgcggactgcagtggcgcaatctcggctcactgcaagctccgcctcccgggttcacaccattctcctgcctcagcctcccgagtagctgggactacaggcgccggccaccgcgcccggctaattttttgtatttttagtagagacggggtttcaccttgttagccaggatggtctcaatctcctgacctcatgatccacccgcctcggcctcccaaagtgctgggattacaggcgtgagccaccgcgcccggccttggtggaaatcttgactgtcaaagttaccttctcccccacaaaggaggagggggaaagctgccgtctagaaggaaccctagggagaaagggatgtgcttggaggtcaagaagagtcacagggtgtgtgtcccacccagggcattcgtgcaccttagggctggggccatgaggaggctgtaaactggaaagatcaaggcagtcgtacaaagacagggcaaaacatgctaaacagatgagaggcagacagctgcagctgtctggaggtgctgtcacagttggcacccagtgtctacagggtgggttccctctttgtggaaagggaggtagcattcccgggtggggcacagcacaccctgccgagtcctggaaagagggtgaggagcgtcactgtctggaaattcagggtcctacccaaatgtgaagtgtgtggaggcagggtggtgtggaaggcacactggatttaaagcaggaagagggactgtgagagccagctgtgctctctcgtcactttctgcctgtgagcaagcctgacttaatgtttaggggactcgggtttttttccacctgtgaaatggggtcaagccatctgtttggcctctgaggaggtgtggaaggagctggccatcctcaggagggggacattcctggaggcagggccaggcagcgtgcagcctatgcagatgatgtggaggcacgtatgtttttcttatctttctgcgagactactctaaatcttcacgacatgctagtaaagaaagcagaggaagtcttatcacaccaattttgtggatgactgcagggggaaagaaagtggctaaatgatataaggtcaagtcatctgtcagacatagagccgaggatggaggttggcatttgaatgatacctttgtcatcattttcgtgaatgtttatgacaaagtgggtctcagcctgcccatgagggtggtgaaatggccaaagggtcctgcacaggccttgggccccgtgatgcttggtgtctaaaggcaagtgcccgacttcggtggggctccttctcttcatctgtagagtgcaggtgataacaccctggcttgcccgcctcacaggacttttactttggtgcgtgatgatcacatcccctcacaggtgttaagagccctttgtgaatcatgaactgtcatagccgtgaggtggaatcattttctcatgagggcccattctttgctgtaatgagatctgaccaagcctggttctgtctaattcctacagcatttgcttccaagtgacagcccctaatatcgaggtcatccttcatttattctttcctccagtcaatcagtgagcactgtgctaggctctgcggataaaaagatcaatacaatgagtctggcttctgaagggctcacattctgctgagtgggatacagccatcttttagttcatctcatgtagtctttaaggaaaaaaaaaaactttattgagatgtaatttacctaccgtaatgttcacattttcacaaaagcacctaattcagtggtttttagtatattcacacggtagtagagctgtcactactatcttcttttttttttttttttttttgagacagactcacagtctgtcatccaggctggagtgcagtggatcgatctccactcactgctgcaacctccacctcccaggttcaagaaatcctcatgtctcagcctcctgagtagctgcgactacagacacctgccaccacacctgactaatgttttttgtatttttagtagatatgtggtttcgccatgttggccaggctggtctcaaattcttgacctcaggtgatccgcccacttcagcctctcaaagtgctgggattacaggtgtgagccaccatgcctggcccatcaccactatctaacagaatatttccatcaccccagaagaaaaccctgtaccccttggcagtcactcatctttcttcccacttctcaggcctggcaaccacacatctacttctcgtctatatgaatttgcctattctgtcactacctaacatgtgaccttttgacaccttaaatagcctttacccagttgtctttttcgctttctttttcttttgtcctttactgatcatcattaaatatttcaccgggttcttttttggtgcctttcctggactacgttctgtgggggtaaagaagggacattccttctttccttgaatgtatgcttcctgaatgtcagctgccctggtcggtactggtatgatatcacataggttcctgttctcagaatttccagcctggtaaggataaactgaccaaaaaatgggcaaaaaccaaacacataaagaaagtcaggtgatgaaagaaaaccctgtccacagatataatatttataccaaaatttgaagaaagggaaggagccagcgacttgaagaaatggggctggacatctgcgtttagtgtttgcaaaggagctcaggtggcagagagcctggtgtgttccaaggccgaaagggggcctgtgtggtacattctccgaggagagtggcccaaagtgacgtcggcagggactagattgtgctgggttttgtctgtggaaacgagtgaattttctccacgtgtagtggggtggatttataccaggagaaggccatgatctgattggctttaagaaaaccaggctgctttgtgaagaatagagagtaaggggcagaaggagaagcggagagaatacgtaggaagcttctgcaaatgccccggcaagggggactggcagcccagatgaagacagggtggatgacgtggagaaaagtggatgaatgaaagtgtaggttaaaagtagaatccacagggccaaaagagggatttgggatgtagtggagttaagcttcttgcttctgattagagcccttgggggaatcttttacagaaatgatgacaactggattcagatcggatatggggcttgttcagtttgagatgcccgtgaagtatctggtgacaacaattaaccagatgtttgtaaacacacgagtctttagcttaaaggaaagatcagaccggagacagaatattggggacaatttgtatgtaggtgatatttaagaccttggaaatggtgagttcttgcctgcagagagatttcagacacagcaaagaagagaagcaactgctgaggagctctaccatgcagagcagggtagagaaataagacacccatgaaaatatggaaagggacagccagaaagggatggggtagccaggagggcccaataccatggaccaccaagaagagagcttttcacctgattctacataagcagcttgagaaaagcttgagtcaacaggacttgaattccagcactaaataagtaaacaagcaaacacataaataaagtaagagatcaacaaagcatagaaagagaatggggaaataggagggagacagaagtggagagagagagaaagagagagagagatgggagagcctatctttccatatcttttgtcaccttttgagtaaaacctgcccataatgggctcagctccgcagccaggttgaaaaaaggtcctgtttcacgccccaacataaccataaattagaaagccttctggaaaaaaatgtgttgtggacagatgagaaagtttaggatcaaacaaccatagcagcactagctcatgcttcacccaggatgatttctcttcatgttttagtgcttggtctttgtcatcgctgacggaactgcactgttttaccttggaaggttataaatggggaggcatccttagaacttatttatctttgagagcatgaatcttttcttcttcaatctagacttgcccattcattattagatgaggtaaattattatatctgagagatacattatgtcctttggtgatatgtgtatactttaatagtcagggtctgtagtttaatgagtgaagcaattttgagaattacctctgctgagtaatttttggtatttagaaattacttatgtgaagcctgtccgtgttcatggtcatttcaacacctatctctcactctctaaaatcattgagaatccgttattgcctactccagtgatctagataaccatttacctgagctttgttgagttcagtattctagctaaaatcctgtatcacaccaagtactttgaacaactaattgactatacataactttattaacttttttcatatatttttaagtaatggttatatgcagagaaaccatggtttggtttgaatctgctatgtatggattaacattgctggattaaattttagttaaatgtaagaattttgtctatggaaatgcatgcaaaacagtacttgtgctaattaaagttggagagaaaggggacattaacaacctgccgttggcttatctctgatcctctgttgtgagtggaatgtctagttgtgtagtaccccgccttcatctatcacacgctatatgaatttaaataagttgtaaatgccctggatttgatttagtcctttctttgatctagtgatgaaataaggaattgtggctatcattgaatttttgaaaagcatctactgattaaaaattttaaaaactgtttctaaattcttagtgtgaaatgccctcggtttagcattttccattattttgctgtttttaacatcttcaggaatatatatgatttggaaaaatgcagtataaaatggtggctaagaatgtaaactcggaaaccaggctgtctgggttcagaccctggctgtgatacctaatagttgtgtggcctcgggcaagcacctgggcttccgggcaccacactttcctgttgtgtaaagctggtgtagtaataacacctgcctcatagcatggctgagggggttacctgtttaagcacgtgcaactctagagggcttagactactacctgggtgtagtaagaccgttattaccattagtggttctgacaactctcattattattaccacttactcaaatgtttcaaatagaggaagaggcaacggttgtatttttttttttttttttttttttggtgttcccttcaaggaaatcttgcagagaaaattgcattctgtatatctggttactttcatcccatctggaggcacaacaattattttcttaatcctttattcgaacaaaagtccaaattctcaataacaataggtaaaatggaactgatggatcagtgttgaaatgggtcctacgggaaaagttgtaactaagttatgcaggtttgaaaggtatcatcatctgaacatctcacaatactcttcaaaaagacatcctgtctggttacacaaaagatggagcatgagcatttttcacagctcagcactgggagccagggacacatctttgcctagtcccctgtccttgcctgatacattagtcctgaaagtgggaaacccatgactgtagacaactctcctagattctgtttgtcctttgaaaagccccatttagcaaggcagagaaggcagtgaggacccaggctgtcttcctggaggtccagagagaagaagggtgctgacaagggccgctgcggggacgattgggagctcacaggcttgggttcggagaaatggttcctctcttaagagcacaacagcaacaacagatgtttcgggttctttgtcttctaaatgtgtctcacagatgtacagtgtttatatacgtatatacaaattatatacaggttgagcatcccacatctgaaaatctgaaatttcaaatgcttcaaaatctaaagctttttgaacatcaacatgatgctcaaaggaagtgctcattgaagcattttggattcggatttcagactttgggatctgagatgcttaacccagtatgcattatgcagatacttgaaatctgaaaaaatctgaaatacgaagcacttatggttccaagcattttggataaggtatgctcaacctgtaatatgtattatgtatatgcaagtatgcatgcatgcatagatgtgtatgcatatatgtgtgtatgtatcaatcagatagtacacatatttgatctcattttggactttgaaggagtgcataattagattattttgtttccatatttgaaaacaaaatctgttttcaatggtaagcagaaaaattgttgaaacatctgttacagtggcaaaaggctctgactcttgtttaaaatgagtaaaattgtgatacttacttttagagtaagatatataatgataatagtacagtgtcctacatcagagaaatgaacatccatgtttttgttttcaagtgggataattgtaggtggagtgtgtaaaaactgaagcttatttcatgcacacatagtatctgttcccttctggtgtttttaactaaatgaaatatatagggaagtgggattcatgcttgcgatgtatcttctcgacttggggcttgttctcagggccttgcttgtttgcattctgtgatgttgtccgcttagaggtttgttcttcagctgagggacctgaacaacacaatgatgggtaagatgagagagattgctgtttagaccatgtggccagagagggggacagtgtgtgtgacatgcagggtaatcacctcattctggtttgtccaggactgtcccagttttagcactgagagtcccctcagtccctgggcaaaccgagatggctggccaccctacttgtttatagctactgtgggtataaaacttgccacactagaattatgtgttgtccctaccactgtcaaagtctgtacatctaaaaggaagtatggaaagtagaaaactaaatctaagattagctaactatcctgtaaaggctaagcaaggcagaaaggtttcatgaacagaactgaatttcttttcaaagcatttttcttaggaatgtatcattgtcactgtaggaagaagttgatacacttccatggtatgctaggcttataaatttgagaaaaattaaccacaagatatttccgggcccctaacatctcattttgggtacattgtaccttcactctagtttattttccctttgttctttttctggacaacattcaatgcttgttgaaacacacctgttggaattagcccagtgagcatttctcagtttgccactgggagatatttttctttcttcttggtggaatgcttgacaaaaacatacataccttgaagggagtgtaaagcatgaggcaagtcagaggtgtgcggaggagctccgtcactgggagggtcttgaccatggcaaatgttgcaatgaaaaacaccaggctgttaattaccccacaactcagggcaactccagctaaaatgccattgctttgtggcaaagtataacaagaaactcgaatctgtgtactctggtccctgtatgtatattttcttctggaatattacagcctttttcattgtgcttataaatttgagaactagcatccgggcacagtggctcacacctgtaaacccagcactttgggaggccgaggtgggtggatcacttgaggttaggagatcgagatcagcctggccaacatggtgaaaccatgtcttctactaaaaatacaaaaattggccgggcatggtggcgggcatctgtaatcccagctgcttggaaggctgaggcacaagaatcgcttgaacccaggaggcagaggttgcagtgagccgagattgtgccactgcactccagcctgggcaacagagcgagactctgtctcaaaaaaaaaaaaaaaaaattgagaactagcaatagtctgatagagcttttggtctgctttcaaatctgcatgtgttctaataacttggcatctttcttacggctctgagatgaagaaacattgcctccaagaaacagaaactgttactttcatatcttatttgaaaaatggcaatgattttggaggacagtctgtcattttccagaggaacagatgtgacccatatccacagcaggatgattcagaccattataaactttgagtaggctcttctgaataactcagagatccttgagtttacctgaaagtagagaaatgaattaatgatgtaagtctgtaagaaagagtggactctctggctgttgtttttctgaagcctatgaaacctcgtagatgggcccttcctatgtgaagtaggtcccaggtgtgaatgccctctgtgcctcctcaacaggagacccacacatggggaccaccctgtgcacgcagagcagtccactatcatccccacctacagtgatgccttgagccccctctttcactatattttcccgtggcctcacctacaggaacagtttgagcagattctgcaggttgttaacattagagaaaacttgcatgaatctacatatcagttaaaataatgaatagttcttttagtcctgctctagcctctgctgccttatatcacattttgcaattctttgagggtagggattgatttttgttcacctttgcatctcttgtatacaacacaccatagcacaccacacatattgatgttcaagaagtatttgtttggttgaatgaatggagctttgtcttgtgcctgactagttaataaatatttttatgtttgtttccttgtccttctcttttttgcatggggagggagtgccacagcaagaggcaactagaagtagtatttcgtggtgactgcaggacatgtcgtgccattcattgagcattggtgctttctctcacgtggatcctgctgccatctgcagtctttgtttatgctccccttgccctccaaagtctggagacaaaagtgataaagttgattcatgcttggagtatccagcgttccttgtgttgcttttctctctttattaacagatgtagattgacttagtgatgaagatgtttcctcagttggttccatttatgaagggcagggaaactcagaacaccttctaccatcttcccacaatttctcggttggctcacacttcctattccaattagtcagggggttcactctttcttcctgccaccacctttgttctggccattggcataattctgcttagattcctgcaggaaatctcagctgatctccaagtatccagctttgtcctttattcacctcctaatccagttaaccagatgtttctgaaggtggcatatgacacccccaccccactcacctttaaaatccttttagtagtttccgggcctcaagatgaagttcgagcactggtcctcctggccttgtgccgcctgcatctggccttgtctgtcgggcttgtttctccttttcccttcacaaggcagccacgctcagccttgtacactgtcccagctgccccaggtctcttgtcatgggactttgcacatgccgtccccctgcctggaatgccatcaccatgctggattttacttttagcttcagattttatcttacatttcagatctcatcactttctctgagaccatttcccaggctcctgccctcaccctgctgccgacacacagcaggttcagtgtggtttccctggggtctggcgacacctctccctgttgcaggtcttgtctgccgtgtgctgccatggcttgggccttgcttctctgtatatcataagctcctgaggacagacactctgtatctcaggccctaaaatagtgccttgtgcgtcgttggcgattggtatttgtttgaataaattaattgttttatgcctaatattaattttcttttcataattacctgtcaaagtacatttgtgaaaacaaaaaaaatcaaaggagagacatcctttaatgatgtcagtggtgagatcaggtggtccatgccttcctatctcaggtcttgcagggtggaaacgagggataaatgcctgacgtttccccttgtctgcatctgctatccgtcacaagaggtgttggctggtgcagtcacatcacacttttctaaactcagaattgaagtgagttttttatttactttttttttaaggacttgtgtttggtgttttggggtgttcttacggtttgggaaattttatgctaaggacttgttctttccattaagtgctcctagaagaaaaataaatgacaaaagaaataaaaatcccaatgaattgtgacatattgtaatatgtcttgtgcatatctgtgtaccttggcagattattctgacctaactgtagctaattttcatttgagaaatacatgtccatgaagtttatatagtgtgttcaaatgtaattttattataaccatattattataaaaaacacacatttgtatagagaacactgcagcatctacttattccattattacaatggtaacaccatttattttttatgagtcacttgtagaatgacattttggcaataagtcaatgagtttatcatggaaaagtcttcctcccaacctcctcctaccctgaggcttttctattcagagggaatatctttttcaccctcatgcttaagattcaaggatagaattcactctttttgatatatagcttgatgaattttgacaaacatacagtgttgatccactaccacaatcataaaatataaaatagttctatcaccgcccaaattctcccacactccattgtgatcaactcttcctccaccaggagaccctggcagtcacagatctgttttctgtccctatagttttgcattttctaaaatatcttatgaatgggatcctaaagtatttagcctttgaatctggcttgtttcagttctcgtaatgcatctggtactcatctctttgttgcacatatcagtactttgttcttctttattcataagtagtattttattgtgtgcatgtaccacagcttgttattctattccccagttgaagggcatttgggattgttccagttttggccatttgcaaataaagatgctagaaacattcacaaatatgtttgcacatgaacataagcctttattttgcccagttacatgcttggagtagactttctggtaagtgtatgtttatttaactttataagaaacttataagaaacctcaaagtcctcagggaaataatcagaaacttagcttgctatacctaacaaaactatcatttgaggtaggggacagagggataatggcagttttagacatgcaagccattctcattatgttttactgcttaataagctgccctgaaacccatcttagaacaaaataatcaggtgttttgtacacaaatctgcaatttgagcaggagtgggaaggcttatctttgctccacctggtgtcagctagggtggttccactgatggcagtagattcctcttccaacacgactcactttcatggcaaaagttggtattgactgttaactgagagttcatcagagttaatgaccagagaccccagttcctttctacatggacctctccatgggcatggacttccttcaaagattatatgctgggttccaaggacaaacatacagagagaagctgtcacataaaaactatattgccttgggcctggtgcagtggctcacgcttgtgatctcagcactttgggaggccgaggcaggcagatcacatggtcaagagttcgagaccagcctgggcaagagaccagcctggccaatatggtgaaaccccatctctactaaaaatacaaaaattagccgagtgtggtggtgtgcacctgtaatcccacctactcgggaggctgaggcaggagaatcacttgaacctgggaggcggagtttgcagtgagccaagatggcgccattgcactccagcctgagtgatagagtgaaattcctactcaaacaaaacaaaacaaaatactatattgccttttatgatgagccttgggagtcacaaagtgtccattttcaccattgtgtcactagctgaaagagtcacaaaggcctgcccaggttcaggagaaggagccatagacctgtccctgtgtgacgtcatgggaggctctggcagagcatgtctggtaaggaatgttgctgtgccccatttgaaaaggacaattggccacataagggctcaagaagtttaccacttaccaaagctctttgagagaatctaaaaaggacacattccagggagaaaagtaaatctgagaagaagtagaatattaggagtgataatgaacaaataaggtggtaaaacatattggttagtgtaaatgaatgttgaatattttgaaaagcaaagaaatgtggaattgaaatcccaaattataagagcatggaaagcagtgtaggagcagaggggattaaaaacctgttaaagttactgctttgtctcataaacagatacagaaacagattaactacagaccttgttgcagaatttttatatttggaacatgttcaggttttacagcaccttcttacccccttttcattgaactcttgaagatctacttctgctcccaccaaaacagaatcatctttgagttcttactctccttgaacttcgctggtattgactgttcggtttacttccaccttctttaaccactctcttcttttgaattcaataacacaacacactcctgctcattttttctggctctcttcttcttagacctctttgccaacttgccttcctccacctgtctttaaaccttggatttcctcaatccttggtcctagcacttcactacctcccaccttattctccctccttaggtaagttcatccaagctcatcagctcacataccaactatagcacttgcagatgactcacaattttacatctccagcccacatcactcctttgagtttcaaacctatgtattcaacagcctattcattgtattttcctggagttttttcaaaggtgcttcatactcagtaggttgaaaacagaactcttttttcttcattgaccctattttccctgccttactcctggctctcctttcttaacataaatgacactgccatccaacagttgcccaagcaagaaccaaggaattatccttgatacttctttttctcttccaccacatccagtcaatcaccagtttctcttattgtaccacatgttatcccacaaatctactcacatcattgtgtgtccacctctgccaccattcctgaccaaactcttgcctctttcattggtctctaccttgtttccctatgtttattttgtcttctctctccattccccatgctgtggtcagaatgatatattaatatgaacctgatcttgttactctgttccttcaaatccattagtatattagtctgagtaaccaaatccttaatataaacagcagggtttgtgtaattcagttccttcccttatctacctaaattttttcttccatctctttccctctgacgtccagccacagccactttggtatattggttacgttcttagtttcccggatcagatacctgagtttgaatcttaacttttcacttactaggtatgatcttagacaagttcttaaacaaaacaaaacttttattaatggacaagttcttgaacctatgcatcagtgttctcatctctgaaatgcagttattagtctcagcttcttaggggatttgtgtgaattaaatgagatgaaacgtgtgcggtggtagcacagtgactgacagttaataagcccccagtaaatgttagattatttgcttaacgaaccacctcccttcttgtctctgggaattctcgttgctctccccacttatacaggatacccacccgcttgcttcccttgcttagtactgacttatccttctgcagcaaaggaccttacatcccagctggctcaggacagacccagtttatgtctgttgtagatcagttaacatttactgtttttaggtatccccttttactactggtttgtgaaataaattagatgatcacccttttgtgctcagttcaagagtaaccttttttaggaaaccttctttgattcctacaaggacaggtcgtctattatttgttcttacagcacatcctgtaacttttttttgccatagttaccacgattacagttaaaacagttcattgcataactagttccttgaggtttgtttctcctattgggctctaggcccttggaggactgggacctcaaggcggggggtgtcttgccttacccctgagttttcagcattggtcttatccaagtcattactcagtatatttagaggagacaagaaacactgaacaggatctggtttggacttcgtgtctgtttctgactttaaatgtcaagtcacttcctctcactgtctcttcatttcttcatcttgtaaattcagaaaattaagcttaatgttctctagaattccatcggcctctacattgtgtgagtctagcccatcagggacattttttaaaccaatttttaaatatttatagtcacaaatttaagaaggaaatggaatcaatgtacatctccccaaagacagagtaaaatactttgttgctcattgaatgaagctctggtcattaccctttttgttattatgattcctaatttgtaagctctgatgttatcccttctttctcaatatagctgagacaaatgtgtagtctgtatgatcatatcattgctgttatacctatttacaagtttaagactgagtcaatagaaaaaaatccaagtgaagagtgtttaaaataaacttgtgtttctccaggaagttaactaatcaaacacttttcattgtagatgttgtcattcagtacaaaataatccctgagacagtctcatgaaaaacctaatgcattttttggtgagttttataatgagattaaaaagaaattaagagcaggaagtgaaattataacgccagtgggaaatctttgaaaccattttatagttttttccttcttatgtaatatgtctgtgagattgggcaggtttttgtttgcttgcttgcttattgtttgtgtttataatgtggaggaatcagctgaacttgacttatccctttacaactgatccatgcctacacagtagttgcttggagctaaaagcaggaacacatggaccctgaggcatagctgctctgaagtcctggcggcctctgggagggcttatccatgatatgggacacagggtctcctgaggtcttggaggagttttcctggtaactctgaggagtggcgggtcatggtgtggtgaccattggtctaacctgaaggactataggaatgagggcagggagaattgtagggaggcagccgatgctgctggtgagaatgaaaacatcctcagagtggcttccatacccatcctgtttctgtagtgcccagttattgtgaatacccatcacacgttattctatcacagcaagcagctcatctaccctactgcacccccaagttcttgaagtgtctctctgtttcttgccgttactggaggtaagccaacatgaaagatgaaagctgtgtttatacttctactgcaaactcttgaggaaaaaaacagaggcattagccaaaagagataggacatacaggcaaagaagaaagatgagctggaaaccagtacctaaataagtccaaaagcaatctatttatagatcccagagtgagatcgataaaggagatgatgtggagaaatatatatatataatatatatatttatataatataatatataataatatatattaaatatatattaaataaatattaaatttatatataaatttgttattaaataaaatttatattaaataaaaattaaatttatattaaataaaaatgtaatatatatttttataatatataattttatatatatatatatatatatatatatatatatataaaaaatacagaaagctctaagtatgcacagatcacacttttgccaaaataggcacctacaatgagggccccatccccacccttgagggtttggagtgatctttgggtaaaagctctattctaactcttgaaatggttaaactttttctagatgcatcttttaatattacttcctcttttattccttttttctattttttttaaataagcatctttgctttacttcttttagctatgaagcagctcttgctgatagtaaataaatacttaaagtatgaagatacttccttgtagcatttgaccaatttgtaaggcagcggttcctcaatttcagtgatgcaccaagcttttccgaaaatgagttccaaagggaattgatttttatctgcaatactctcatcctacagacaggatattgactacacttgatagaatggaagtgtaaatccagaatgaagcattgcaggaacaaatcccatgggggcggttcatgatcaacagaatcattcattggacggaaagatcggagagctagacagtgtcaatagagacaaaaggggaaataaaagcattcatttcctgaaagagtcttttcctggaaggtttttgttgactggctcttccttttagtatactctctattcctagttgtttatcagcttatgtgagaaccttaaaactcataatcatttataatcaatgtttaaacatggaaaaataaaagtacataccataggccccgccggcctgttattacatgagtttattaacattcactgtgagatgccttggtatagacttacccctttttatttctgtctcatgttgttttggatattctgctttgctaatgcattaggtagtttcgtcttgctctgcaaagacaaaagctcagtcattgacctggagggcccaaaactgcgccccctgctgccttgtgtatttggtggctggcatagtcagttcattatgtggcaggcaaaagtttgcattccaagggcggaagacatacacattggttttgtttgagaattatatcataaaactgagttctaagtacttcttgaacattgagattattattgatgaactgattataaagtattcttaaatataaacccaaagcaaattttattaaaaataaatagaaatttgattaagaataagagataatttctaataactttttggtaggtgacagcagggagatttgtttgatcatggagtttttaaatgcttttaagtcttgaagtccattaaggcatagaagagagaataggagaaaaaaacatctctgaatggcacagaccgatcacatgttgattgaagcacagtcaatgtgtatactgaaattgtgagtcaagagctatatcactaaaagataagggaaagacagcatcagaaattgactacaacaacgaaggtgtagtgggagataaagttagacgacatgagattcagtgttacagatggaggcaatttgagaagaggcgggtggagtgtagtgagcatggtaatgagaaggaaggagggcatctaccccacgtccaagtccaaagcagggtgggagagacctagagagggctgctagggcatgagtgtcagcaggggaggaccagccttcctgttgagcaagaagaagaaacatttagaggagagggtgacaatacaggggcctttgctgaggctggtctttgagtcacagaaagcacaatggaagtggttaaggagttttggtttggtgagggatgtagtgtggagtaagagctgttcatggctgtttggggattcatatacaggagatgagggatgaattgagattctaagactttattccataaatacggacaaagggcagtgatgtgttgttcagtgtttgataactataactggctcttggcagggaagagccctgatgtgtagctttttccaattttcatggtgtgaatactcccaccacagtgtattccaggtgaccaacatgacgtctttctataaggagttggacagagatccacaagattggctctgtgttcagcacgcattgggtaaagggcatggctggattaatgctggtagactcaagccaatcattaggcaaggctgtgagtggtagggagtagagggcatttggtatccttcctgacccctgtggatagaagcatagtgacctgaggaacaatagtcttcttggtgtgtgggccatataaaaacaagcctgcatcaaattctgtacatgggttagagtttgctagccacggctgtaaaccttctcatgcccgtgagccatctccacgtgtgaatctaacagatatctccaatgttgatctccctccatgccccaaacctgctccacccatagtctatatcatatcatttcatggcagctttatctttcaaatggttcaggccaaaaccttgatctttcacccatagccacagaaaaacctgttagctttcctttcaaaagctattcaaaatccaacatttagctgttttcactgctaccactttggaccaagtgatggtcgtctacagctggaattattataacagcttctggtctgtggtctagtcttcttgcttgcttgtattcaacacttagctaatctttttttagaatgtaagttagatcatgtcagtcttcaaaatcagaaatttccagtttcctgtttcattcacattaaatgctggagtacttaaagtggcctacaaaagtctacataatatgctccccattacctttcttcctccccctactcctttttgtttgtttgtttgtttgtttgtttgtaaagagatgaggtcttgttctgtcacccaggctggagtatagtagcatggtcatagctcactgcggcctggaactcccggtctcaagccatccacttacctcagccactacaggcatttttgtagaaactgagtctcactgtattgcccaggctggttatgaattcctggcctcaagtgatcctcccaccttggcctcccaaagttctggaattacaggtatgccatgccccgtatgtcttcttttgagaagtatctgttcatgccctttgcctactttttaattgggttgttttttgcttgctgatttatctaacttccttttatacgttccttatatgttctgaatattagacatttgttgaatgcatagttcctgaatattttctcccattctgtaggttgtctgtttgctctattgagtttctttttttgtggcactatcacggctgactgcagccacaaactcccaggctcaagcgattcttccacctcagcctcccaagtagctgggactacaggtgcatgccatcacacctggctaaattttgtatttttttgtggagacggggtctcactatgttgccacctggctaaattttgtatttttttgtggagacggggtctcactatgttgcccagactggtctcaaactcctgggctcaagttatactcctgccttgtcctccgaaagtgctggaattacacgtaccacacctggcctcttctagtactttttttttttttttttttttgagacggagtcttgctctgtcgcccaggctggagtgcagtggcgcagtctcagctcagtgcaagctccacctcccaggttcacaccattctcctgcctcagcttcccaagtagctgggactacaggcgcctgccaccacgcccagctaattttttatattgttagtagagacggggtttcaccctgttagccgggatggtctcaatctcctgaccttgtgatctgcccaccttggcctcccaaagtgctgggattacaggcgtgagccaccacgccttgccctcttctaatattttttaagcttgaggtcttatatttaagtctttaaaccatcttgagtaaatttttgtatatgatgatagaaaggagttcaattttattcttctgcatatggatatcccattatcctagcaacatttattgaatagggaatctttactccattgcttatttttgttgactttgttgatcagatggttgtaggtgtgtggctttatttctgggttctgctccattggtctgtgtgtctacttttgtattcataccatgctattttagtttcttaggccttgtagtatagtttgaagttgggtaatgtgatgcttcaactttgttctttttgcttctctaacctcatcttttacctacttctgttccctggacataccaaggattcctgcacctcttggcctctgggatgtttgtttcttatgacttcttcaagaaatctgggtggctaattttgtacttttttcaaatatccttttcttagtgaagacttttctggccaccctacttaaacccttggaatttccaactctcccacagggattctgctctgtgtgcgaaggggtatgtgtgtatgtgtgtgtgtgtgcatgtaggtgtgtacactatttttatttaacatacgataagcatctttggccctggattcttcttttttagatgttaatattgttgtattagtctgttctaacactgctagtaaagacatacccaagactgggtaatttataaaggaaagagttttaatggactcacagttccacatggctggggaggcctcacaatcatggctgaaggtgaatgaggagcaaagtcaggtcttacatgctggcagacaagagagcttgtgcaagggaattcccatttataaaagcatcagatctcgtgagacttattcactaccacaagaatggtatgggggaaaccacccccgtgattcaattatctccacctggccctgcccttgacacatggggattattaaaattcaaggtgagatttgggtagggacacagccaaaccatatcaattgttaaatgtaaagacagtgtttatgaattgaaagattcaatatgtgaatatatattttatatcttaatgtgatcttaagacttactatgttgctgtggtaaacaagacagtgtggtattagtggagggatagacacatagttcagtggatggagtagagaacccagaaatatattcacacatggataaccagctgattttttgacaagggtacaaaactccatagaatctgatcagaggctgatgtccagaatgtgtaaagaacccctacaactcaacaacaacagaacaaacaaagtatttccccagagaagatatacaaaaggtcagtaggctcatgaagagatgttcagtgtcattagtcattagtggtcaaaccacagcaggtcatgacattaacaggtcaaaaccacaattagacacaacttcacaccccttgtaacagctaatataaaaagtagaaaattaacaagtgttggtgaggatgtggaaacagtggggtccttgtgcattgctggtggaaatgtaaaatggtttagccaccgtggaagaccgttggttgctcagaaagttaaaaatacaattaacagcaatttcacatctaggtatataccccaaataattgaaagcagagacctaaacagaccttgtacaccaatgtttatagcagcattattcacaacagcaaaaatgtagaaataatctaagtgtccatcagcagatgaatggattaacaaaatatggtctgtaggtaccatggactattatgtgcccataaaaggcaggagctttgaaaaatgctgcatcacgtggacgaactttgaaaactaatcattcactatgctaagtgaaacaagccagacataaaagaacacccattgtgtggtttcacttacatgaggtctctagaatacgcaaattcataaagtcggaaagtagaatagaagtcatcatggccctggggggagggagagatgggagttactgtgtcacaggtacagagtttctgtttgggatgaagaaaaagttctggatagaaatagtggtgatatgcacaacactgtgaatgtacttaacactatgaaattgtagactttaaaatcattaaaatgatagatttcaggcatattttaccacagttttttaaaaagcaattcaggggaggaaaggtgatcttttcaacaaatggtgctggagcaattgggtatcaacaggcaaaataatgaacctgacctaaacctcacattttatatctttaaaaaaacttaaatgaacaacaacaacaaaatgacaaaacatacgagagatttaaatgtaaaatgtaaggttataaaactttttggaaaacacaggaggaaatcttcagagcctacggattagtgaacaatttttagctatggcaccaaaaacatgatcaatacatgaaaacaaaataaattgaatttgatcaaaagtgaaaacttgctctgggacagatgctgcaaagaggaatgaaaaaacaggctgcaaactaggggaaaatatttgccagccacatgtctttcaaaggacttttatctgaaatctgtgaagaactcctaaaattcaatagtaaaaattcctattagaaaatgggcaaaggaggccaggtgcggtggctcatgcctgtaatcccagcactttgggaggccgaggcgggtggatcacgaggtcgggagatcgagaccatcctggctaacatggtgaaaccccgtctctactaaaaatacaaaaaaattagccgggcgcggtggcgggcgcctgtagtcccaggtactcgggaggctgaggcaggagaatggcgtgaacccgggaggtggagcttgcagtgagccgagatcgtgccactgcactccagcctgggcgacagagcgagactccatctcaaaaaagaaaagaaaatgggcaaaggagattaatagacatttcatggaagaggatatacagatgtcaaacaggtatatgaaaatacctttgccatcattggccattaggaaagcgcactttcaaaccacaatgagatttcacttcctacctatcagaatagctaaaataaagagacagtaacaacatcaaatacgtcgagatgtaaagaaatgggatcagtcctgtattgctagctgctgtgtaaactggcatatagccactctgagaaacagtgtggcagtttgtctaaaaacaaaacatacgcttaccatatgaccctatcggtcacacttcttagcatttatccacagaaatgaagacctgtattgacacaaaaatgcacacgcaaatgttcacagaggctttatttgtaatagtcaaattttagagatttatttgagattagtaaaaaaatcagaaaccactcagatgttcctcagtgggtgaaagagtaaacaagccgtggtgcatccgcagcatggaatcctttgcggcaataaaaggaatgaatgaatgaatgaaccaggcaacgacttggctggatctcaggggcatcatgcttagggaaaaacccaatctccaatctcaaaaggctttagactgtgtgagtccatttatattgcattctcaaaatgactcaattacggagatggagaaaatattaatggtcgcagggagttagagacgtaggagagcttgagaggggaggtgaggggagacggctggatgtgaatttaggtggacagcacaggggatctttgtcgtggtaggacagtctgtgtgttgattgtagtgatggttgtataaatgcgcacgtgataaaactgcataaaactatatgattgtgcacacacaaatgagtacatggaaaaatgatgaaatctaagtgaggtctgggtgttgttccaatgactatgcaggttttgatattgtaccatagttacataaggttttactttgggggaaattagatgaagagtacataagacctttctgtacaattttggtatcttcttatgaattattatttaaaatctagtgattttaaaatacaggtttgcatcttttaattattgtcaagtaactatttgcatatgaatgtcaagaaatggaacctgtggcatctgagaatccctaggtttgttgtctccagatgcaactcctcttcctcttaaaggcaacagctatcctgacttatgcgttagccactttgtatttcttattatttatttatttatttatttatgtattttttgagatggagtctcgctctgttgccaggctggagttcagtgatgctatcttggctcactgcaacctccacctcccgggttcaagcgattctcctgcctcagcctccggagtagctgggactacaggtgcaccccatcaggtccagctaattttgtgtattttttagtagagatggggtttcgccatgttggccaggatgatctcgatctcctgaccttgtgatccactgcctcagcctcccagagtgctgggattacaggcgtgagccaccgcgcccggctgccactttgtatttctttatagtttcaccatctgagtatgcccccgagtgctatagtttagttttttgactttatgtaaatgaaatctgactgtgtgaatccttgtgtttctaacttctttgaacatagtttttgtagcattcgtatttgttctggaaagcattcgttttcattgctgtttaagattccattgtgtgtacaccccagtgagttcattcattttaatgttagacttttcctgatgagatgattataaactgctgctctgacctttcctgtacacatccctggtgtacttgtggacatctttctgttgagttttacctcagaatggaattactgggtcataaaggtaggcaagtcttcaaatttatttttcaaaatgccaatttttcaaaatgattttcttaactgtccatttctttcaataacacttaatgtcttttgacatatcatacttacttacagtgtatattatgtgtctcccatcactaaaatataagctccaaagatcatgtgctttttttttatatttttatcccaagtatctagaacagaacatgggacatagtaggcacataataattacttgttgaatgaatacattgaatctatgaatgctgcagccaaaagatagctttctatttattgattaactttcctttcacatgaattggattagaacaaacagaggtataacatttttttccgaacctcttgggaccagatatgttttagaattctgagtttttatttttcatattttggaaagattatacagtccctatactgtatgtagcccagtatcacaagaatggtctctgagagcataacataatcaaatgttttaatgttctgcagtgaaaagtaaatgggagaagaacagactctaaacagccttatatcagttaaagtagttgtttagttggtagaattttgaagtatctgcctgtcagacgaccagtgaagattatgatgctaaaaattacacatcagcatttacaaaaatggtttacctctctctaccactctgtgagatgataggcaacccaggtattattatacccatttcacagatgatattatggaggcaccagaaaatgggactctcaccccatggcttactaaacagcagagctgacacacaaatcttgtctttcgattctgtccagtgcttttcaactatgccacagttgcttcttattgaggaaagcagcaatttttgagatttgtaaattaacatttccagaggggaagaaaactcctctataatgaagctgtcacaaatcatgcactgtcgtcctggtatctggaacaaagctaatggcagcgttcccacggaggcgctcgtatgcactgaactgtccagggtcagaactcacgtgtctgctgcagagacagtgctgagcccccatgcatggggcagtgagccttcagcacggctggcctctccttcctgtgttcttcctttcttgagaatttttttctttttacatcagcttcatagagctgcctgttatactccaacctgctctcctctctcagaaggggggatctcaaatcaagcgtttggatttacagttttttttttttttaaacagagttttgctttgtcactcgatctgatggagttttgcactgccagatcatgcagtggcgcaatctcagctcactgcaacccccacttcccaggttcaagtgattctcctgcctcagcctcctgagtagctgggactacaggggcctgccaccatgctaatttttgtacttttagtagagacggggtttcaccatgttgtccaggctggtctggaactcctgacctcaagtgatccacctgtctcagcctcccaaagtgttgtgatcacaagtatgagctaccacgcgcggcctggatttataaattcaatagcaaatatttctgagagtgattttcaggcacagtattaccgagcaaggcatttacgctgagtggattgattgggagtgaatgtagtgtgtgcagtcttctttcatatgatatttcttgctttttcgtctgtcttttccacaggtaagctacatgagtgtatagctttgtatctgtggtgttttctgatgcttccccaatgttgataacaggacccagcacatactatgcacttgccaaatacttgcttaataaatgaataattatttaagccttttatctttaaaagataatgcctttcagctctgttaacaaaactggtttagacaataggaagcagacagggagatttttgaggcgagtaggtagttttaaacatgccctgtgagaatactcatcagaggttattataatgatttttatgtaatcttctgttaagattttgttcacttcatgaggacaagaaactcacatatacctggtgcatagtaggtgttcagaaactatttactgagctcacgttccatccaggtggagcagccccgttcctcccaggtcctccacctcacagctaacattccctgcgcctaacatggcaagcgtggaagactctggagggtgaaaggagaggcagctgcctggggaccttgggacttgaggcatgaggtgctggtggttctctgagtttccttgttgccttgttgccttagacacatgcattacacggcacatgtcctaacaaggagctgtaaaaacctctaatctggaactagcaatggacacagacacaaaatgctccaagaacagtcctgtttcctccaggcatagggctgggcaaattgtggcctagtaacaaaaaatgtgttggccactcctgtcccaatgcagccacacaggaatgagaaaagcacccccttcatcacctggccctccagctggtttcagcgggcagaatgaaaggtaatgtgcatctccaccgctgctccactcaagcgttcaggtgctcaagttccgctgtggggtggtggtggcaggcctcagtaggagctgatcctccattccctgctcagcagtgacaggtggtacactgatccctgcaacccgtgcagtctcagcaggtctagcgtggagctaagcctctaccccaactcagcatcaggtacttaaggagggtgagagaagctgtgcaagttaactattaagcatcaccccacacaccctttcagtcaggcacagggaggaactgaccttcagtcccaagctgcagctacaaagcaatgggagtcagcctcccctcccccttcctggtggttgtaaagtgcatactgaagctcacccctcactgagaagcagcaaggggagaggagtcagtgcttcccttttgccatgatagtgttggagaagcccagcataaagctgaacacacatacccagccggcctttatgctccacatccacaatgggtaagcccactaaaaagagatgcataggatgcaaaggtcttattatatcatacccaaaatatgtgggatatacctgaagaccatttatcatacttagaaccagcagaatcacaacttgaatgagaaaagccaattatcagatgctaaatcagagatgaatgtgatgttggaataatctggaaaatattttaaagcagctagtcataaaagtgcttcggtaagtaattttgaattctcttgaaataaatgaaaaaaaaaaatagaaaatcttagcacagaaataaaagagccaatggaaagcagagaactgaaaaatagaataaccaaaataaaatactcattagatgggctcaatagtagaatagagatgacacagaggaccgaatccatgaacttgaggacaggtcaagaatgtagccaatctgaacaactaagaaaaaatagattggacacaacaacaatggacccaaagggacctgtgggacaagactgagaggtaacattggtatcatcagaattcataaggagatgagaaagaaggttgggctgaaaatgtttgaagaagtaatgtttgacagcatctccgatttggtaaaaagcctaaacctataaattcgggaagctgagtgaacctcaaataggataaatgcaaataaatttataccaagacacatcataaataaacttgtgaacattaagttaaaaaaaaaaagagagaaatgagggaatacttataagggcaggtgaaaatgacagcagtcattcgaaactatggaggctgggaggaagtagcaaatttttcaatcaccaaaagaaaagaactgtgtacagcaaattttgcatctggtaaaaacatccttcaaaaatgaaaggaaaatcaagatgttcctaaatgacagaaaggtaggaaaagatgttagcaaacctgtcctattggggaagagctgcataaaatattctaaacagaaataatagaataaaaacccggactttagaaagaaaagaatgttggagcgcagaaaaataggggcaaatataatacacaatcaaacttctgttgaggttcatatgtgatggttgatgcaaaaattgtaactttatgtgctactcagtgaatgtagaagaaatatgtaaaacaattacattttagaagtagaaaaggaaaggaacctaaatggaagtaaggtttctacacttcaaagtatcatatatgtacattgtgatacccatataaccactaagaaaactatccaaaatgagatacagaaaaacgttagaaataaatcacaacggacttctaaaaaatactcaacctataggaagataagaaaagagagaataataagaatataggaaaataataaaatggcacgtttaacatgcatatcaataattatgttaaatgtaacagatctaaatataccaattaaaatacctagatttatagaatgaatgaaaaaaatgacctaataatatactgtctacaagaagctcacttaaagtgcaatgacataagaggacagaaagtaaaagactagaaaatgacatatgaggcaaacttttttttattttattttttgagatggagttttgctcttgttgcccatgctggagcacagtggcatggtctcggcccactgcaacctctacctcctgggttcaagtgattctcctgcctcagcctcccgagtagctgggattacaggcatctgccaccattcccagcttatttttgtatttttagtagagacggggtttcaccatgttggtcaggctggtcttgaactcctgacctcgggtgatccacctgccttggcctgccaaactgctgggattacagccataagccaccatgcctggccaaggcaaacgttacttttttaaaaatgcaggagcgtctgtattaacatcagacagagcatatttgtattaggtgtccagggctgcagtaagaaagtatactcatgggctgtacaaggacacatatgcctgtcactcacgcatacatacattgccagtgataatgtaaaacaggacagtcaatgtgggaaagaatttggcagtttttcataaatctaaatatgcaggtactatatgctgtgttctaaaattgaaagattggttgggtgacaggacacagcgcactgaccctgagttagaaagaagctacgactctgttgctgacagctctgaaggagaaggccaggccaccagcaggaccacatgggatcaggtaatggcaggcaggagctgcaggggacgaggtcagcttatgtatggaaagcatttagttaattttctcaggatccctgtggattggagagttggaataatttcagtaggttccagggcactggggcagtcccttgttgtctggtgcctggccctggagcaactggggtaggcaggtagtggccctggagtgtgagtgcccagtaagggaagtggttgggatgggaacttcaacttgatctgcagctcaagaagggagatctgagtggcttctagccagaatctccaaactgggttgggatagcatcaaaacacacacacacacacacacacacacacacacacacacacacaccaccctgtatcacatgggcattgtttccaagacaaatgaaaaattatgttcacacaaaagtctgtacacaaatgttctttttttttttttgagatagagtctctctctgtcgccaggctggaatgcagtggtgcgatctcagctcagcctcccaaggagctgggactacaggcacacgtcaccacacccagctaatttttgtatttttaggagagatggggtttcactatgttggccaggatagtctccatctcttgacctcatgatccacccgcctcagcctcccaaagtgctgggattacaggcgtgagccaccccgcccagccccatagcatttttattcataatcaccccaaactgaaaacatcccaaatgtccctcagctggtaacagatatcgaaccgcagtccatctgtaatgtgggacgctgcttcgcactgaaaaggtgtgaactgtcgatgcacacggcaacttggatgcatctccaagaaatggcggtgatgaaaaaaattcagtcccaagagatcgcatatggtacggctccatttatatggcattgtgggaatgacagaattatcagagtggagaacagactagaagtctacacgggtcagcaaagcagcggagagaggatagagctggatgcgatcatcagaaagtaacacaagaggtccttgcggtgatggaaacgctgtgtgtcttgactgtgttaatgtcgtatcctgctcacagtgctgttctatacttccgtaagctgtcgtcattgcaggaacctggataaaggtacccaggattgctgtatttttcttacagctgcatgtgaatctgtgttatctcaagagcttagagtaagggaatgagaggagaaacatggcaccctcaaagattattagagaaggttctatttccaaagattagaggatttccaagaggaaactactctggaaaggatttttaattgcatttagggaagccagtgtactaagagctgagacaatcagtgctcagtgtagtaatgatacagctacttcctaactcctttctgggtgctataaagacaaagttaattgtatcattactatttcaaaacaactgaggcttttaaagtgtttcttaggagtgttacaagcctgtctgaagtcctggagagcaatgaagtgtagatccaggaggctgcagtcaatgcagtgtggtggttgagagaccaggccctgaaatcagacctgggtcaaatttcggctctaccagtttctggtcttacgccctttggcaagttagttaatcttttgaggtttaattcttacatgtagtatgagaactgagaagtaataactgtatctatactgaaggagtgttataaagaataaatgagataattaacacaaagcacttcataaatgctctacaaatgccagctttgctgccgttgttagtattataattagaagcaggagcagtagtggtgcagaggaatccagagacaaatttcgtctttgtttctaacagcatgatttctagaaagtcacttagctttgcagacctcagtttcctcatctagagttttagtatgttggagtagatagtatgtaaagtatcttccagtgtttatcttcttggatgctacagtgaactttttagagggaaaatactacagcggctgaaagcacaggctgaggagtctttcaggcctcagtttggatcctgcctccattctgaggcacacaccgctcatggccaatccatgtcctgtgtcctctgccttccttagagtttgccattttgttcagaacagcactgtgagctccctcccacctccccgaccctatgatgaatcatgattgctctaggacaggtcagcagactactgcccaaggggccaatccatccatgttcccaccttctgctatacttgcgttcctgtaaataaagttttattgtaacacagccacccattcatttatgtgtcacttgtggtggtttttccagttctacatgtggagttgagtagttgtgacagggatggaccatatggcctgcaaaccctaactgtttgctatctggccctttacagaaaatgcttgccaccctctttcctaagaacgttatgataaccctgcttctgtcaggtttccagcttcccttgcagctatggggacctgatgattcacctctcccacaaagatgtcagcccgagccattggagcctgctattctccctcctccctgttcctgttggattgtgtgcagttgtttctaagtctagtgcttataggtgtagctaccatcctgccgttataagacagtaaacctggtacaagctaagcagggtggaacagagagagggaggggcctgcattcttgacagacattatcaagttcttgtactggctctggattccctacgtgtagtattttttgttatatgagaaaataatctcttgttttttaaaaaggacttttaaaattatttgttgtggctgcctgtaactaaatgccatccacctattacagactttttactactggtgaaattttgaacaaattatttaattttactaggcctcagatttcctctctgtttcttactttagtaatgaggattaggttagatgaaaaatataaggcttttgctccgttcctactacagaggaagcaaataattggaagttattatttttatttcccaatgaatccattcataattctaaattattttgagtctgtgtctacacaggcccatatctgccaaattaccttttgcaaaaaaccatgttttatttagaaatgctttgacagccagaacatgtgtgtctattgcaaacaaaaatattttcagtttagaaatacttgttttgatcatccgtgtggaaatgaatgttttgtatttgagttgttaagctacaaaatatatttgctaaatgtttttgcaaaaatattcatccatttcttagaataatgccttagagaagcacccagtggtaattatgttcttaggcatgtttatgacacagaacagatcgaaccttttggaaaaatctggaatggaagctgggactaatagcccagtgactctagatgcagggcgtcacctacctcatcacgacgctaatgtttccagggcttgctagttgaatttccacatgacgattagcacaaatccagaactaaatgacaggttatacttctgtctcaagcatcatatgatattgatttttttttactgtaactagaaatttttttcctggagggtcatgagaaaaattgtattttttgacaaaagtataataatttacttgagacttattgttaatgttcagtgatagtggcagggatttatccttttataatccttacattgtttctctttcaaatttttcgtgtagggattataaaaataaacccactggatagcttgtaccttttgctggcatttaggataaagagaaacccaataaatcttgcgtcgagtggcctcactgatattgattgaattataagatcatagtatagcttttacagataagtcaccaggaagacatcacacaatgttgtttatagaaagtaagaaagcaggtcttcttttgtaagattccatattaatcttaacccccgtaacattatactgatatatttttcaagttgattataactctctactacaaggtcaaaataaaccttatattaataaaaaccatatgacttgtctttagacatccaagaaaatttaaaagtaatactttgcgtgtatataagaactttcataatagacagtctcaaaacacttcagaaataaaatacactcatattatagcctggatgtctataggcattcactgggctaatgtttccttccaggactctgtgaccttctagaattactcaaagacagtgtgtttgccctcactggttgattttgtccttcaaagaaaattatttggaagaaaaaattttcaacttattagagaaaaatactcatttctcattttcttatcatttgacaggaagcttaccaatttattgtagataattacaccaatgtttcattccttagaatcacctttcaacatgaattcaaatgtatacgaaaagcaatagagaattctggactttagatttgcaagaaataaaaaggctccaattttcttaagttgttatgattaccacagagtaaaaaatgccatagaatgaaaatgtcttatgttgataggaagaggtcagggctcttactcgaagtacaagataaatcacaggcttaattttggatcacagtggacccctccctccacttcagctgtggaaatacaaagaaaagagttgcattgaagaaacaactggagtccaagtagcactttgcttccgttacaggacttggagcatgttataaatggctcaaaaagtaggatactctctccccttttcagggatctgtataaggaggcagtcatattcaaaatacaaagtagaagataaatgttttctgccggcatgatattttaaaaggaaaaatatgattatctaccatgatgcattgtgaactgatattattgatttttcctcttgtgaccttggttgcacagcaccaacacaaacacacaccccttgctggaaggtctagtttcaggtgtgaatgcgtagaagtcagagatttaaaaaatagggggcttgtagtatttgtttttgccttaattaagagttaatacttggcttatctacttactcattcagacagcgtgggttgaaaatgtattataaggcaggtaatgtgaggcaatgggggtgtctttaagaaggtaatagcttatctgagccttttatcctgcaggattcactatgaccttgcttttccactcccctcccgctgggtctttcagtctgtccccctttatttttgcttactcattcatgagtattcattaaactcctacaatgtaccaggcactcagaatatagctgtgagcaagacggttatgcttcctactctcatttagcttataattgagttggaagacagacattaagtaaatacttatattaataattttattgtaattatgatttctgttcagagacccaacataatttcaagtttccattttttcttaaaaaattctttctgattctaaaactttatagacaactaagaaaaaaataggaataaatcaggaaaaagtaacctaagatatcccaccagcccaaaataacttgttactatttaaaatgctttttcttgcacttttctttagtgtgtatatgtgtgtgtctgtgtgtgtgcacctgtgcccatgtgtatttagaatttgggatcatactatatagttagttttgctattctctttaaatgatcattaaacagagaggatttcttatattacatatttttcaataacatattttaagcttgttgaataatttgtattttagttatgtagcataaattatttgtttatttgggtacatttcagttatgtccttcaatttttgtgcttatttaaactgatgtgataaaaatataaactcttggctacatgttttatttagtctactagataatctagaattggaattacttggtcaaagggtataaatatttttgaggtgattcatatattttatgaaacattatagaatatttatactctttgatctattcaatgtaatatacaatatgaaacattcccctgtattctagaatcgcatcgatttatacatgccttcaagtggtatttgtgtcgagtttacgtatccttggcaccatcgagtattgcactggcaaatacatttctattttaattatatattaatatgatagataaaggtagcatcttggtaatttaatattttcatttatatatcatccagtagtatttcacgtgtgtacctgtaatatttgccagttttctgttgagatgatagccttttttacaaaataaatgaacatattttagacatataataaaattttagatgccatattatatattaatatgacttaatatcttatgtaatagtgtagacatatttcttaacgatattaataatttttgtttttttacaaataaaatgttgtatactcatttataatgctactttgagactgtgtggttatataaacaccaaatttttttcttcattatctctgttcttttgtaaacctgtttttcttttactaatttccctttttgcataaaaatgtcgtaatattcattattccaaatccctctcgttatttggtttgtattgtttcatagtgttacttcctcattctttggaccagtttcaaaatcacaatggacagttcaaaaaacatgttaaggattttgattcgaattacattaaaagtataaatcggtttgaggagaactgacatctttacaacattgccccatttcctccagaagtattatctgtccgtcagctgatccatgcttttctttgtatcttcctgtgacctttgatatgtttttttcatagatgccatgttttttgtgtggctagatattttatatttttgttgctattatgaatagtttctttttattgtttttttctggctataattgttatctttctctcttggagatcatcatcaactaagtgcaagatagtgacaggaggtctagtttcacatccctggagtatctgggaatctattgttatagcctctagattctggcactggcctataatttttaccagcctaatctctgctatcccctagctatgtatactgaagctgcagtgaacacctggtccccgcagccatctcattttctccttcctgcacatttgtctctgccttgaccctgacctctgccccaggactgtgtccatgctctgacactcagctgcatgctgccttgctccctcactcgtcccacctgcatgtgactgactcttcctccagacctttgtggcattttgtttgtatctttcttgggagtatttgtcatagttcaccttttatgatttatgattatacctgtcttgcccaaaagtgtgcccgattggaaggcaaattgtaaaagactaagcactgtgacaatgggaaagtaatttagattgctctttgcctcagtctccaaactcgtataggaatactaagttgtgccctgcccactgcataagacttcgtgaaagctctttgagatgtgagaaaggcgaatctaagagatggccaccgggaggtcacttcccctcctaggttgggcagtgcatgaaggcaaggcctggctttcacagtacttcatgcaggtttcatttagctcaacaccctcctctcatagacactcacagttagattgaatcagagggtggccacgcttggcaagcggggaatagcagccaagttgtagtggacttggccgtgtacagagaaggatggattccaggtagtgaaattagaaattacacctcagtcggggacctctggttacctctggcacttacattggtctggaaagaatgtatttatgttggtggggggggaaaagcatatgaaattgagacagtaggtgatccagtggatgttctaagacattccctggaaaacaatgccactgtcttggtgtgtctgatgttctggggaacatttgaaaaacatccgtctctgggccacatctcgagtttctgattccatagtttgagcccaggaacctacgtttttacaaacatccctggtaattcctatcgtaagtttgtgaaccattgcactagaacaggattcttaatagtgacatgcaggccttactgaaaatgatttgttctgtggaatgagaagctaacaaacacacgtacaaacacacaagcacatttcctagaataggcatttctgttctgtagaatttcttcaagtgtcttcttattgatctaccaaacatgaaaatatttccaggatagaaatgctttcccagaaagcaggtataaaggtgtttcattgggaaacatattagagactctacatattagagactaacagttgttatgatgtgaattttttctgtattactacataagtcactctttcttaattgctaaaaatatttatcagtacctgatcacagaattcttacaagacagcatggtctacttacactaggcgcctcacacagcaaattaaataagtatttccgtctaagaatttgcatcctaaacacttgcaggaggataggaaatggattctgtcattataataggatttaattattcctttccatgattttaaatattatgccaaatagatgctcatcgtagtatacaagtgctgaagaatatgagtagattaaaatcactcataatcctgttttctataggcacccataagcattttctcatgtcttctctttctcttacatatgttttttgttatggagttcctacttgataagctgctttgtaaagattttaaaattcagattatatcataggtgttttcatttatcaaaaacttcgttaaatgtccttttaatgggtgcataatagtttattatattggaggtaccatactttgatatgaatatccttgcagtcagaactataaaacatggagaattacattgttagtgcattaagcatttcaactcaacacagttaattgagacatttatatcatgtgtacattttccttataacatgcacttattattccggtgacataaatcttcagaagtaaacagagaaggcaaccgctagacgtagcctgtatgtgcagtagagggcagaggaagaccagcagtgtaatcacctggaagtcatcacccaaattaccttatttcattctgcagtgatgacacaatcaaagctaatgagcaattttacttttcacttatttcgggttttgcagcatttggagttgctgacgctcattggcttcctggcatcttcttttttgctttcctcccaccgttcttccctgtttcctccttcgttcctctcagcctcttctccgcgttccggttttcccacttgtcccttgttcttatgcaatacttgatcctcttctcactctaaactgtctcctggctgatttcctcttgctcccatgtctttaacttcctcctagagatgatgtcctgccaacttaaatcttattgccactctctccactgtgagactcccctaagctcccaccactcactgtggtccttgttcagatccatgctccactgtgtgatcttggtcatcctccactccttggatcccccaatcacgtgatctctgcttgtacacattgcaccgtatatgtttgctgtgccctgacgtccaagggacacgttgcatatgtggagagcagtggcaaggaatgattgattgcttgattgaccagtaactgattggatcactaactgataggcatgaaaactcctccctcactaattcctatataatcctcatctgagcccaggatttggtgatggtgctctgtaatatgtagtccaactttctctttctcacagagcttacatttctctgtgtttgtgtgtgtgtgtgtgtgtgtgtgtgtgttgttacctacatttaaggttactcaaaaagcagcaataattgtatcttatgtaattattgtctaaatttctaatcctttggtgccgatttctgaaacaatgttaacaaaagtaatcaaaggatgaaataatatatatttaattatttttgagttgtgtcagttcttatattaaatagtgtattgaatttagggactaaaatgtaattataacaaagcaattcactctaagaacatttgattgtttataatactgtagggtgtctaacagtagataggagacctctgatatttaccatagaagttcctttaaaaaaaaaaactcataagtaatacggtttatggaaaaattcatcttgtttatggaatggtagtgcgaaatagaacttgtattttagaaatgctttaaagatcttgaatgagatatactctctcaggttcttaaacataagaatcagaatatgaaaggcatgttttattttctagattttccttctctcgccatttgactaattcttacagtaaaagtaggggaagtgaatgaagtgaacatcaatgatcccatgctaggtttgtttatcttacttttggaaaacaatgataatgattctgtgtagggctgtggtttttaaattgcttgtctgctaattataagaaaagccaagatattgaaatttgtgtagtgctaattactcatccctttctttcccgctgcaatttacagtgtgtcttcagggtgtcagtcactgatttggagcttctgcctctgcttcttctcagcaattaggtctcatcttcaactaatggaattgagtgacgtttagctagtaatatggggaatctgtcttcagctctgcttcattagaagttggtgcgaggccttgaaaaaggtttcctgtttgttgctaagacaatgtgatttgaacttactctaatacccctttttttgagtcatttttgtctcactgtcttcttactgcttgccccacatgattctttgaccatcttcatccccaaatctgaattttgccttaagcaagatgtgcaaaaagtacttggttttacttctaaagctgatgtggtttataacttactcatttcctctccccacttcactcctacagtaggttttgctgcttttattgttgtcaccagtatttctatgtggtaatgatccttgaatcttattttgctgatcatcaatctgtggaagagaaagactgttaaaagaggcctcttaactcgcactttcagaaagatggaattagatggacttttccctttttgtcctgagtacagctaaaaactgtgaacattatatgaaaagcataggaagatactgaacagtggagagaagaaggcagacagactgaggaccttgagacctgatgaatggcacagtgctggcatctctgagctttccgtttctctcatttagcttgcactgggtgttgagaagctaacagtccagttgccagtgggcacagacaagaaaagcacccccaaaccctccccttcctcccaaaggaccacaaaggaggcagcttagaatgacagaaaacttttggacaataaccactctgctatagccaaatactaccgaagaaaactgtggccatattcacaaacccccaagcaaaggctgagcagggagcttagactttcagcgtgacccccatcagaatggtaagaaagaaggatgggtgtggggccaaggcttgtgtctcctcggtgtggtcacgcgttccctctcacggtattggagagagcacctgaggcgcctgaacttccaccttacctggtgctgtcagggtgtcccttgtcctccccactggggtgatatcagaagaggcctagtggagaatcaggattttcccatcttctcagtggtgacaagggccctcctcactcagagcgtcagtggaggcgtataaggagcagtcacagaaccctctgcacctctatctcagctcaggctgctatagtaaaacaccacaaatactggggcttagacagcggacgtctatttcctcacagttctggaggctaaaagttcaaggtcaaggtgctggccagctcatttcttggtgagggctttcttcctggcttgtaaacaaccaccttctcgctgtgtcctcacatggcaggtagagagagagaacaaactctctggtgtctcttcttataagggaaccagtttcatcataagtgccctgtgctcataacctcatctaaccctaattagttcccaaatgtcctatctctaaatgccatctcattagagtttaaggcttcaaaatacgaatcagttggggaggacacaaaggatcagtctataataacctcctacccaggagagacatcagcagagaggcccaggggacgctggagctttcacccaaacctgggaggaacaaggaatcaacttcccactcccaggtgtcaagagaggccaagtggggctcctggatgtccacctgccacctggcagaaatgaagggcggcacttctcttggattcctactagtgcagtgtcagaagaggcctgataaaatagaaggctaaagtaacatacacaatctcataacatgatatcccctaatgtccaggtttctagtgaaaatcattgatcataacaagaaccaagaatatctcaacttgaatgaggaaagacaagaaacacccacaacaagatgatacagatgttagagatgtccgaccagcattttaaagccagtcataaaaatgcaatcaatgaggaattacaaacatgctggaaatagaaagaaaaaagaggccatttcatcaaagcaatcgaaagtctcagcaaagaaatagaagagataatagagtactgaatggaaattttagaactagaaaatttaataaattcaattaatcttgatgatgtactcaacagcagaatggagaggacagggaaaagaatccgtgaacttgaagataaaaaaaatagaaaatacttgatctgaacaacagagaaaacagactaaacaaacaaacctcagagcctcagagatttctgggactacaataaaagatttcatgtttgtatagtcagtatccaagaagaagagaaagagggtagagttgaagaattattcaaagaaataatggttaaagatttcctgaatatggcattttaaaatatggcaaattcgttgaagaattgttcaaagaaataatggttaaagatttcctgaatatggcattttaaaacacataacctttcaagaagccgagagaatcccaagatcaaagaaatgcacatcaagaaacatagtagttaaacttctagaactaaggacaaagaaaaaaaattctaaatgcagccagagaaaacagtacctgacatatagggggaaacaatttgaatgtcatcagatgatctctcatcagaaattgtagtgaccacaagaaggtggcaaacatttttcacttactgaaagacaagaactgtcaactgctaattttaaagctggtgaaactatccttcaggaatgaaggggaaattcagacattctcaaatgaagggaaaactaaaggaatgtgtttctataatacctacccttaaagaacaggtaaaggaagcactccataaacgattttttatttttattaagatgagagttatcttgggacatcaagaaagaaaaaagaacagaaaaagcagaaatatagataaatagacttttcttttccttttgagttgtctaaattatgtttgttggttgatgtaaaaagtataacattgtcaaatgtagttcacagtgatatagaggagatgtttatgacagtcatacttggtgtaggataagggacttaaagaatggtaaggtttttatacttaaactggtaaacgttgatactaacacaccataagccttgtggatataatgcaataattaaagcaaccactaaaaagctatccagagagacacaaaaatgccataggtatgtcaaaatagaatttcaataaaatgttcaagtaacagaaaagcaaaaaagaaatcagggaaacaagaaaacagagaacacccacaacaaacaaacaaaaatggtgaacttaagccccagaatgcccataattatagtaagtgtaaatggtttaaatacaccaatgaaaatgtagagacaatagagaaaagtcgattcatctatacttttgcactttttgttctttcttctttccttccagatgaccccaaatacctcccaccttttttccccttatttctatttttttggtgtgcttccgtcagctattccttaaaggtgggtattataggaacccattctcttagtttttcttcactgataggagattggtagagtaaagaaaaaaaatgtggagagcggacatcttgtggctgtgtcgtgcgcgtgagccccatagggctggggaggaaccagttgccgcgcagggaggaggctgaggctatctacgtagaaaattccaaggaatctatttaaaaaaaactcagaataagttcagtaagatcaacatacaaaaatcaatcacatttctatacagtagcagtaagcgtggaaattgacagagaatacaatactgtttaaaattgctttaaaaaacacttaggtataaatccaacagaacatatacagcacttgatgttgaaaactacaaaataccgatgacagaaatcaaagtgctaaatttgtggccaacatgccgtgttcaacatgtccatgtctataaaaagtggactatgtgtctataaaaagtgaatttttcccaaattgatgtataggtttaatgtaattcatatcaaaatcgtagcaagactttgtgtaggtacagaaaagattgttctagttgggagtggtagcacgtgcctgtagtcccagctacttgggaccgtggggcaggtggattgcttgattccaggatttggggttgtagtgagctatgatcgtgctacagtgccctagcttgggtgatagagcgagaccctgtctcaaaaaaacccaaaaatataaaagattattctaaaatttatgtggttaagcaaaggagctggaataggtgaacagttttggaaaagacggataaggtacaaaggatcactctattcaatctgaattcttacaatataggtaatgtaataaaaactgtgatattgttgtagggatagacacatgaatcaatggaacagaatggggaacatagaaataggcccacataagtacagccaagagatttttgacaaaagcataaaagcaattcaatggaggaagaatagtcttttcaacaaatgctgctagagtggttggacgtgcataagcaaaaaaaaaaaaaaaaaaaaagaaaaaagaaaaattgtatcttgacctacaccctaatctttatataaaaatttacttaaagtgtgttggattaagtgtgaaatgtaaaactgttaaactttcagaagaataaacctctggggtttagaacttagtgaagtgttcttagacatgacaccagagacacagtccataaatgtaaaaattcaataagttggaattcattaaaatttaaaacatctgctctgcaaggggatgaaaagacaaaccatagactgtaataaactatttctaagctacatatttgagaaagtggccatatttggaatacataaagatttctcaaaattctacaattaaaaaaatctaatgctaaaatgggcaaaagacgagacattttactattgtacgttttcttgtgggagcaaagtaaatctttttaaaaagcaactgtgtctttttcaactcacttcttggaagtgatgatggaagtgtgtattcgtggctcctgcagaggttttagctggactttccatactggacatgaataagcacccctctccccctccacattagggccggatagcattcaccactctcacctgcttagtcttctgccccaaactgcttcattcatacctgcttctggaacattttctcgtacactgactccagcacagaggctgttctttctaagttctccctgaattagcagtgatgagatgcctcatgacccgagaaacctggccttggctgttccccatgttggactagtattggagatcacatagtttattgtttcacttgtcattgactagaaaataaattagaaagatggttcaagttcagcatttttactcatggtactccttgacttctgcctgttttgcaaaagagggtctgtagatgacaaaaacatgaaaaagacattcagtggaaatgcagattgaaaccaaaataagagatcactagctattagaacagctaaaataaaaagtagtgacagtaccaaatactcaggaagatgcaaagaaattggatgtttcatgcgttgctggtggagatataaattggtgcatctagaaaatattggaaaatagtagtttctttaaaaagtaaatgcgagactctgtctcaaaaaaaaaaaaaaaaaaaaatgtatgccgacgatacgacttagttctcctgaacgtttgtcccagagaaatgaaaacctgtgtctacacaaaatatgcttctggacattctagaagctttcattgtaatggccacaaattggaaataacccacgtatttttcaatgagtgaataattttacaaattatggtgcattcatgtcatagaacactactctgcatcataaaggagtgagccgttaataatgtaacacttgggtgaatgagtctgaggggaattacactgaaaaaaagcctgacttgaaaggtcacatgttgtatgattacatttatgtaacattctcaaaatgagaaaattatatagttgaactaactagtggatgccaggttgggatgaatgggaggattagatgtgtctattagagtagcaagagggaggtgtgtatggtgatggcagttttgtggctggactgtagtggtggtgaagtcagctacacatgtgataaagtgacagagctatactcacacattgcactaatttcaatttcctgatttttcaatgcattgtatttccttaagcagtatccattaagagaatcagggtaaagggcgcctgattttctctgttctatttttccaatttcctatgaatctataattatttcaaagtaaaatactgtttttttccttgaaaaaggagacttctccaatgtccttcaaaaatatctgtcgttggcttcccaagacgtgtgaatttgttgttgttttattgtgtttttgttttgtgtttgttggcatcaaccaatattttctttattttatttctgcacattttacttttgtttttcatctttttatttcaataacttttggagtacaaatggcttttggttacatggatgaattgtatggtggtgaagtctgagattttagtgtacccatcacctgagtattgtacattgcacccagtttgtcgttttttcttcctcccctttctgagttcccatagtccattatattgcactgtatgcctttgcgtatccacagctttgcttccacttataagtgagaacatatggtatttagttttctattcctgagttacttcacttggaataatggccttcagctccattcaagtttccgccaaagacgttattttgttcttttttttatggatgagtagtattctatggtgtatatataccattttttctttatctactcattgtttgatgccacattttctttatccacgcattgttcgatgggcacttaggatgaggatccatgccaatatcgattttttttttttttactttttaataatggccattcttgcaggagtaaggtggcatctcactgtagttttaatttgcatttccctgatgattagtgatgttaagtatgtctcttgtatatcttcttttgagaaatgtctatttatgtcctttgtccactgtttgatgatgatatttgtggttttcttactgattagtttgagttccttgtgttttctggatatcagtgctttgctggattcatagtttgcaaatactttcccccattctgtaggttgtctgtttactcttgatgattgtttcttttgctgtacagaagctttttagtttaattagatcccatttatttattttcatttttgttgcatttgcttttgaggtctcagtcatgaattcttttcctaggccaatgtccaaaagagtttatcctaggatatctaatagagttttatggtttcaggtcttagatttaagtctttcaccatcttgagttgatttttgaataaggtaagagacagggattcagtttcattcttctacatgtggctagccacttttctcaataccatttattaaatagagtatgctttccccaatttatgtttttgcgtgctttgtcaaagatcagttgattttaagtatttggctttatttctaggctctctactctgtttcattggtctatgtgtctacttttgtatcagtaccatgctgttttggtaactgtagttttgtagtataatttgaagtctggcaatgtgatgcttccagatttgttctttttgcttaggattgctttgggtcttagggctctgttttgtatccatatgaattttagtatttttttttctaattccgttaaaaatgatataggtattttgataggaattgcatgcaatctgtagattgttttggatagtatggtcattttcatgatactgattctttcaatccatgagcatgggatgtgtttccatttatttgtcatctatgatttttttcagcagtggtttgtagttctctgaagagatttttcacctgcttggttaagtatattcctagtgattttattttattttattttattttattttattttattttattttattttattttattttattttattttttattttatttttgcagcttttgtaaaagggattgagttcatgatttgagtctcagtttggtggttgttggcatgtagcaatgctactgattggtatacattgatttttgtgaactgaaactttactaaattcatttatcgaatcaagtagtcctttagaggagtctttagggttttctagttatgtgaccatggcattggcagacagcaataatttgactctctcttttccaatttgggtgccctttaattttttttttatcttgcctgattcctctggctaggacttccagtactgtgttgaatagaagtggtgaaagtggtcatccttgacctatttcagttctcagggagaatacttgcagctttgtgccattcatgatgcaactgtcatgatgttggatgtgggtttgccacagatggcttttattttgaggtaagtcccatctatgcctagtttgttgagggtttttataataaagggatgctagattttatcgaatgtcttttctgcatctattgaaatgattatatggtttttgtttttaattctttttatgtgatatatcacatttattgattcatgtatgttaaacctccctgcatttctggaatgaaacccacttgagcatggttattatattttgatgtgctgttggattcaattagttcatattttgttgaggatttttgcatctatattcatcaaggatattggtctgtagttttattttttgttgctgttatgtctttcctggcttggtaccagggtgatactggcttcacagatgagttagggaggattccctctttctcagtcttttggaatagtttcagtaggattggcaccaattctttgaatgtctagtagaattcagctgtaaatccatctggtcctgggcttttttgttggcatttttcttttttatggagtcttgctctgtcacccaggctggagtgcagtggcacgatctcagctcactacaagctccgcctcctgggttcacaccattctcctgcctcggcctcccaaatagctgggactacaggtgcccgccaccacacccggctaatttttttgtatttttagtagagatggggtttcaccatgttagccaggatggttgcgatctcctgacctcgtgatccacccactttggcctcccaaagtgctgggattataggcgtgagccactgtgctcggccagcaacttttttttaaattactcattcagtctcactgcttgttactggtctgtttagagtttctgtttcttcttgatttaatcaaggagggttatatgtttccaggaatttattcatttcctccagattttctaatttgtgtgcacaaaggtgttcatagtagtatcaaatgatcttttgtatttctgtgctgtcagttgtaatgtctctagttttattactaattgagtttatttgaatcttttcttctcttggttagtctagctaatggtctatcaactttgtcttttcaaagaacaagatttttgtttcattgatattttgtttttgttttttgtttcaattttatttcattttgctctggatctttgttatttattttcttctgctagctttgggtttagtttgttcttgtttctctagttccttgagatatgacattagattgtcaatttatgatctttcagaattttttgtggaggcactttatgctataaacttttctcttagcattgcttttgctgtatccaagaagttttgataacttgtgtcactgttatttatttcaaagaatttttaaatttccatcttgatttcattgtcaattcaaaaatcattccaggagcaggttgtttaatttacatgtgtttgtagttttcaaggttccttttgtagttcatttctcattttattctattctgatcagagaaaatacttgaagtgattttgatttttaaaacatttatcgagacttgttttgtaatccattatacggtctatcttggagactgttccatatgctgatgagaagaatgtgtatctgcagttcttgggtagaatgttctgtaaatatctgttaggtccatttgttctacaggagtttaagtccattgtttgttcgttgactttctctcttgattgtctgtctggtgctgtcagtggggagctgaaggccccccctattatcgtgtttctgtttatctcatctcttaggtctaatagtaaatgtttcatgaatctgtgagctctagtgttaaatgcatagaaacttaggattgtaattcttcttgttggattcatcctcttatcattacataatgaccttttgtgtctctttttttctttactgttgttgctttaaagtctgttttatgtgatataagaatagctacttctgctcacttttgatttctatttgcatggaatatctttttccatccccttaccttgagtttttatgaatcctcatgtattagtctcattgctataaagaaatacctgagactgagtaatttatttttttttaaaaagaggtttagatagctcatggtactgtaggttgtacaggaagcgtgatgctgctcagcttctggggaggcctcaggaaacttacagtcatggcagaaggcaaagaggagcaggcacatcttacatgacaggaacaggagcaagagagaatgagaggggagatgccacacactttaaaatgaccagatctcacgagaactcactcactatcacaaggacagtaccaggaggggtggcactaaaccattcatgagaaacccacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccattcaacattggaaattacagtttgaaacgagatttgggcaggggcacatatccaaactctattaccttacatgtcaagtgagtctcttgaagacatcagatatttggtttgtattttctatctattctgcccatgtgtatcttttaagtggagcatttaggccatttacattcagtgttaatatttaagtgaagcacttaggccatttacatttaatgttaatactgcattcatgatactcttccagccatcatgttaattgttgcctagatactttattttatttattgcattattgttttataggccctgtggctattatgctttcaagaagttctattatggtgcataacaaccttttgtttcagaattcagaactccttttagcatttcttgtagggctggcctggtagtgacaaattctctcagcatttatttgtctgaaaattactttatttctccttcaattatgaaacttagttctgctggatacaaaattcttggctgacagttattctgtttaaggagcctcaagataggaccccacatcctttgggcttgtaaggtttctcctgagaagtctgctgatagaagtcaggaatggtttccctccatccatgctggagactgggcatgcatgcaaggcccttccttctgctgctcctacttaatattccccacccctccctgtatcaggttcagcactaggtagggttaaggctttctctgtggactggattgccaggttccctggaggcagtccgtcccactgtcatactcacagttcttcacctggctcatggtgtaggctgcagcctgctgcttctttcaaagggtctgtggtttctttccatttttctgttaaattccttcattgtttcttggaagaaagttaatggtgtgtctctgcagactattttttctttccaagggggagacgcatgctaacactgcctccaatccaccatattgaaaaaaagaagttttcctatttttaaagtaaaatccttttcttgaaattgggcttttgaaacatttgcctaggtactttgcaagatgaaccaaacttctaatatcaaagggaacttggcccaccaaagggtagaagctgtaggctctctcctcctgctgtttgtcatcaaggcccacacaggggtcctggccccagctgcaagatgggctttgtgtgagctcacaggagcaaagcacgtgccaggtgccccgagacttaaatgttctctctgcttttatatcttttcatcatttcatagtttctgaaattatttgacatattacttgactataaaggaaaaaaaatcagagattttattaaaactctgtaaacattcctaattaaacctcacatgttgttcacaaaccttttatgttttaagctgcttcaggacagagaattgattctcctctcatttttcactgacagatctggtggtacttagagccagtaacatgcagcagttaattatgctgctgtcccacatgtgtacattttgttttcttgcctgtatttgttataaagagggttcatgttacattcctctgcaccctccagaatgattaggtgggcgtgagatcctcacatactgaacacacacttagtaactttcttgttgactggttattctgttgtttcatgttattttaatgagactgggaaaaaagccattgctcaaatctggttattctttattaaagttctcatattggaattattaaggactaatgtcattagggacatttctacttttgatatagaaacaagctgcttagggaaaaatctcctgttttcatgcttgacagtgtagtttctcgtagttaaaacaagtctttatgtactgttttatctcctgtgctaaaacagaacggtgaaatctaaggcaaacattgtgtgtgtgcttcgacactctcgtaaattactcttgccattaatttaaccacagttgtgttatcacttgacctaaaggggctcctggatgattgggaaaccagcagagaggctaatgggccaacaatcttggcagccaacctccgtgtatgtcttggaaaattccttcaggatgtttgctttggcatttgattgttcctatcttcagattaccttattttatagtatattgaatgttgcatcattaacaaatacctggttgatatctttattactgtggcttcaggcagtaatacaaagatttttctctaaaatacaaagtgtatttgaaagcttttctttacatgtatatcagtttcaaactttacaattaaattttattcccaggaaactctcaggatgttcttttgtgtattcataaggtataatttgatggcaacttatattatttttcagaaaggaaaatagtttcgtatccaaaagtttgaattgtcttatttaagaaagttgacacactttaatcacaggaaacagtatgatttgacttttctaaaccacataaaagtatttctaaatatttttgcagatctcttcttctctttaaagtgagaataatcttctttaattttggagactgtgctaaccattatctttgctattaaggattagttttgtaactaaatatgtgttgagtcctgggctcacacttcagggatacatcaggagacaagtaaggcctctgacctcgtaaaatttacctgggagagacaggtagttccaagtaaacaaatgaataaacaagatgatgatagatggctgtgaattctatgaaggaaacaatgactcaggtcatggaggtgatagtttgctttggtgggtgatcgggaaggctgctctagggaggtgacatttgcatagcttcctaagtataagaaggagccagagatgctgctggtaccagggctcagagcatttcaggccatggagttgacatgttcaaagagcccaaagcagaaaagctgtttggtcaagaaacaggaagaaaatgactgtggctgtagtatcataagccaggcaaagggtcaaggcagggtgggagagttaggcaggaaccagatcctgcaggccctggaggccattgaggttcttcccattctgagtacagtggggagcttctgtatgcctggaagctgggggcgttgtgatcttttgatttgactcctgggagaccagggaggagccctgccatggtagacttccaggggaaacatctctgtggctgttttcctgtgcgggcaagttactttgtctaaagcccagtttccacattagtgaacaagattaatgatggcatctacacagtagggttggtgtgacagttccataagaacatgcatgtgaaacggttaatccagtgcttggagaaaagcaaatgctctacagcagaggtccgcaacccttgggtaggaaccaggccagtccatggcctgttaggaaccaggctgcacagcaggaggcgcagggtgggcaagtgagcgaagtctcatctgtatttacagccattccccatcacttgcattcctgcctgagccccacctcctgtcagatcagtggcagcatatgattctcataggaccgtgaaccttattgtgaactgtgcgtgtgagggtcctaggttgcacgctacttatgagaatctaatgcctgatgatctgtcactgtctcccatcacccccagatgggactgtctagttgtaagaaaacaagttcagagcttccactgattctgcgttatggtgagttgtataacgatttcattatgtattacagtgtaataataatagaattaaagtacacaataaatgtaatgcacttgaatcattccaaaaccatcccccaaccctctggtctgtggataaattgtttttcatgaaactggtccctggtgccaagaaggttggggactgctgctctacagcattataacgatattgtcatgttgttttaaagatggataggacatttcactgccttcctgaagcgcatggcagtgggcatatgaacagacatttactgggcagtagttaccttgttagagaaatgggtacaagagtatacctgttcacctaggaaagaagttcattctgaggaaagggtcagaaaagtcttcctaaaggagcagagtctaaatgtggctaaataaacaaggaatggccctgcgacttggcccaggtgcccccacaatatagaccccttggaccttcagtggtgccattggattctctcctttggttagtgcactgttccctgaaagcttctgtgagctgcaaacccatatgcctgacacccaggaatgctgattgctgttggccacaagcttgtcttaaggggatgggcaccaaggcgtgcccatgtggctggggcatggcagggtgccaggaggcaggtgctgcgtccctggagaagcagatcttgcacagcggggagcaggctgaaggcaccaggaaccctctgccagcacacccctgagataagcacttccttcaaagctgagtccggctgctcagcgaattgatggatgatgaagacattgtcttcctttgttaggataagaaggataatgatctttctccttccaagtcgtctgggagctcaggctctgtgttgtgataaagtacaattggggttgtttgtctttccatgcttacagaaatcctattcctcaagaaaagaaagaaagagcctacaaagaacttaaaactaagtaaggacttcaaaaaagaaaggtggagagaggggaaaagatgactgctacacattttccctttgcttcccacgggaatggcttcattcttgccttgagtgtcttagatatgtctctcccccacccgcagcactggcttttctgtcttttaccattgaattaggcctggtctagacttcagtatttatacctgagagtacagaaaagaggcttttcaagaatacgtcagttctgttagaataagatcccatccgtcatcagatacctttctacagctttctgtcacagtatttgatcactgatcatagaacctggactagagatttcatgtggagaatgtactcccttcaaaaggaaaaccattcaacaatttaatatttaattgattaaatacatgtgatttgctaatgttaaggtattatagtcacagcccctcacttgttgacaagtcctatatcaagtaatcatagtgattaaaaacaaaaccgagagtcaggaatcagcaaatcaggctttccactgccaaaatgaacattatattaattcatgactttatttaaaagagagagcacctcagaccctaattcaaagactgtttcatctcagcccacaaacatcgaaatatcagatgagaaacattttgagaggcaggtgtgcagacggcagcaagtcgtgagccggctgcctgacagcaaaggaggaagcgtttaaagtatggagccaggaattcaaaacaacaacacgttgacgccatggtgcacatccagggcaacagaaagagctctggacttagactcagagggacgggaaaaactcagaggctgcagatagaccaggaggtagaggccttgatcactccttgtgtagccagacccgttgcttaaaatctctgaacttccttattgtaaaatatgaaggaaaatcattactattcttagaattaaatatttgtgaaaggagctttagaatgatagaagtaccatagggatgttattatcttttttactctcttttcaacctgtcaattacctgtttaaatatgaactagttattcgcccttccagagtctcagtttcctcttaaattaagaataataagtttatcccatttgctcatttcacatcagtcctttaagtgctttgcattttgttacatcttatgtaagtggtgatattagcattactacattgtaacacagtacacaacatctgaaaatggtcctgaggccttcaaagtttaaatgtcgtttaatacactttattgaagcaggtacagaactgctgtgtaattaatttcaagacacttattttctctcaaaagtgcttctaaaacaagtttccatgcttgaagcgttgagtgtcaagtatctgggagatttgcttttgtaggacggttcatttcccacttgtgccagaatgagtcattttgtgtgtaagtgtcaagcttggagaggttctaattaagtgcaaattacaatgaaattaataaatgacaccaatttttagattttaaaatgtgctttgagagaatgcaatgtgggcttagattgatggtaattctcatattttaagttgtgattcaatattatgtagcattaaaactcaattaagtaaaaaataaatgaagaatcaagtagagagaatactcatctctcagatgcctcagcttctccaatgatggcttaaaatctgttaaatgctaaggttgtaattgtccttattgttcactatattccaaaataattgcacatataattagcttatttagtgagagatactaaatcaccctgttcacaaatatactagatcgtcataaattgtacaaatgtaattgtaaatttaaggttttattttactttttgcagatgagctgcagactatatataaattcatgtatgtatccacttaccagaaattttattaaatcaaaatatatttgacccagcattttccgatccgtttacagtgggagaaggtaggctacgtaggttcttccctcctcaggtggcactagtcaagactgacagagccaccagcaactgatagcccaaagatatcctctcagcctaccgaaccagacacccctcaccttctacctggtgatgcagggaagcccagggaagtgcgttctgtcccacaggaggcaatagcagggatagagaaggatccccagaccctacagaacaaaggagaccaggacagctctgaaaaacacattatcattggaactacagcccaaaaaagtaggcaaagtcctataccctaaacccatcaggcaactgccatctaaaataaaagatttaaataggacaaggagtcttaacataatatcgaaaacgtccacagagaatggaaaattactgaacatacaaagaacaaggaaaaatcacaacttgaatgagaagacacaatcaactgaggccaaaattgaagtgagtcagctgttgcaattaccagacaaggattttaaagcagccatcataaaagggcgtcagcagcaaactattcattctccttgaacaaatgaagaaatagaaaaatctcagcaaagaagaagaaattatttaaaaagtgaaagtgagtgaattgaaacattccataaccagaattaaaaactagcaggattagctcagtaataaagtggagaagacaaagatagatcggtgaatatgaggatagatcaatagaatttgctcagtctgaccaacaatgaaaaaggtagacaaaaaaaaaaaaaaaatgaacagaggctcctgtgaggctgtaaccaaagatctaactttaattttattggagttctagtaggagatgagaaagaaaattgggactgaaaaagcattcaaagaaataataggtgaaagctttctaaattgggggaaaaaaaaaactccacaagcctacagattcaagaagctgaatgaatcacaatagaccctaagaaatcaatttgaagacacttaaacttctgtgttgaaaataagtaatttctgaaagctaaggaaaaattagaactctgaaaaaaatctgtcaaccatgaattctgtatttggcaaaaatatcattcaagtatgaggggaggccacgtgttatcacgtgtaatatcagacctgtaatcccaccactttgagggacattgatgagggaggattgcttgaggccaggaatttgaggccagcctgggcaaggtagtgagaccccattgctacaaacaaatcaaaaaattagccaggcgtggtgcacacccctgtagtcccagctactcaggaggctgaggtggagaactgcttgagcccaggaggtcagtgctgcagtgagctattacggcgccattgcacttcagcctgggtgacaaagtgagaccctgtctcaccaaaaaaaaagaaaaaaaaaaaagaaaaaggaaaaatcaaactaaggaaaaatcagataatgtgttgctataatagttaaatgaggtcctccaaacagaaagaagaaaatgatcagagaagaaggcttgcaactacagaaaagaaagaagaacaaataagtggataataggggtaaataaaatacactacttttcacttcatgagtttcctaaattatatttgaagtttgaagaaaaaaaatttaattccatctcaagcagtgttaaatgtatgtagcagaaatacttaagactattagattttaaaagtggggaagggaaaaagatttcagtccttcctttgaaggagtggaatgaggatacaagtaggctgtgataggttatagatgcctcttataacaattagaggaactaattgaccgaaatagaccatatcctggttcataaaatctcaatgaattttaaagaatagaaatgcatagtatgttctgtaaaaataaaggaatcaaactagaaattaacagagagataacaggaaaactttaaacatgtggatattaaacaacttctaaataatccatgtgtcaaagaaagtatcttaaagggaataaaggaaacactgaactgaatgaaaaatcaaaatgcaaaacaccataatttggcagatgcaactaagggcatgctgagaggaaaatttatagcattaaatgtgtatattagaaagagggaagtctcaaatcaataatttaagctcccacctaagaacctagaaaaagcagataataagagaaaagacacaaatcactaatgttgtaaatgaaatgacctatcactatggttactgtagcctttaaaagaatgataggaaaatactacagcaggtttatgcccataaagttgaaaacttagattagctggaccaaatgctcaaaaactacaaagtgccaaaaactcaacctatagatatataacctgaatagtcttaaagcccttagagaaacttaatttgcagttaaaccctccccacttgatatcctggcagagatcatttgacttgagaaatttgccacacatttaaagaagaatttaaatcagttttacagggttttgtttattaaattaagagtaggaaacacttcccaattcatgttgtgaggccagtattattctgatacctggaacagccaaagacagcatttaaaaaaaaaaaaaactgtaaacctttatgtctcatgaatataggtgcaaaaattctcaacacagtaatggcaaactgaatccagcaaagtacaggaagaattagacaccgtaaccaagtgggtgttattccaggcatgcaaggctggcttcatatttgaaaatcaactcatgtaagtcatactaacagcagtccagagaagaaactttatgagcatatccattgacacagaaaaagcgtttgataaaatccaacactcagctggttgcggtggctcatccctgtgatcccagcactttcaaaggccgagatgggtggaatcacttgggctcagaagttggagaccagcctgggtgacatggtgaaaccctgtctcaaaaaaataataaaaataataaattggccagctgtggtgccaggtgcctgtagttccagatacatggtgggcctaaggtgggaggatcgcttgagccccggaggttgaggcccggaggttgaggctgcagtgagccatgtttgcaccactgcactccagcctgggtgacaaagcaaaactgtatctcaataaataaataaataaataaataaataaataaataaataaataaataaataaataaataaataaatatctaacactcattcatgctaaaaattctcagcaatctagttatagggagtagcttcatcaacttcgtaaagagtatgtacagaaacttacaactaatacacttagtggtgagaaggtgaatgctttttccccaaagttgggaaccaggcaagaatgaccgctctcccactcttaacagagtacctaaccagtacaataaggtaggaaaaaaaaaggcatccaagtttgaaaggaggaataaaagtgttcttatttgtggatgacattattgtcttcattgaaaatccaaaggaatttacaaaaaagtcccaagctaataagtgattccagcaagcttgcagtatacaaaatcaacacataaaaatccatcacgtttctatataataacgcgtggaaaccaaattaaaaatacaataatacaatgccatttataattgttccttgcttttcatcctaatgcctaagtcctgggaacaaatcttgtttgtagatatacccaaatctatattataggtatacccaagtctgtatttcatttggggataaatctaacaagaatagaaactattttgaaatttacaaaatgctgagaaatggaagaaatcaaagacctaaaaaatcagagagactttggggatcagaaaacccagaaaggttttttttttttttttttaaatataggtactagacctagacagtctcattctgaaatgtagatggcatagcacaggacctataataactaaaacaactctgaaaaagaagaaaaaagtaggaggaatcattgtttccagtgttaacgcttactgtatcctgacagtaatcgtgactgtgtggtactggcaaaggaaaagagacataggtcagtaggacaagacagagaacccagaaacagacccacacgaatatgcccaactaatttttgacaaaggtgcagaagtgactcagtgaagaaaaggtggcctttacaataattgtagctggagcacttggacatttaggacaaaagtgggtggaaccttgacctaaagttcatatttcattaaaaagaaaactcaaaaaagtatcacataaaataaaaactgtaaaactttaaaacttttaggagtccgggtgtggtggctcacgcctgtaatcccagcagtctgggaggctgaggtgggtggatcatgaggtgaagagattgagaccatcctggccaacatggtgaaaccccgtctctactaaaactacaaaaattagctgggtgtggtggtgcgtgcctgaagtccaagctactcaggagactgaggcaagagaattgcttgaacccgggaggcggaagttgcagtgagccgagatcgtgccactgcaccccagtctggtgacagaacaagactccatctcttaaaaaaaaaaaaagaaagaaaaggaaaactcagagtatctttgggatctaagactaagagaagagtttttaaatttgatgataccaaaggtacgatttacaaaaataaaatcttatcacaattaaaaacttttatgaatgaccttattaagagtataaaaaccagccactcgggaggctgagggaggggaattgcttgaaccagagaggtggaggttgcattgaggcaagattgtgccattgcactccagcctgggcgacagagcgagactctgtgtcaaaaaacaacaacaaaaaaagtataaaaacaaaaactgcagacatggaaaaaaaatttgtaaaccacgtacctgatgaagaactagaatatactagaatatattgaatatatagactactcttagaactcaacattaaaaacctatcagaaaatgtgcaaaatacatacacagatatttcaccaaagaggatatacaaatggcaaacaaacatgtataaagatattcaactttactagccaccaggaaaatataaactgaaaccacaaggagatatcactacaaacccatcagaatggataaaataaaaaagttgatagcaccagataatggcgtgagaatgcagagaaactggatcactcatatattgttagtgggaatgtaacctggtacagccactctagaaaatagggagttgagaatttcttcccaacttactctgtgacccatgggtgcttactttatgatcctttgcaagctactgcattcttgggcatatctcagagaatgaaaactacgttcacacaaaaacctgtacatgagtgtttctagcaccattgtttgtaatagcccaaacctaggaaaagttcaaatatcttgcaatagacaaatatttaaaacacagtgtagtacttccattccatcacacatcgctcataataagaagtgatgggcttctgatacacacaactgggatagacctcaagagagttatattgagtgagaaaagccaatctcaaatggtcacagaccgcatgagtccatttagattccatttatttaagatccctcaagttacacagttacagcaatggagaagagatcttttgttgccaggagttaggctttgggatggagagcaagggcatgggtggggcttaaaaagggagctggagggagcttggaggtgatggaactgttccctctcttggttgtggtggtagttacataaagctacgcgtgtgataaaattgcatagagtgtatttacacccatccatgagtgcaggcactgctggtgtcatctgaatactctctatgaattctcccaacatcagtttcctggttttgatgttgtttggtaaactgtagttactcagcacgatgttggcactggggcaggttgggtgaaggatgaatgggtttcactgtacatttctttgaactcctcgtaaatctaattatttcaaaataaaatgaattaaagacaatatgaatgagagaacatcaaataataaggctttcacagtacagcgtaggcttctaaagtttgggaggagggccttgagatgatttggtaacacctctgtgggtgcacccttctgacgcaaatgaccctctgttgtctcttctgctctaaccaggcatcagctatgtgggtgtctggtgtttccaaaggagggtaggatgagatcagagagtgcattgtgtgctcactgaggaagggggaggaataatgatctgttcccaggattaagaaagaggaagaggagatacaggaccataagaaaagagaacccagagctgagagcttgtaggaatgtctctgctccattctactagggcttagaccggttggcataacaacttcatgaactgtcggccatccttaagctctcctttaggtaccaattatctcctgattttctcttcattattaacagtaaattattttcctttcctctttcctttcctttcctttctgacaaagtctgtctttatcacccagtctggaaggcagtggcaacgatcatgcctcactgcagccttgacctcttgttttttttgtttttttgaggttatttttgtagagccagggtttcaccatgttacccaggctggtcttgaactcctgagctctagtgatcttccttccttggactcccaaagtgctggaattacagatgtgagccaccaggccagcccaggttagcagtaaatcttgctaagattggcccataaagaataccctggcttggtagactgtacagaagaaggggagactcggagaccacgtcctatgccatagccactattagagagacaggagccccaagaacagtcgaagaggagtggagtttaggaaacaatcagaacaatctctctcccctggtatggcagccgcaaggaaggggcaccctggggagtcagcccagggtagagaagtacatttggagcctttaatcagggaagcttgcagggctgcggcactcaccgcaggggacaccaccagggggaaagcaggcaggagccatttgccttccctcctcttcaatcctgtatctatgtccctgtgctgctgaggtccaggagctccttagggatgcactgtgtgtacgcgccttagcacgctgcacaattccggacacacggggtgcttataaagcgctgtggtgtatttagcagcatcctgtagccaccacatggtgcccagacagctgcaggctgaactcaagtgccccaccccctggtgcagaatcctcagatccggggactcgcgcgggtggctcagcaccgccctctgtctgttcttaggtcttgctcagaggctgaagcagggtgggctttctggctcacagggccatctgaccactcccctcctggccattccccctcctctctcaggacatatgctttccccaagatggagaggagagccagcctgaatccttggtgtttgtaaactcctttcacctggaaattgctttacatgttttaaacttcacattactctttgggagaagaaaagaagtaacaagtaatattcaatttcacacttgggaaacaaacagtgaagttaagtaactttcataatgccagatagcatatctgtgttaggaaagaatgtgtgagtccatataaaattctgtcctcagacgtttctcaagtgtgttctaaaataaaaggcttctgtactcaaaattgagctttgtccctgttgaatagtaaattaagagttcaaaatgagacagtaaataagttagaccaagtaagtaagctgcctttgagtatggaggtagagacataaattcgtatgattaccatagaaaacaggcagcactttcctgaaagaagagcaatttttatatcttaaatataagcctttgaaaaatacggtatttgttgataaaaggaaacttctaagggctgctactatatcttgatgacttaataaggggatctccctgtggatggggtaagttaaaagagattatttcttcagtttttctttattcacacactagtagcaaaattagaaacatcagtgagaaaattatatctgatttgttgatataaccttatgaactttccattataaaacctgaaattaaagtatatgttgttttctttaatgaagtttaaagaattggaagaagacatttcattcagttagtaagtaaaagttgtgtgtgtgtgtgtgtgtgtatacgtgtatatacacgtacatatacatatacacgtgtatatacacgtacatatacatatacacgtgtatatacacgtacatatacatatacacgtgtatatacacgtacttatacatatacacgtgtatatacacgtacatatacatatacacgtgtatatacacgtacatatacatatacacgtgtatatacacgtacatatatatatacacgtgtatatacacgtacatatatatatacacgtatatatatatatatatatagagagagagagagagagagagagagagagagagaaagagagagagagtctcacctgttgcctaggctggagtacagtggtgtgatctcggctcactgcaacctccgcctcccgggttcaagcgattctcctgccttagcctcccaagtagctgggattacaggcgtgtgccaccatgctcagctaatttgttgtatttttagtagagacagggtttcatcatgttggccaggctggtctcgaactcctgacctcaggtgatccacccaccttggcctcccaaattgctgggattacaggtatgaaccactgcgcccagccaaaaattgctgtatgaaatagttatcagtcaggagcaggagctcacacctgtaatcccagcactttgggagactgaggcaggaggattgcttgagcccaggagtttgagaccagcctgggcaacatagtgagaccctgtctgtacaaaacataaataaaataaaataaatagttgttattctattgtaccatcaccttattatgtctgagcagtatttgtttgatgtaggctaaaaggtgagaagagagaaacagaaaactgtgatcatgattatgccttccaaggggcctaatattgaactgtactaggtcgactattaacagactaaaaatgtttgaaagcgcatatgcaacaaaagtggtttttatcccaagaaaagccctggataggctgcctggtccttgggttgctgtcttccatgaggtgattcagagacacgggctgcttgggtcctgcagttgtactgtctaccagctcgcctgcagtcagctttcggaaggaaaaaggaatgaggagggagcccacctacctcttacaaccctggactggcctggcccagaagcatcccatgtcatttccaccacccttccaccgaagagaacttgtcacatggccatgtggccatgcctacctggaaagagggttggaaatacaattcctggctggggtttaaatgtgtattttagaaatgaaaatagattttcgtggacagccagctcagctgcctcagaggccttcttaagctgcattagcttagactttcttatttagccacatcctgattcaatgtgaatgggcctagttgttacttttaagagaaagatagatctacagagctgaatcctttttcagtagatagaggaagtaactttctgaatagagttcagttaagaaggaattgctagggactttcttgctagaagaaaatctgccctcatttgtactagagaggtaaaagaatgcagggttcaaggaagacggactttcacatggtactcccagcaatttcatgagatccaaagcacatggatctcaggactttgagtgaggaaggaactgtccttctcaaagcattgcagcctgataagggctgaaaaggaggagggacttggcagaggacctgttaagtaatcctctggctgttcgccttgcaatcagaacattgtgtaggtttgataaatttcatgtttttcaaaaaaattctctattcatagttacacaagaaactgtgatgagatccccttaagagaatattaatgctatcaatacagttactattattccagcacctttagctcactcttgccactctttggcgctctactttttaatataaaccatacatagagagacaggagccccaagaacagggaggctggccaagctggaaaaataatcaaagcattctctgtccctggagccccagccgtaagtggacaaacttcagttgccggaagccaagaccactggagagaagaaaattgctagtaccagtgtgggagttgtactgtcgtcttctcttttataagcatggtcacgaatgacatgtgatttgaaaccacaatttactaccgtaataaagtttctaaaattactgcagtcggactccaatcgtattgaacagtcaattgattctgggttaaaacatgcttacatcacaaaataatgaccggtttgagaaaaataaggttgtcttcaggagccaatatctcagtgcaagacggacactattaaaattctttaggggaaaataaattgctgatttgctaagtgtgcttgaagcaatatcaccttacatctgcctaatgttctttcctcacagcctcccagtgaaataggtaaagcaggaatttcgactttatagagaaggatctagggatatgagaatccatcatgtgagaacattttagataagtagcggaacccaattcataaaactctttacactgctccaagtaaaacagggcagccagtggattgacacacactgtttttaaagaccagatttagaggtatgctcactcaaatctgttaattctgatcagtgtgaagaacgaagttagtgcttttggatattaagatagttggtataggcaaacaatgaaatttaaaagcagtcactcgactgtaagtatttctttcttacaggaaactgtttttgcagtcttatggcaaattttgaggcccaactctcacccttttgcatgttttcctgtaggaagtaaatgaattctttgttttgtattttgttagcactttctaaagtatttgttttcatttggttttatccattgcaaggcaattgttactgattttattctttgtcgttgaatcatctccaaggttataagttatgttaaaaaacaacttagcctttaatgcttcaaaaactttaaaaggtgggtagtgggaacatcaaccactgtgttctctcatataatcgggagctgggagaaatcacagcagattttgacagtgtcctcagtaccagcagaccttcctgcagaagggtgtccaaacttcctgggctttattcctctattaaatgttctaccaactcccccaactcttctctttactcaacccttgacatgaaacacctttctactgtgtagtccattagggtgtaaatcacaccaaagaatttttgctcaaccactttgctagatagattggaaagaaacaccatttattgcatactaatcaaactgtaattgcctgtcttcctgataaattgaccatgaataaggtaggtctctttgactgacagtcttgggaatgtgcattgcagtctttataggcatgacatgcttctgataagaaagcaggcttgctgtgaggaaggaaacaatgtttccctcttttgaagggactgattttcacaattttcacttgcatcataaataggtgttggcaaaagtatcactcactgattatgtacatggcagatagagaagcatgttacttttagtttaaaaaacaaccttgttgccatgttgatttaatcagagttctgtttgtttgtgtcttctcatctaatgtgtaatcagaaccccttaataggaagtggtttcattccattgctctgtattctggagagaaagtctgatgttggatttatcattaacgtttgccatcagcttgtcaccaccaaagccctctgaattattttctgtgctctctataaggctggttctgctctgccatcctctttttgccagggagagaattttctttttttttgagacggagcctcgctctgtcactcaggctggagtgcagtggcgccatcttggctcatggcaacctccacctcctgggttcaagcaattctccagcctcagcctcctgagtagctgggattataggcacacaccagcgcgtccggctaaattttgtatttttagtagagacggggtttcaccatgttggccgggctggtctcgaactcctgacctcgggtgatccacccgcctcagcctcccaaagtgctgggattgcagacatgagccaccgcgcccggccgagaaattttaaaatgagtcaccaggaataaaatatattaaccaagcgaggtccaccgtttattcagattttcctagtttttgctcaatgcctcctttctgttccaggatcccatccaggataccacattacatttagtcactgtatttccttaggtttttccagtctctggcagtttctccaactttgctcgttcttgatgatcttgacagtttgaaggggcactggttaggtattttgtaatatgttcttcagttggatgtttctgatgtttttctcatggttagactgatgatgagtttgaggaggaagacagcagaagtgaagtcccactctcataccatgtgaagggcccatgccatcagcatggcgtgtcactgttgatgctgaacttgatcaccgctgaggtagtacttatcagctatctccactgtaaagttactccgtttctctttgtttttgtactacttctacctattttaactctagctgtcctgcaagtgctgtctcagggttcactccttctgggtatcttctcttaaatctgaccaacttagtggaatgtttcaccacagacataatttcaaatagcccagttattgagaattgcattaggaaggaaggcgggatgtgctcaccacctcttagctgagtgactccctctgtgattccatcacatctcacaactgtagtcttttacacatgaataaatccccaaaactcttcccagcatttctttctggtcaacagtggagaaaggccttgtgacattgagaagagaagttggccatgtagtcatgagttagcaaattccagtggctgtttctttttttgagacagagtctcactctgtcggcctgactggattacagtggcacgatctcagcttactgtatcctccacctcctgggctcaagcagttctcctgcctcagcctcccaagtagctgggattacaggcatgtgccaccatgcctggctaatttttgtatttttagtagaggcggggtttcaccatgttggtcaggctggtctcaaactcctgacctcaggtaacccgcccactttggcctcccaaagtgctgtgggtccgtgagccaccgcactggaccaacagtggctatttctaagagacctatctctctaaaaaaaaaatctctagaaaaacttgtatttaaaaattatgaaggcaactcgagggagaatataggatgccaacggtgtctcctgaccttagcctttgcgattaggtgctgattgtgtgaaatccggcttgatcatttgctttaaccatactgggcaacattgtccttgcctggaggatgtttatatttattttaccatggcatcaaactttttaggatattaataaagtttggatgtaagatctaatgaaattaagtgttctttatcttaggaaaacatcattttgttttgcatttgcaggcggagttagcatttagatattcaggtttgggactatgaaggtctattctcattctggctaatatataattccttaacttaatggttctgttgttgaaagtgcttgctctagcgctgtattcctacacagtagcctagactattggtcgagggggaggatttatcccttaggaaacacttaacaatttctggagacatttgtggttgtcacaactgggtgggggccacatttgccatcttgtgagtgaaggccagggatgctggtaaacatcctgaaattcacaacctctcacagcaaagagttatctgacccacaatgccaacagtgctagatatgggaaggttaattggttggccacattacctttgcttcttgtctggggcagctttccctagaccctgaggcatgttgtatatatacttaattttgttagatcatcccagagaacatctgcggccctaggtcagcttcacaatgagtctaacttctagatcagtggtttccattgagcctgtgtgaacacgaagatcttttttaatgaccagaatttttagtcttataatttttgagctcttattatttaagaaccgagaaaatcctcggttctcggccttttggctaagatcaagtgaagaactgagaaaatgtgtgatgatgctaacatacatgctatctcgcatgcagtggctgtggatttagtaacatatctcgagtaattttcattttgttgaacataacatttggaaaacagtagtacatatatatgtatatatgtgtgtgagagacccattatttcattattcattctacagatagtacttgggtacacatggatttgatggcccctagcaggaaatatttgtcctcatagagaaaacagcccacagcttagggaccattgctgatgaggatccctttgaaacagagatgacttggagaacactcacatctgtagctgaaacaaacagtctaggaaatagggaagggcatctcagcctcacatacagtgcccacttattaaatttctgcaaatgatgggaggtgctctgttgtggttttcatgcctgttgttaaaggaatctgacagccgaggcatcaggctgctttcttcagccctggtgagagtaggagctctggagtgaagccagtgaatagaactttgccaagattctgaatcttctgggaccatctgtgtctactttttcaaaaagcagattgtgtgaaatgacaggtgggtaggacacagaaggtaatagagatgtgaatgagaagactctaggaagggagagagcaagtacgggtgccagcgggaagagcccagcagaagattgagtgtcctggcagcaggactgagaggatgaggtcacaaatggcttttttctctgggaaggaagccagtggtgtgtgagttgtggcttgggttccagatcttagatcagttttccttacacacaatattaacgttcatattccttccaggaaactatcaagagtaaatggatcaacaggcagccaattggaagagcctcagacatagcaagagggtggcatggagggagaggacatataaccctctctttggcagctgtgcctaccacactctggccttgaagattctgctttggctcccagactagagacccttttgcatctttgccatcagtctttttggaatacagcatcaggcctaaggtcccagatgaaccttaggacagctttcattttgaaaattttggttctcagttcacattttctagctttccattgagtggtgtatcagttagctgttgctgtgtaacaaaacccctctcaaatttagtgacttcaaagaataactttttgtgatttgtgccaagcctctgggttggctaggtgtttctgctagtctgcactcactcatgcatccatcaccgcagtggcagggtgacgggcggagagctggtcaaggatggcctccaatagatccctcatgttcttccttccacttctttacatccttccataaggttcacatgggcatgttttcctggcagtgggtccaggagagaaagaaaaaacatacaagtgcttctacaagctgctgcttatgtccagtttgctgctgaaccattaggaggcgagccccgggaccgtgccccgagtcagcgtgggagggcactgtcacaatgtggagccactgatcccatcactctgccattgctggtgaaatacaaggaagccagctgacagcttccgacgagttgccagatgacgtttcttctgctattctttcatgtttagtagtgtcgctttgtagcaacacgttatgtcttaatctgttttgtggttgagatgcacctgagcaggcatctggactaggtgttttaagtagctaatttttctatctcttggtcattttgtcgtctcacctattgtgatggtgatagagccccaggaatacaaacaccatattccaatacagcatgttcagaagaactgaataaaaggcatacagatttaggaagaaggagaaaaaaattctccatggagaagaacctcctgcttattttaggttttattttattttatttttttgagacagagtcttgctctgtcaccaggctggagtgcagtggcgtgatgttggctcactgcaacctccacttcccaggttcaagcgattatcctgcctcagcctcctgagtagctgggactacaggtgcccaccaccacgcctagataatttttgtatttttagtagagatggggtttcaccgtgttggtcagggtggtctcgatctcctgacctcgtgatccacccgcctcagcctcccagagtgctgggattacaggcgtgagccaccacacccagcagtaattttatttttaagatggaagggtgaatgaaggaatatttgttagcagtgactacacagagttccagtgggctttctctgtgttgaagtaggtaggaaggtgtagggaattggtaaactccgactattttttgttttgtcagtagagcgtgggaaaacggctgattttcaaattgttgtgatgaaacgaatgctggggtatttataggcatgtgtaaataagaagaatatatctttgtcaaaaaacagccaccatgttatttggagcttttttaggtagaataaagtagaactttctaaaagtccgaggaaagatagaggaagattttttaaaaacttgacaccattaatttctgctttgtccaattcatatttatagcatttgcatccatcatctctttaatagttcggttcggtctgagctagttatttctttcacatatttccttttttgttcagtgctaataattacacttttgttctcttactggcaaaacattgcattgtcctcgggaagcattcaaagagactgagcagcaaacgctaattaatcctcgcagtgtgtctccttcattcctttaactgaggcgctgaaatgtctagccacacatttaatgaaatataatttggtgacagagagggtacgaaaactttaattcaagatgccatagcagcttcaataagcctcatatggccatggttgtgaggcagttcaaggctttaaatatccttgagatgcaggtgtggtgactagattatctttctgtgttattctccctttctgacagcagtcatcctgacttgctgtggagaatgagtttatcttgagtggaagttatcctggagtctagggaggcaacctagtttatagcaagtaatcttgggagttacaggcttgtgttttgtttccgtttttgtcagttgtctacacgttgacaagtgacttcatccctgggaatcattattgcttatcaccaattaaacacaatggatattaggtagttcagtgatgagcttaaaagagtttgacaagtttcttggaaagaacgttaggtaactatggatggctccctgtgcaatgtcttaagtctttaaagaatattttaatttattaccttatgtccttaaataggtcccttgaaccaaatttagtatcccagaatatgcattgtcctaagaacttttgcaggatgacatggaaacagatactataattgggaagcctcctaaatatgtgcaggtaggtagtggttataaattatctgtagcgtctcattcattagagactatcttatgagttagtgtgcatgattgatttgtagaaactacagataataagaatgctgtctttgctttaaccggattcatacagtcttctatccagggctggaagttacaagttgccctgctctggaggtccgagtgctgagcagtgagtgactgtagacgtgtggcaggcattcctccctccttgaatcccatgtttaaggtctgtgtttacctctagcccgcgagttccaaaagctatgtctgtctcacttggctttgtttttctagcccttactacagtgactagtaatgaagtaagtgcccaaacacagatgtatgaaataaagagagaaatgaaagggcaaataaggaaactggacgttgcttctctctgttgtacttaaggcctgttgcttcacggcccttccctacaggaggctgtaacactcataacgccgattatgactattgtgagaacaaattggcttccagatctgaacagaatcgcacataagaatcacctaggaagcctgttctggagtctgcccagagctactgaccgagatctccaaagactgagcccggagagctttttattttcaaaaggctcccaagatgattcagatgtaagtgctctgaggattcatgctgggaacagatccagatctgctgtaagccctggctgtgccctggacccacagctcctttccttgcccaggctccccgtgagatgaaggctcgtggaacacatctcatcttcttcatggcaggtaattggaatcaaggagctatagttcccttacctatagtaacatgctgaaaattaaaaccatagttgttcttacatttctttgtatcattaggtgccccactgccaggcctattagcagagacctaatacataattggtgttctggaagaaatggaaggatggatacatgaattctgtgacttaaaaatgaaatccacatggacatacctagatcaggaagaatgttgaatttgtctttacacaaattagcatgaggaaatacttctaccccaaattaataataggtcctgaaatccatttttagactttaatccacttatagatggtgttaagaatgatccttgaaaagggatgtactttagtatttgtctgttgtagaattgttctttaactatcaagtcagtacttcagggttaaacattacaagttcaagatactatctaagattagttaccatctgcagcttaaataatgtgtcccttcccaaactccgtcaaatgaaataaccattaattaaaccccggttcttttccaattggaggaaggctgcaggccaaattatttttgtgatgtatgggacatctgtaatgagtgccgctcaagtgtacctgaagcccttcatcctcagtgcataggactggagcagttgaacagcctctgtcttataaacagattatagtattgttaggattagccagcttttctttggcaatttttttcatctcaagtagtccatattttccaagttcagcacgtagcaagcagtcagtcctgttcttggctgaagtaagcagtctgccttgagtgccctgtgtctttcattctcccgacgtgcacatcccctatgtgttcctcattctccccatgggtcagttaagacctctgtaattacagaacgctccctcaagctagtggagaatgtataatttggaatgtagaggtatctccagaatcatagggcaggagtccagctccattaattgcttttactacatagcagcttgtttcttctcaacttaaaaaaaaaaattaattgtggtagaatgttcataacataaaatttatcatcctaaccattttatatataattcaatagtgttaagtatgttcccattgttgtgcaacccatctttagaacttttttaccttgcgaaactgaaaatctgtacttgctaagcagtgactctctgattccccttcccccacagccccaggcagccatcattctactttgtctctatgagtttgactactctaggtacctcatataagtgaaggcagagagtattttgactttgtgtgacagacttatttcacttggtataatgtctccaaggttcacacatgtggtagcgtgtgtcagaacttcccatttaagactgaagaatatttcactggatgcatagggcacggtgtgtttacctgtttatccctccacagacactaaggttgttcccacctttttgctattgtgaatgatgccgttatgaacgtgggtgtacaagtatctcttcaagaccctgtcttcaattcgtttagatagatactgagaagtattgttagatcatatgataattctatttttaattttttaaggaacctccatactgttttccgtagtggctgcaccattttacattttactttcccactgacagtgcacaagatctccagtttccccatatccatgtcaacgtttgttattttgttatttatttatttattttctaaataatggccatcctaatgtgtgaagatgaacctactctctcattgcggttttaattccattttcctgatcattggtgcaacttagcatcttctcatatgctttttgctcttttgtaaaccttctttggagaaatgtccattcaagtcctttgcctgttttttaatcaggttatttgtttttctcttgttgaattgtaagagttctttatatattctgaatattaaccccttataaaatatataatttgccagtgtctttttcttattccgtaggttgcattttgaccctgttagttttgtcctttgatggcacagaatttttaaattttcatgtggtacattttatctacttttattctcacacttaatatataatctagttacttcttttattttctgttcttttaaaaactttataatgagacattaaggttttgttttgttttgtgagacagagtcttgctctgtcgcccaggctggagtgcagtggcacgtctcggctcactgcgagctctgcctcccgggttcacgcccttctcctgcctcagcctcccaagtagctgccatgcccagctaatttgttctatttttagtagagatgggtttcaccgtgttagccaggatggtcttgatctcctgccctcgtgatccacccacctcggcctcccaaagtgctgggattacaggcgtgagccaccatgcccggccacattaggggttctttttagctgctatccccagtttaattcctctcttccccactactgtgggagtttttctaagctttactgaggtatagtcatatatatgattatatatataaggtatacagcgtgatgctttgatatacatatgtattgggatattattatcaaaattaagtaggcacattcatcacctcacatagttaccattcttgtgtgtgtctgatgagaaccactaagatctacttttctaacaaacttcaaatgtacaatacagtattattaactgcagtcaccacgctgtagcttagatcctcagaacttttgcatcttataactgaaagtttgtaccctttgacgaacatctgtgcctcagccttggcaaccagcattctactctctgtttctaagagttgtacttttttagatttcacatataagtgagatcatacagtatttgtctctgtctgattccactcaggagaatgccctcaggatacatccatgttatcacaaatggagggatgtctttctttccttatggcggaatagtattctaggtgtgctctgcagcctggtggagtggcaggctgtgccctgcagtcgggtgggggaaccctgacaggaccccctgctgggcagggccataggctgggctccgcagttggaccggactgctgtctgggctctctggtcaggtggtcaatggggttgctggttgatctccctgtttgggggtggctgcaggctgtgctctgccgctaggcagtgctgtggtctgaactctgtgccctgggtggtgcaggggggcgtccactgtgttccatagctggtcagggtctctggctgatttcaggctatgctgctctgctaggtggggcttggctttctgcctgaggagagctgtaggctgagccccagggctgagccagactgctggctggggactgatggtgggcagagctggtgactgccctccctggccagatggtgacactggttcagctctgtgggtgcagtgccactggctgcgccttctggtcaggcaactccactggcagggatttggtgccaccactgagatacacgagctagttgctttgagccccatccttctttgttcctagccaaccccaggtggtcttattttcccagtgttcctgtgagacaagacagaaggaggcatcctgggaagtaccctgcaatgctagggaagctggatgtccaccttaggctctctttttccctactggaaaaacatagcttaggggaagtctctttgtctagtgctctaccagactggggaggggcagcatgaccaaaccaaatccctccactcttcttacccttctaatgaaacttttcttggtttctgtggtccaaggggttggttctgcctcatccccttattctgggatttccacaaaggtgttttgtctatagatagttttgctagttggttgttttgtgaggggacgaaagctggggacctcctcttctgccgtctttcttttgttgcctgtccttttcttgttacatccaagaaatcactgctaaatccaacatcgtgaatcttctctcttatgttttattgtaagtgctttcaattttaggtcttaggtttaaatctttgttctgttttgagttaatttttgtatgtggcgtaagataagggtccaccttcattcttttgcatgtggatgtgcagttttcccaatgccatttactagagactgtcctttatccattgaatggtcttggcacctttgtcaaaaatcatttggccctatttgccagggtttatttctgggctttctaatctattacattggtttgtatgcctctctctgtgccactactatgctgttttgattactgtagctctataattcattttgatatcaggaagtgtgggacttcctatcttgttattcttttgcaagattgttttggctttttgaggtaactttaaattccatatggcttttttatttctgcaaaagaaaatgccattaggaattttagcaggattgtattaaatctgtaaatcattttgggaagtattgacatcgtaataataagtcatctgatttgtgaaatgggatgtctttccatttgtgtcttcttttatttctttcagaaatcttttgtagttttcatagtatgagtcgtttgcctcctttcttaagtttatttttaagtattttactctttttaatactattgtaatgaaattgttttcttaatttccttttatttgttgttaatgtgtagaaacacaactgttgttcattgtgttgattttgtttcctatcattttgctaaatgtgtttattctaacaggttttttgtggaatctttagtgtgttctatgtataagatcaattatttttgtttttttgtttttttaaaatatttccttatttttttcttatataagatcgtttatctaagaatagaggtaattttacttcttcctttctgatttgcatgcctgcatagctaatccttggttgactgtttttatttctgaactttaaatagatcatcccattgccttctggattccatagtttctgatgagaagtcattcattcatcttatttgctgttcttttcttgacaagtaattgttttcttactgctttcaagattttgttctttgccatttaacagctttacttttatgtagctgggtgttgatatctttgcatttatccttcttagagtttttgagctgcttacatatacagaccattgttttatattaaatttggtaagtttacttcattatttcttcaaatacttttccagtattctttctgttactttcccttccatcttctatttctattagttgtgtgttggcacacctgttggcatctcatatttttctgagactcttccttttatttctctttgttcttaggattgagtaattgctattagcctgtcttcaagttcagtgattctttttctgcagattaaaatatactgttgagtccctccagtgaatttatttgttattttaccttttaaccaaaattaatacttttaaaataattttcatcttttaatattgtttgttgagacgtagttctcatactttaattctttagaaattatttatcttttaaaatataattaggatagctaatttcaaggtttttttctgtaaagtctagcataccttaggggcagtttctattgattgctttttttcccccgtgtatgctccataccttcctatttctttgcatatttcataaatgttttttaacaactgggcatttgaatgatataatatggcaattttggaaatcagatttcctaccctatgcagaatttactttttatattgcttctgtctgttaagtgaccttcttaagataattctgtaagatatatattctatgtatgtttagcctctgaagtctcttgtcagttagctaagtggtcatctaataactggatacaggtttctttaaattatttgagggataaatctccaagcctttgggaagggacttgtgtgtgtgtgttgaggcttgcctgctatgtgctggcaggcagtttacaaccctccacttgcttgcttagagccagaggtcagtcagaggtgacgtacactgtacgtcaaattgtatgtcagtctgtcatgccagaggtgagatattagagccttttccagtgctttttctggacatgtgcttagccctgtacatgtgtgtgaccttctgaatttccaggaataagtcagagcagttcagaatcccctatggccatgtcattctccagtttttccatttaaggtttttggtctgttgcttgttagccccagttcatattgctgcctcagggaactgtgatattgagcatgtgtcacagattgtttgccctagggatagggctttttgcacagatacaggtcagatttaggtcagatacaggcaagcctaagaatggagcttttgaaggcagcttcttgacagataaaatagtaagaattatctgtactatcccccttagtggcttcaaggctattgtttttcacagctcctgtagttgcaagactgttggttttcaagggtcctgtggaactagtggaaggggtatgggaatagggcaagttaaaacactttatagtttgcttattcttaacaagattcgtctgtttttcttgaataaacagtacttagattgttgcaagcctttgattaatttttagagttccaaaaatgttgatttcacaatttttgtccatgttctcattgattttatgaaggagatgattttcagagacttttattctgccattcctgaggtccttcttttctcagatgacattttgtggttcatagcaaccatagaaacattctgtagttcatcaggtgtggacacagggaagggtcactttgtatagaaaggctatcagggacctatccttgtgattaatctacctgttgcctccctctggagcctcatggaatgtggtgtctgtggattatagaaaacttggcttccttggccacatctccttgaaaattccatcctgccacctcctgtataccaagtggatgtgctgagcactctctgaagtgctaagaaatatgtcagagagcttgctgggacagtctttccctctaaccatgggactggccagtgtgttttgagtttttccagccaatttttggagtaaccaaaactttaggaaggccctgtcagcccacctccctcactggcacactaagcaggaatccccagccccctgttctcccagctcccaggggatgctcttcatctttgctctgtgatcctgcagtggtctccttgtgtgggaatcgtgcaccccactggccatgccatatctgtgtgaagcttattttagctgtcctaatcagagcatgattaaaacaattgatttttaaaactgttgtgtatgtattttatctgtgttattcttgaatattggattcatattaaatagtagtttgccctaattaactttaatactacagatttgtgctttttgaactcagcatgcagatttatgtaaattgcataaagcctttaagctaggagtgtatcatttacatttacaatcccatttatcccatgtctccatatcactgactcttcaaagaaagacaggaactattgggatggacgtacttgattgtttcagtttcactcctgtgcaaaccaaagaacaagtagtaaatgacttttccacataaacacacacattcacacacacacacatagatgcttgtgtgtatatacgtgtgtgtggacctatctttggatgctcatatatgtgcacttagagaatcaaaagcaatatccaggtatcttgaccataagcccaataccctgtctatttttttgagtggcaatttgtgttcccatattgtagtgtgcatatatatatatatatatatatatatgctgtatttttaaactgattttagaattagcgcttaaaatagaaaagacagagcacaaatttggggggggagcagtttaaattttgttttcatacatctggttgtattaaattctctgttcctctttttttttttacccccatttctttgcccttctttcttccctttcctccccaatgttttccgtatctctggcaaagttcatgacataaagggctgtaagagatcagattatgttaccccaaaacacaccactctggcatacagattacattgagctgaaaacagttaagaaaaagacacaagatgagctctctgccttttcccgtctgcctgaaacataaaattttccttgtgaacgtgttcctcccagctctacttccggtaaggagaatttcccagaaaaggagtaacagcctcattactggagatgagaggacaccagaaagggcttacacaaaccagccctaggagccagccatcatctcccatcagtttctcccgacatttgcatatttgccttcatacagtctgccacccctagaagttcaaagtccatttcctttgccatgtcacttctctttagcatttttgtcttttttccaaatagtataaaagcttccaagcacagccattcttatgaagtcctcctcccacccctttctgtgtaaaacttttaacaccaaataaaattatatactttttattccctgtttgtctgcctgttgtcagtttatttcacagacccagtcacagaaccaaagagggtggaggaaagtttttcctttcctacaaggtcagtgtccttttggatagaggtcgaatggatcggttattggaaaagaaacccacagagaaatatgttagaaaggaatttttgcaagcaaagaaccaaacaaacaaatagcaaattgtacgtcatcagtggagactggttttctaccagatgaatgaccctcattaacatgaggaagcatgtatggatattcagtacacatggtcctacttattgataggcatgaatttgattgtacggaactttcctggagcaatgtacgtgttgtgtgtcaggaaaggctctgttcaggaatgcgataggccttgggtgccttgaatgggagagtaatacgtaagcagaccaactgatgggaaaagtctcaatatagaggtaagagagggtggggagactcatgtgaggggtagtttaaaagaggcagtctgttaagcttatgcctggacgtaaatagcagatgaatttggagttagaagaagtttcttggctttcttggtgaggtttgagactcgggttctgtggcggtacagtcttgctaagtcacagatttttgaacccaaaacattcagcccattctccttgtcacaactctcttacctcttttctcatgtaggcttctgtatacagagctagaactggcaagttagagtggaccttttactttaattgtggaaggagggcaagcagcccctgagaaaataagagtctctaacaaaatgcacttataccctccagacctgtctactttaccagaatgggtgtgccgggatacagaataccctagtaccacaaaataacttcaactgcaaacaattaaactagtaagtatttaaggaacatttgctatgtgccagaaactgcttagtgctggatatgtattagtcgttgtaagtagatgtcggaggaggaggaagagggtatatatcaccactgtgtgtacgaaaaaaatgatataaagagttgaaccgagtggcatgatgagaaaaacttctgcttggatatcattgtatgaaagggcgatgcctggaccttactggccacaagttagcagctatctgcccccatgaatggatcataaaagatgtcttccaatgtgctgacatcatgtagccacaggaccaatgctggaagaatttcctgtggcgttattatcctgtgtaattaataagacactattaatcaacagcttgactcacagattctgtgacttgcatccaaagcccactactggatgtctcaagtctttgccatctctcactttatttcaatagcctcctagtttgttcctgcctcaggatccttccgcttgctgttcatctgccttgaatgctattcctaagatttttccatggcctggtgccccactttatttagttggtttctcaaatgccatctcccaagaaaggtcctcttcatccaaaatagcccccctccccccatctctccaattactgccgaaccccttacgatactttgactttctgcatagcacgtatcactacctttctttccatatatacatttagcttctttgtctgttcattgtttgtaatgtctattctattataatataagcatcattttgggcacagacttcatctgccaaacatatactaggtatccagtaaatccgatcaatgaattcatacagtataacctagcaaggaatatcatcaatgaaaaaaagaaaagacacaaaagacctaaaagaaataagaagacaggccaggcatggtggctcacgcctgtaatcccagcactttgggaggccgagatgggcagatcacaaagtcaggagatcgagaccatcctggctaacacgatgaaaccccgtctctactacaaatacaaaaaaattagccaggcgtggtggcgggtgcctgtagtctcagctactcgggaggctgaggcaggagaatggcgtgaacccgggaggtggaggttgcagtgagcggagatcacaccaatgcactccagcctgggcgacagagtgagactccatctcaaaaaaacaaacaaacaaaaaaaaacaaaaagaaaaagaaaaacaatttaaaaatagaaaacaaacaaaaatgtatagtatatccaaaataaagaactgctttttttgtggttatgcttttctttttccctcacgaaggccaaatctcctgtgtgcttcaatagaaatcagtgatgagaaaaaagtagcaggtatcagattaaaccggcctccatgtgatgatcatctgttagctttagtattgtctcaaatgaaaaactcacaaaacactccaagttccctgccattgctgaatttaatctttggaatgttttgaaccccgtgcatgaattatatcaattttacttagggaaggtcctgtggtatctcaaagtcacttagctcagtttctctaggttttgtgggaatattaccctttaggtatgtaaataatatttatttcaaatcaaaatcataagtgaaatcctaaagcattgctattaaatgtctaggctaaaatgaagatacctgcttttgccactactattttgaaatgtagactcacaagaagttgtaaaaataatgcacagaatcctataaaaccttcaccccacttctgccagtggtgaaatgttgcataactggagtgtggcataaagactgagaaactgacatttatataatactgttaactagaatagaaacgttactcagttttcactggtttcagtatgccctcatttgcatgtgtgtgtgtgtgtgtaaataattctaaattctatacaatttgatcctacgcatagattcatttaatcgcctccacaatcaagatgtgcaactgatccgccatgacagaggaactccctcgagcgacccctataaaactcccctgttgcaccccctcccacctcattgcccctgccgtttaacattgttttcaaatgtctagccaatataattagccaagataagtagtagtaacactattggcaaagaaaagtgagaatgaaacatatcattatttgcaaatgatatgtttatctcttgagaaaaatccaaaataatggattgaaactattaatttgagattttctgtataattatgattaagaacatacactctgaagcctgctatgtgggtttggatcccagctccaccacagactagctgtcagtcctctgggaaatcacttaacctctctgtagaggtttccctcatctgtaaagcagggctagtaagagtacctacctcactgagttgagaggattaaagaatataatacaggcatacctctaagatattgtgggtttgctccagactaccccaatttgcaaatattgcaataagtgagtcacatgaattttttggtttccagtgcatataaaagttatgtttatactatagtttattaagtgtgcaatagcattatgtctaaaaatttacataccttaattcaaaaatactttattttaaaatataatagcaatcacctgagccttcagcaagtctttttgatggtacagggtcttacctcattggtgatggctgctgactgatcagtctgatggttgctgaagggtggggtgactgtggcaacttcttaaaataagacaacagtgaagtttgccccatcaattgatgtcttcctttcacaaaagatttctctgtaatgtgcactgcttgctgctcttttacccatagtagaacgtcttccaaaattggagtcactcctctcaaatcctgctgctgctttatcaactaagagtatgtaatgttctaaatcctttgttgtcatgtgaacaaagttcagagtgcctccaccaggagtaggttccatcttaacacatcattttctttgcttatccataagaaatacctcatcattggttacagtttattatgagattgtagcaattcagtcatgtcttcagactccactgctaattctagttctcttgccgtttctaccacatctgcacttacttcttccactgcaatgctgaacccctcaaactcacccatgaggggtggagtcagcttctcccaaactcctgttaatgttgatattttgacctcctctcatgaatcccgaatgttcttgatggcatctagaatgatgaatgcttttcagaaggtttttgattgacttttccaagaccatcagaggagtcatcatccgtggcagctatagacttacaaaatgcatttcttaaatagtaagacgtgaaagtcaaatttactccttgattcataggctgcagaatggatgctgtggcatgaaaccaacattcatctccatgagaactcttgggtaaccaggtgcatgatgtaatatataaattaggaaactaggagagaaaaatccaggcatgataatagaaaattttgcaaacagtgtgacacagaactacctaggtaaatagatggaaaaagtcattctcactggtaattagaaatgtattttataccataaccaacatttagtttctactacccaataggcaagtctttagaaaataatgacataacaaccactgtctgtgtgtacttgtaagggtggagtaacatgtttgtgctattttcttgcaatatttattgaaggcattcaaagtgtatgtaacattctgacagttaaattttaaagaattctgagaattgattagatgcactgtggcttttgtttactaagattttatttatagtcattcttttatttagcaaatgctgtcgtgggccttgtctatgcaggacagcatgctaagcactaggaatagagtagtgatgaaaacaggaagacaagcattaaataaatcatggggcaaagggaaataatcactagtgttgaaagaggaagtattgtactaggtagctgagggcctgtaactagaggatttaacttagcctggggtgtgtgtgtgtgtgtgtgtatggtgaggggttttcactgaagagttgatgaatgttgaaacgcagaggagtggtaagaggcagggaggagggaagggaggattaaggtgtgaggtaaccagcagcagaccctgtacagggaggctggaggctggagcagagagaggacatgacggggtgaaaggtaactctggagatataggaaggggtcacagcaccttttaggaaaatctaagattttagccaggaaactgatacgaaaaataatgttttcaagggagatttagtaatacaattataatgatagaatattagtatatatttgattatactgtatatcacagttactatatgtgttatagtatgtatcatgatcattatatactatataaccattaaatgatattttaatgataaatgatgacataatagttaatgctataatattaaacgttgaaagcagggtacaaaacagcatgtttggtttaatcctaattttgaaaaggaaaaatgatgtatctaacatacactgaactctaaattgtttttacggtgatttttctgtgtagcaggatagaggctgcttttttatagttcctttatttcccggattctctaaaaatgaataggtgttactgtttacttagaaaaattgtactatttgagaaaaacagatttagtttatcttggaacatttcattgaatagcctgtatatattataacgggcttatggaataatactgaaaaatatccattaaatggcgagtagtcaggtccagtgttggcttttgtccctgtgaggtctccttcactgtgtatgtttccattaaggacccttaaggttcagagtttttgttgaaatacactattcagtcacatggatctgggaggaaaactgaaaccagctggccttgggcagttgctttagaaattctaatacatgttcagtttcctcatgcttcatgtattgaactgtaaaaattctcttttggttaccatcacacaatcacagggcaaattaaatctcatccctgtttcatttgactgggaacaaaaaacaaatcttaaaatttaagagtacttggtacaaccctataattactatacataaatccaaggtttcaggtaccgaatgcttttgttttgagattacagcatcaccgttgttcaggtaaatatgattcatcctgtccagacaattttttgttgttgttctacaggaattcattgacaataataacattctagtttgtggtaggtttcagtatactaggaaaaaaaatcaaccaaccaaccaacccaactcacacttagatggagacatgccagtaatgcgaatattttcaacagagcatattctcactattctttgccttcagaatttaatcagatgatataatagataagtacatgaaagaaggttaaggagaacatcacctcttttttttttcttttgagagggagtctcgctctgtcacctaggctggagtgcagtggcataatctctgctcactgcaacctccgcctcctggtttcaagcaattctcctgcctcagccttctgagtagctgggactacaggtgtgtgccaccacgcccagctaatttttttcttttttgaaatggagtctcgccctgtcacccaggctggagtgcaatggcacgatctcagctcactgcaacctctgcctcccaggttcaagcaattcccctgcctcagcctcctgagtagctgggattacaggcgtgtaccaccacgcctggctaattttttgtatctttagtagagacagggtttcaccatgttatccaggctggtctcgaactcctgacctcgtgatccgcccgccttggcctcccaaagtgctgggattagaggtgtgagccaccgcgcccagccgaacatcacctcttaatctgatgtaagaaaagtaatcaaagttctgatacaaggatagaagtgactgctgcccttcagcctcttgcccctgtgccagctagctcatagttaaaccttggtgcagagagagagagaaagcacctcgtgggctggcattctagtgttctggtctcctgtattctaatggtagtcatggaccctacaaatcccaaggcagaagctgtcttggtgtaaaatagcagcaataaaaattaatttagactgagtcagtactgtaaagaagaaacaaaaatgaaaacaaaatctcacctttcccagctgtgtgaatcaatataaattggttcaacatgagctcttgttagaatctgggtgtttttcacactttgtaatacaaagctcacataggctttacagatgatggttaaaacgtgtgtgttagggtccaataagtgacttctttgcctagcagaaaattcacctcatttattgaacaaaattggcaaaaaatgtttcactctgaatgtttggttattttgactggttcaattaaaaatcacttcttcgtatttgtttatcattgcaaaagaggactggagagttagaacttacatctctaaaagaaggtgtttgatttaatcagaaaagtgactatttggagaacaaggactgggaaagaggtgttaattgcattggagaagagtggcaaggaaactaaaccatttaatttcgaagtctactatcctgtgctcaatccacaagcaggtaaagaatgtaaatttataatttatatgcactgccttctataagtaatgttagagaatcaactcttcagtgatacttgttaaagaccagtaaggaagactttatttaggaccattgcaataggtataggaacagcgggattttgcagtgggcgagagagattgagagggattgcagagagagattgagttcaactccaaaaacagcataggccagtgggaattcatagccaaggagtagtgtgggggtcagcggatggaaaatgagcaagaggaagcatcagcgctctgactgaactgatttaactgagttctttgctcaaattggattttccaaagaaatatgcagataagtctaggagaaggttcagaagccccactgaagtttggccatgcaaagaatctttgtcagtaaatactagtgaaataaatgaaatctgatagagacaaataggatacgacaatctctaatcctgccatgtctttacacctttctcttttgcactgatcctgcttcagttgtgaaactgtgcctggatgtagcgctaacagcacagaagaggtatatgtcaagcctgtcctctttatgcgactgttttacctccctgcgggtgcagaatctttaccttttgagaactgtctttttccttcccaagagtgggcctgccccccaccatcagcaataccttcgagctccaccctgcagccactgtcacaaaggaaggctggggaccttcttgctgttgttggtcccactcttcctccagtcgctgtgtggctaccagcctgagggctcttgctcctggcattacaggacattcaagcccttactaaaataaaactgacattttagcctgtgttttttatgagtatttcagtcttctgaaggtctgatgatccttctcaaggtatcaaataagagagctaataaactaggatgatgcccctctttacttcctgtcctgtaaaccttgaagtcagcacctcccttcatgaatccttgctgctgcgtcgccctctccaagatgctgcctatggcaaactaaatgtgagagatagaaccagaggacaagatagaagaacttcggcggggggtggggggaggagggaggagggaggaatggggagcagggacagcactctggagagtggtccagtgcctccaatgcttcaaagcctggccatcccgtcattgcccagtaaggatgctttttacaggcctggatcatggtcagggacaattctgatagccacaccgacttcctcttcaaaggtcctttttctcaaaagaaaccatttagcctttcagggactgcagtaccgagctctgtgatccagcacagctgacagatgcggaagggggttccagtcaaggaggcttccaaccagtgccctgaggtcaccttgcctggtgattgacacccttgggctccagatagccctccccttccatttcctctgaggaccgctcccttctgaaagccctgggaaactggttttctacttcctttctttttctcattccgtgatgaaatttgtgtggttatatctaatattttgaaacattacaaacaatggggaagagacgaaagatagtgtttcatgggaggtgtatttgagataggcagaagaggaaacaagctttcagccaatgggaaaagtactcctttggccttctatgattgacatttcagaacaagcttttgggagaaagttaaccaataaacactttctaagttactgcctgtattattgaacgtatattgcacttttcgttttcatcttgcacaacctgataggtgagcctgaaattggctctgttaactgttctccattagcttttattcactcttattagggactgcagtctatgtaatgaatttattggatcaattatttgtatcttaatgcatgtttaggacttcaaagacccctttcttttgatttttttcctcatttaaatagttttctgaacatcacagttttggtgccttcactttgatacataattactattctgcaagtgagcttaatacttttaatgccatctgacctcaagattttaatagaattaaatgcaaacaagatgaggaaagaagagtcatggggaaacttgacttgttactgagctttgggaaaaactttaaactcttggtcaaagtgattttctgttaagaaatcaaaaacgtgccagcagatgcctttaaagacaacatttatagaaattatttttttttgagagtttgattttagtattctagcatggatttacgtcatctgatactggatagtataatcttttttcctcatcctctaaccctcaattcttaaaactccgtgaatccatttctttctttgcatttttattattgtgcatcatgagactcatcttcaaaggcaagagccttattattgggaaacaattgtgtagtaaatgcttatttgttatttctctctatagttttttctctatatagtatagtagtatctctattatcttaacacagtcttggaaatacccacagtatttgtaataaatgtataataagtatgtcaaatttattttctatctaaattttgttgttatctcagtcttaaattccatccctcccaaattgctatttctccaccctgaaagataaagggtagcccacgttgatactactcggtgtctgcccaatcacaggaaggcactgagatctttcaatgtactgccatcacatcactaagatgggtgaggtggggatcaaaaattgagagaactaggatggcggcaatattttcaggaatggtcattaataagctagttatgagattgtcatatttaaatttcatgactgtttttcaacctgaatgtatggaaataaaaattataaaccctcttcattttatgaaccttatttttgaatttccctggaatctattgctattaaagccattaattccttactgtaaaacgtcactatcaagaaaaagctaaaaacatcaccatcagtattagagatgcaagcatgcaggtttcctaaactgaagagacattgccccttaatgagcctttacaaaacaagagaagatcatttttgagcttaatattagaaccaaaaagagaaatgcaaggcagtagcccattgcaagaaagaaaacaggaatgcactcagccaggttgcagtcacccccagacaggaaggttcttgccgtttattgcagttgcctctgattcctccctcgaagtctgggagccttaagggtgaacagcctacaaccaagccacgttctcccgacaattctgtaaacctgtttatcacaggcaaattttcaggtgtctgactatagtgggattttttattatcaatgaaatgcatgaagtgacaggccttggttggtgaagtggcttttgtagactgaatatggctgagtatgtacagccaataatacattttaaaaggcatgtttccacgtagctagaattgaatacttggtattactgtccttattttcttctttttactgtatttgataaaatacgtccatgagaattcagcattctctataaaataaaattttgaaggaaagtagaatgaaaaataattaatgatttgatgaggaaaatctaaaagaaatgtgttatttctaggcaggtcctcttggctttccattcaggacttctgcccaaaccatgaaagcaaatgactaggccatatggaaattggttgtaaaagatgttttagattagccagtcactccaggagcctttgatgttatgcaggctaatgaagttggctcttggagaggtttttattcagctgaactgaatttctgagagattcatattacattttcatacagttgtcttgcttcataccccagggatttattaagttataattgaatattgtgtttttaagaaagtttcttaatgtattacacccttcagcaaattttgcttggtattgttttgtcaagataatttaattttacattggctaatttagcccatattaatatttcccctgaaattcaggtaacttagcaaactgttacaggtggtgagaaagaaaactcttttattgaagcattaaaatgttacattattgtgaggtgaaatcttttatcagcctttggagatattctatcaaggtcagtaacattgtatctgtcaaagaaaagttttactccaaaagttgattctcctttcctcagtatcccctgttccctgcattctccagtgttcctccttcctcccatctcttcctgtcccagggaagttctccccggattgctgactggagaaacagcatgacgtggtttctaagtaaggggaaggggggtggggggcggagtactcccttgtcagtggtaacaataggctgtgaataattcagacatgatgaaagaaagtctcatttgacaagatagtacccgattcactaaacagctagtgtggaaataatgatggcgttagttaggggaatacaagaagttcaaaagttttggtggttttgaaagggaatcgcagcacaggggccttcaccagcttcccttctaatgttcgtttgttacgcctggagtttcttacattactgattacgtctcacttgggcgatgttttatctaatttctggaaaggctttgttttataaagtgggcttgcttctgtggaaataaacaaagaccaaatgagaacaaacagaggctatttattcagagcttgctataccaagggagccatcctttgctcttggcagagactcaaaggcagccagaggggtgggaaagcttccaagtgaaagaaggaggcttccagctcactctgattggaggctgttggcctggggaagccggaagtgggcttactagaaagggggcgtgttgtgtggttggtgtggggagcgtatttggcttcctctgattggccttgagttggaaagggttggggagcgaaaatagggacgactcagtcactggccaagtgctgactgttcggtgcccatgactgcagaggttgtgttttggcttcctgggtttctcacgcgggtgggagttgacatacacggtctggccattgtctgtctgcatagtccgcctcactggatactgagaaatttgcctggcagtgtatgaactggataaacttgagtgggaagtctaaaattatgaaggatatttggacagaatacttaatttttttaattcgtaccccacactattcactctttatgaggaacagagtctgataaccacctccacagccaaaatacagaacgtcatctcaaaaaagttctccgtgtcgttcatttgtaaccaactccttccccccaacccctcaccccaaacaaacgctgataggtttgtttgcccctgtaattttgttattttcagaatatcacataaatggctacatgcagtatggagctttttgaacctgagtcccttcacgtggtatagtgcatctgacacatgcatgttgttgcatgttttgaatctgactcctttcacatggcatagtgcgtgtgacacatgcatgttgttgcatgttttgaatctgactcacatggcatagcacgtgtgacacatgtatatcgttttaactctgactcctttcacatggcatagcacgtgtgacacatgcatatctttgatgttttgaccctgactcctttcacatggcatagcacatgtgacatatgtatatcgtggttttaaatctgactcctttcacatggcatagcacatgtgacacatgcatatcattgatgttttgaacctgactcctttcacatggcatagcacatgtgacacatgcatatcattgatgttttgaacctgactcctttcacatggcatagcacctgtgacacatgcatatctttgatgctttgaccctgagtcctttcacatggcatagcacgtgtgacacatgcatatctttgatgttttgaccctgactcctttcacatggcatagcacgtgtgacacatgcataccattgatgttttgaacctgactcctttcacatggcatagcacatgtgacacatgcatatcattgatgttttgaacctgactcctttcacatggcatagcacatgtgacacatgtatatcgttgttttaaatctgactcctttcacatggcattgtgcgtgtgagacatgtgtgtcattgcatgtgtgtcaatagcatcactagtttattccttttttttttttaaagaaaatgctcaactttatatttcatttcaacaatttgctcctaatgcccttttcctgccccaggatcctatctaagaccttgtgcgtgtagtcatgtcttcttggtctcctccaatctgtgaccatttttactctttctgtactgtctacaactttgacccttttgaagagtcctcgtcaggcatctttgggtcgtgtccctatatttgggtgtatctgttgtttcctcatgcttagactggggttatggattttggggaagaatcccacaggggtaaaggacccttttgatgatatcatatcgggggcaccggtcatcaccatgacttattcctggcgatgcgaaccttgaccctttggtgagggtggtgacagttagggttttccactataaagttaccatttttttttccgtatcctattcttgaaaggttttcttttctcaccagctgaatatgtggtgtttttccatactgattctccaactctctgacaccaactgggtgtcctgcaattcaactgaattacaaaaccaactcccagcgttagcacagaccccacacattgagggctcaaaactacccccacttcagatcccaggtgtcctcatatacatctgacagactttgaatcggggttcccaaaaccccctccttgggctcagtaactcactagaacagctcacagaactactcaggaagtcactttacttacttcctttttttgagacaaggtctctctctgtcactcaactcctggtctcaagcgatcctcccttgtcagcctcctgagtagctgggacctaaggtgctaccatgcctggttaattttatttaaaattatttttaatagagatggggtctcactgtgttgcctaggctggtctcaaactcctggcctcaagcagtcctcccactttggcctcccaaagtgctgggactacaggtgtgagtcaccaggcctgaccaggaagtcactttactttctatgaccaatttattataaaggatacaactcaggaatagcgaaattgaggagatgcatagggcaggtgtgggggagggtgcagtactcccaagctctctccaggcgcaaggtgccccgtcctcccagtacctctgtgtgtccaacaccccggaggctcttccaaccccattgctggagggttttcatggaaggttcattatagaagcatgactgattaaatcgttggtcctaggtgattgaactcaaccttcaggccccctcccctcccaggagactggggagtggggctgaaagttccaagtttctaatcaaggcttggtctttctggtgaccagcacccatcctgaagctatctaggggcctgccaagagttgccttgttagaacaaaagactcctataacccttatcactcatgaaattccatacgttttagtagctctgtgccaggaactgggcacaaagaccaaacgtatctttctcattataccacagttccttagaagcaagttgtcaagtccagcccacagtcaagcagagggcagttaagttccactctgcagggaagagtatcaaagaattcgtgggcatatgttaaaaccgccactgtacttaataaatattctgagggatatactttgaggcaatgcaaatatctgtttttcctaaactttcagccacccattttagcattcggcagtggctcttgcttacagcatttctatcgtaatgttctaacggtgatttttctcatttccctcattcttcctacatttgttttttggaatttttctgtaaaggaaatctgtcccatctcccatttatatattcaatcatttatttatatcattttggatatatgaatatttatgttattctctgggttataatcttctatttaggttggtgcaaaaataatggtagtttttgtcattaacactaatgcgaaactgtaattatttttgtaccaacctaatagatttaatttgtaggtcaaatggctcctactgtggccttgagagctttctccagttggccactgtgtttgtttgacgtgctcttatctttttcttttcttggcacttactctgcactgtgagatcctccagccttgttctgtgtgtcacctgcacccgcccagagtcagccatttctttaagaaccctggtgccttttatggggaaataggattagaaaccaagactgaagcatggagtgtgcttgtagcccctgtgctgtcacatcctctaggcctctcagtggacccagctaggaaacaggtatatgtattccaacccatgtatacacacaagtctctgttcctgtctgtatccatctgtatctatttaaaaataaccgtgagtttctacaagtatttctgagtctaatccagtaccatggggttcattctgttttcctcccttggttacttgtaatttatttctctgacagggagaaacctgactcgcattatccacagtttatttaggtgttcaatggtagcatttgtgtaaactacccttaggattgctgacgtgtatcctgcgagaaacaaatttaccaaccaaaatacaggctttacctatggctcatttttcctttatcctgcaataatcagtcaaatcactgtttcccaaggggtttggatcataattctgaaagaaatgctgtaaaatgctgtactttctgaagtctaaatcccaaaagatcaatctctaaatagaaagtgggaatgtttaatagggaatgctcatgttggtggctattgaatcatagaaacatttttaaaagagcagtgctatatagaaaataaatgtgtatgtattttctgaggagagccatgtcctataagaaaaaaagtagctgtgcatcctgatgcatgactttaaagtattagttaatgatggtgaaagccagcgactgtggactgtctccctgcagttacccataatctgtccttgaaatacgcttttatcatatgttgaattttctttttagttttctctgttttttctttttaaatttttttcattattattattattattattattattatttggaggcggaattttgctcttgtcgcccaggctggagtgcagccttagctcattgcaacctccacctcccgggttcaggcgattcttctgcctcagcctcctgagtagctgggactacaggggcatgccaccatgcctggctaattttttgtatttttagcagagacggggtttcaccatgttggccaggctggtctcgaactcctgacctcaggtgatccacccacctgggcctcccaaagtgctgggattacaggtgtgagccactgtgcccaggcttttccccattattttaagttgtccgcattcttttgttttacaatttgctgtgctatatatttccttttcccatcatttccaatactgggggtataaattttgtagagaccttgagagggctctgatttgttttatgtatttttttttcaaatttgactgcacaaaagagcattatcataacgttgactgtttacgcattgtgcatgtttgtaaaaacatggaaaattcctccataaataaagagatgtcttttttgcatatctgcatttgtgaaagataaaatttctcgaggtctcggccatttgggtggctgcatatacagtgatgatccagtgcagtttttgatcaatttcaacagaagactcaggttgtccgtcatggtatttcagatgaccacagttacaaagctgggtgcacacaattaccaaccacagcaatgtgcatgcatacattccccttgttgacctgttacctgtttctttctgaatacagtttgctcatagctcttattcttgtgtgactgtcattagtatacctgaatgtttatccttgcaaaaaatgtatgttattattgttcattttattgcacaaagtgacctatgaagtgttcggtcacgtttttatgtttgccaaataaatctctttttgtacatgtaaataaatgtcttttaaggaattaaaacattttcctcagaataatagttttggaataattttgatctttcaggattgtgatttgggggacttttagacttcagggattttgatcttttgggatttctgcatttggatgtggtgtttgggattgtgtcttttgggatgataaccggctcctggcaaccactgatctgtttctgacttttccgtttttgcctttctcagtaggcaatatcattaggatcatacggcacgtagccatctgggtgtttaacttagcagaaagcatttaagatctatttatgctgttgtgtgaatcaacagttcattccttttaacgctgagtagtgaagtatttcattgtctggaatgtatcacaatttgttgaactcttcatctgttgaagaatgttttggttgttgggatggttatgaattaagctgctatgagcatttgcctacatgtaattttttgggaacttacattttcaattcacttgagttagatacgtaggagtgggtcagataagtatgtgtgtaatttttatgtaaagatttgtaaatattttgtgaatctgtaacagaatgagtagcactttttccaggtgagcgtgtggattgccaagttgcatagagctttttaagttgactgatttttttctaatttcattgaaaaatccagtagttttttttttatcaagccccccctccttttttttttttttttttttgctcttgctgatgatctatttagttattaggtggcaactcatgtcaacaagtgaattcacatgccatttcatcttttcttgccttaacacggtgaaaccccatctctactaaaaatacaaaaacttagccaggcgtggtggtgggcacctgtagtcccagttactcggaaggctgaggcaggagaatggcctgaacccgggaggcggagcttgcagtgagccgagatcatgccactgcactccagcctgggcgacagagtgagactccatctcaaaaaaaaaaaaaataataataataggcctaatcattgtacaaggatgaaggtagggaaaaaaagaaataggaagaagcaaaggcagaaaacatctaggatgctggagcgcagagaacacaggaatgactcaggagttttgatacaagtttgattagagaaaatatgcaagtactgcagtgactaagtagcagattatagttatgaaatcatgcaggacaggaacgctgaggttaaatacaaactgacaacaaaaatcataagaataatatgtaaaagcaagtatgaagcctttgtatttgcttgcgacttgcagtttgaatagcaaaatgatctttcacatcaggctcagtgtgttaaatccagccttaggcaagaataagcaaatattgtttccatatgacaagcctttagctgctagtgaaatgctttctttgtagtgaactgtaggcacaaactatcagcagatgactgtgtatctgagcatatctttaaccacagttagctacaaattatttatagaggttaaataaatgtttacactgaatgattcaggaatgagcacataacagcggtttgggggattatatttctgctattgaaatctaaatactcctacaacaatcctttcagcttagatccgtggtttctagttgaggaagcagtacctcctatgggacattctgggtctcctatgggacgtactgggtgttctgtgggcatttttggtggtcctgatgatggcatttgtggagaggacagaaaacagactgcacctgctgcagcgcttggatagtcctgcaggatgaagggcggctctgcgccctcatagatctcctgcacgaccctctagatgtttacgtaggtaaaagcaaaaaacaacaacaaaaaactagtacttcatttttcttaaacatgcatggtatttttgtggtatttttaactttcaccgatacttgctgcaaatgcaattactgagtaaattgagggaaaattgtgctttggttggttgggtacttttagcgatagccattctccatttcagcaatgcccttgtggtgtttgagcggccagtgcaacacctgtgaatcagtcttcatttgtagctgtggcatgcaaatatttaacagaggggatgtaacattcactgtaatagacttaaaaccaaatatgttttaattagatgaagaccatgaagtgtgaagagaccactgacttttactaatagtttttaaaaaatcactgtcatttatgtagtttttgtttccgtagtatgacagtatgaatatgttataaaatcacacatttaaatgattgatttttgaggttgcctacaggtttttagtcttatgctgatgtgtgcacaagtctacaacataactgtgttctagcctcctggttctttccctcttaagcatcagagactggatcttttgcttggcacgtgataggaattcaagataggagagtaattttctgggatcctttttcagtaccctatcctgtgtcaacataggacattattttgacacttcacttaaaaataagcctccttattcctgagaaagccataaatttctttttctttaataatgagtaatttgtcttggataaactgtctttaataaatttttttgtcttgtcatttacaaataagcatagtcttattttttctaatcttagtacttttgattgtttaatatttcagtttttaaaatcaaggcataacttacatgtagcaaaatacagaagtcttaagcatacaactcgatcatttttttcaacattttattataaacattttcatacgtacagaaaagccaaaagaattgtaaagtgaacatccatatactcaccacctagattctgcaacgaacattttgctatatttacttcatcgcatctatacatcttcatgtccctccattcttccaccagtccatcttatttgatacatttcaaagctgcaggcatcagtacacgttgcccctaaacacttcaccatgcatatcattagagtttcatgtgtttacttgttaagctaaaatttgcacacaataaaatggataaatattaaacataaaatattgaacataaaacacatatttttattattcctttcacatgagattcatagatgccagaataacagttacctttttaggggtggtggtaagaatgcaaatattttatatctctatctaggtggtgttttcatgagtgtatagtttaaaattcattcatgacatattcatacattagaatagtatttactgataataagcaacaaactaacatataaatgctcctcacatgattttacgaatgtatgcatccgtgtcctataagtccattaaggtatgaaatatcactgccactgttacctcagacagttctctcatgccccttcccagtcaaacctaaccctaacccaaaaggaaaccacaattttgaaaatttttgccatagaaaatacagccttggtatggggatttgtggatggtctggaaacccttcaggggaccctgggggtcaaagctatgagtagtattgttataatactcgtatttttataattctactttggcattttcccttttctatctcattctgttgtgaatggggattttcagatgctacagtaatttcttgcattgtaatatttttgctcctaggttctgtatttaagggagattgatgagctgaggaaagaatgaatgctttaaaacttgatctaaggcggtattctccatcctactggacaaaataccccccttttttacaacaaatatttaatcatggccctattattctcctgcgatgcaattcatagattaaaataaccatcctaggccgggcacagtgactcatgcctgtaatcccaacactttgggaggccgaggcgggtggatcacctgagctcaggagttcgagaccagcctgaccaacatggtgaaatcccgcctctactaataatacaaaaattagctgggcatggtggcccttgtaatcccagctaattgggaggctgaggcaagagaattgctggaatccgagaagcagaggttgcagcgagcagggattgcgccaccgcactctagcctgggcgacagagtgagactctgtctcaaaaaataaaaaaatctaaaaaaaaataatcatcctaaacatacaatttaaaaaaaatcaatataatattctagctttgatataaaggagacataaaagtaattcataatgaatatgtattttaatatgtaaattgaattcagaaacagataggaaaatccagctgtcttttattaagctaaacattaaaggcatttttaaaaataaaaagtgccatacttttactttgttttggaaagtattatttttcataaaacatgttatatagtctaatatgtaaggtttattgtcatttttaatgaattatgaatctcaagtatctcagtataaaatgtaatatggtaagtgtacatatataacaacataaaacaaaactttttggttttcttttaataattatagtttttaaactgtataaggatactgagagcaaaaaatttgagaatcactggtttagcttgtactagaacaatataagtgaattatatagtgtgtggctttaaaaaaaaatctagtgcttattttactcaggataatgtttctgagatgcatccatatattagtagtttgttccttattatcaataaacagtattccattgtatgaatataccaccaatgaattttaaaatatatgcccatgaaaataccatccagatagggaaatacagtatttgcatccttaccaccttgcccctaaaggtgactgttattctccatctaagaatctcacatgcaaggaaacagagtttgttcttttatgtctgacttccttggctcaacgttatgcttgtaagattcacctgcgctgtggtgaatggtttgttttctttccttttaacgctagttctcgttgtagtgtccacctgtatctgtgctcttttgttctcctgtattttcacatggaatagcttttaatcttctactatttctacatccagacatactcattatacgaaggtggaagtatctaacaacttcattatgctttcagtgtagtcagccatcagaatttacatattgaaatgcaaagtcattatgaattgccttctttggtttctcctttacatcactgttagggcattatattgattttttttaaaaattctatgtaaaaggctggctgttttatctggattctatttcaggggattaaaggaggcattattaaatattagctgttaaaaagcaagggaatattgagtccagcaggattcagactacctccttagatcatgttttagagtatttattcccttctgatgtcaccatcctccatgagatacagaacctaggagcaataacattgtaatacaaagaattgatcacttgcttcacaagaacatgcttttaataagtgtatcatttattttacaaatggcgttttcccaagagatgacatttctggccggttgaccaaaatttttggtgatgagtagaaacttcatgtttgaggattgacatcttgaattttttgtgcaaaatttgaatattaatttatagaggacattattcttatctccacagtatctcatttgcattagttaatattaaataagtaaagtagttgtccatttttctcagtcttaacactttctaaattcatgcctcaagaagttcttttattccaagaaaatgatccaaacgttattaattgcaaagtgtactcacttatttttcacttcggggaaaaaagcagaatgataactaaaaatgaggtctctgaagttagactaccttgatttttaatccagctcccctacaccagtcacttccttgtatgcctcagttttcttatctagcaaatggggtaattgtacctacttaatactactaagtgtacctggttaatatggtttttgtagttattagagggaataatataacgtgagatacttagagcagtacttttagtaaggatttagtaaataagctttagtaaggacatgcaagatctgtaaagaatagcttttggttattatgggctattatgacttcagaaataataaatataaagctaatattaatactagctgttacaactttagaaataggaacaaatgatgagattagggcttgttcctttgaattttttggaattagttttcttagcagtcaacaagtatatatggactattagatgtggatactttggaattaaagatataaatgagtaattaatactccttagagtgagctcatggcattgtcactttaacaatatgcccaaaagtggttctatttaaattccacacaagagaagtagcaatgttatatagagcattgggttttcgtagctatttggatttggaaattaggagcatattagtaatcttagtaggacaagccagaggaatgaagagctaggaaggaagtagggattgtgtatccagctgggagaagtttgaatgagcatggaatagaatgggcatcttggaggagatccttctctaaggcatctagaggagaaggcagtgaacttcacacactggagggctgactcctggaggtgactatggagggaggggtgggccctcaggtagagtcagaagaccactcgtggctgcagagggacacttggactctgggactgcctttggtgagttgacccagggactaaggggagaaagtttgaaattgtgtctaaggggattgagcaaagcagcctgggaatgtgtaaaaaagaacacacaaataaacaaaaaagtgccgagtggtcctgaaagcccacgggatgagacagtttacagtgtgagaacatggtaaggcttttaaaaaaattgttttttctctttcatatttttcttgtaattgcttattttaacacaaaatgaaattcatgatagctaacacttacataggcttactctatgccaggcactgatctggtgtaaatactttacatgtgccagctcattccattctcccactaattttcagagctaggtaatatccttctcatcactttacagatgaagaaacagaagcactgagacatgaggtaatgtagttaggaggggaaaatagaatctgaacccaggctgtctgaatcccaagtctgtgttcttaattatctaatgatggtattttgcctcaaaaaacaaacaaacaaaaaacaacttaggaatcatttggaaggaaacaaaaaaaatagcacaacaaagtattatgcaggtcattgattatcataaaatgactgtctcccaaagcaaggagagatgattattgaacacttactttgagccagttactatcttaagccatttactttaccatccccattttaatcctcataactctaatacgtaggtgctgttactttcatccctgttcacacatgtggaaagcagcagggcattaatctttctaaggccacacagccaataagaggcaaaagcatggcacaatcccaggctcttgattgtcttagggatggtcattaacgtgccatttattattctggttggtagtttagcaaccagctttctaattgcatttactattctctttaaagcagcgttgaatataatagactgcaaccatacttctcctctaccacctaagttgcaacagaaaaactgttgctttgaaggatgtgcaagagcatagacatggcccgcataaagcagagtgtgaaggtccccaaaactcaaggacagtattgtcatggataaatacagccgattgagcatgctgatgaaatgttgcattatcatcttgaaccttaaactttaaggaaaataaataaaaatcagtaacttcaaagagcatttcattaaatagacaagtctttattattaagccctcagcatttctcagctcagcagcagttcctgagactgtgtctgataatctgaatggatagtgcaggcatgtgctttacatttggaatgtcttagaattgcttcttggaagctccagtgccaccagctgactggaataaattacacgcctagtctcacatattgtcagaagttttcacgtgtgcatcgggtacagcctaaaggtttggcacagagctgtaggtacacgtttatgctcaacactgagaaattgaccagaaatagtcaccaatgcttcacactttctgaaactcccacgtgtattcctctgaagtccctttctcattctaccctctccatgacccaaattgtcattttccattcagttttccttccccactcctttagatcctgtttggtagacttgccgtaggaacacagaacaaaatgaaacattttcttatgaatattcgtaaatttctgatggtcttgccctgttaagaccaaaatctataggtgtgccgggtgacatctgtaaaatggttgtaattatgccacgttctcttggtgccctaaaacctttgttgaattttttacagtagagctttttaaataagactttttatttggaaacaattattgaattgcatgcacttttaagaagtaatacagagagatcccatggacccctttacctagtttcccacaatggtgattgtctttgtccatttcctgttgcttagaatacctgaagctgggtaatgtatgaagaaaaagaatgtatttcttaacagctgtggaggctgaaaggtccaagatcaagggtctgcatttggttagagcccttttgttggtggggactctcttcagagtcctgaggtgtagtacagggcagtatatagtgagggggactgagcctggaacctcaggtctctcttcttacaaagccacaagtcccactcctatgataaccctttaatccatccactcattaatatattaatccatggatagattaatccactcatgaggtcagagtccttatgatccaattgcccctaagctcccatctctcaatactatcacattgggtattaattaaatttcaatatgactttcggagggggcacatattcaagccatagcggtgacatcttgcagaattgcactggaatatcaggaccaggatatggacattgataaaatctaccatgtcagtgggactcctgttcaactcagatgagggatgagcctgcctggactgccttctatggtaggttaggggttaggagttaccaggcctggcttactttctgctgttggtgagggaaggaaggtaacgttctttgttgcgatcttcctccagtcctggggtccctagccagttttcctgcttgttcacaataggtactaattgatgctcagctgaaagtcaaacactcagattttctcagtgttatttgtacttattgtctgtgtgtgtgtgtgtgtgtgtgtgtgtgtgtgtatttacggctatgtaattttaccacatgtgtaagttcacatatccctactacagtctccattcatggagaataggttactggttatgaggagtgagggagatgagacagggccgaaagtggtgaatgtatttataaaagggcaacagaagggatccttgcggtgatggaactgttctgtatctggactgtatccgtttctataattatgtcatttcaagaatattctctaaatggagtcatacaatatgtaaccatttgagattatttttccctctcagtgtaattcccttaaagtccatacaaatggctatacgtattaataactcattcatttgtattgctaagtaatgggtcatggtatggatgtaccacagtttgtttcgccattcacctattgaaggacacctgggatatttacagttttgggcttctgtgaacattcatgcacaggtttttacataaacataagttttcatttatctgagataaaaatctcagagtatagttgctgcgttgtgtggtagctatatgtttagtttcctaagaaattgtaaaattgctttccagagtgcctgtagcattttacattctcaccagcaacgtctgagtggagtagagaggcttcccagcctgggcacttgttgtggagagattcccccttgctgtggctgcccagctgccttgtgtgtgttggtgagaaaggagtctcatgtctagtggggaaggaacatccttctgtctcctgattctcagtgggctgccagttggttgatcccttgcctgtgctgccaggcttaccttctgttgtcagtgggactcctgttcagctcaggtaagggatgagcctgcctggactgccttctatgataggttaggggttaggagttacgaggcctggcttagtttcttctgttggtgagggaaggaaggtaacattctttgttgccatcttcctccagtcctggggtccctagccagttttcctgcttattcacaataggcaggtattgttgctcatgagcctctgaattggctgggtgttttttctggtcttggctttgtttgtcccttgcactaattgatgctcagctgaaagtcaaataggtggctctgctgatctggactgagctgcctcacatgtttggagatcaactggctatgggctcatctagcatggcctcagcttgcacagtcatgctcttctctctgtggtctctgattcttcagcaagcccacctgggcttgtgcacatgatggttgcagggatccaggatagtgtggaagtgcacaagccctcttggaattggagcttggagttggcaagccatcacctcacttgcgtcgagtgaaccaaagcaagtcacaggatcagcccagagtcaagaggagaggaaaggacgtgcttcctgaaggcaggaatttcacattcatattgcaaagagcagaggtacaggggagcataaagaatcgaggccgtttttataataaacttaactcaccctcattgttgtgcatatgtatgactgagttcatctcttggggttctgaatacctttaacctgtctgtactttggttacagggactgacatctgagtcatttctctttgattcataggatggatttaatttttgaagccatccatcatggaaagaatatgctttgtcttctcagaaattgttatttttttccagattatttcttgacatgtttctgcatttttcaaatgtccttttaaaagtatgtagctttgttttccaatttttttttactgtggtaaaatacagataatcaaaaatttactgtcttaaccatatttgaatgtatacttcactgccattgagtacgttcatattgttgtacaaccatcaccccccatccatctccagaactcttttcatcttgcagaactgaaatgctaatccattaaacaataactcctaattcccttcttccttgagcccttggctggcacccttctactttttgtcttatgagtttgtctactccgtgtacttcatataaatgggatcatacagtatttctcattttgtgactggcttctttcacctaatgtaatgtcctcaaaatttgtttgtactgaagcctgtgtcagactttccttcctttttatggctgactgataaagagggacctgcttccgtcatgttgctattctttttcctatatgtcttatcacttttttggttttccatttcctgcatttgtctgcttttgtgtttagttgattttgtgtagtgacatgtttgaatttttttcttttttttttatattctacgtctgtttttcttgtagttactatgcagatgacatttggtatcctaaagtcaaatactcttaatttggatttatatcagctgaacttcaatattatacaaagtgctgctcttttatatcttcattcccactgttttcagttgttgatgtcacaaaatcacatacacgatacttccaaaaacatcaataatttttaaaaatgcattagccttttaaataacatagaaatcaaaatgtggggttaaaaaccaaagttacaatgatactagcttttagactaataattgcttttaaaaaaagtattagcatcttaaatcatatagaaaaaagtggagttacaaactagtgctaaaataatactagcttttacaattgcttatgtatttacctttactgaaatctttatttcttcatacagctccaagttactatccagtatcttttcatttcattcagaagggctccttttagcattttttgcagagcagtctacaggtaacaaactccctcaacttttgtttatctgggaaatcttaattccaccctcacatctgaagtcccattttcctagctgtaggattcttggttacagggttttgtttttgttttttcaaattttctgataacaaatctgctgataattttattgaggatcccatgtatcgtgatgaatcactgcagtttcactgatttcaagattctgtctttgtatttggctgtgggaagtttaattacaacgtgtctcaatgtggatatcttaaagttcttcctacttagagattgttaaacttcttagatgtttgtattcacatctttcctcaaatttgggaagttttcagcccttatttcttcaagtatactttctgttctttctccctctcttctttttctaggactcccataacacatatgtttgtcctctttattgtgtccctcaagtcccttttgctctgttcacttttcttcaatcttttttctttctattcctgagaatattttcctttgccctatcttcacattcactgattctttcttccacctcattaaaattgcttttgaatccctctagtaaatttatcacttcagtttttttttctgctccagaatttctttttggtttcttttttggttttctgtctttatttatatttccattttgttcaaacgttgttttcttggctttctccacatctgcctttatttctttgagcatcttcaagacagttgttttaaagtctctgtccagtatattagccatcagggctttttcagggacagttactgttgttttattttttttctttaaatgagtgatactttcttatttctttgtatgccttgtgattttttgttgttgttggaaagtggacttttgaatctaatgaggtaatatggaaatcagatttcccccttacccaaagtttgctgtttttgttttttgttttgctggttgttgtaggctgtttctgtgccatggatcagcctaaggtgtatacttaagttcttctcaggtcttttctgagcctctgccttttgctgggcatgcacaggcacttcctaattttcctcatatatgcagttgcttttgaatatcctaatcttcaatgtctgcttcctaaaagaagagaaagagaaaaattaggggataaaagaatactggcctttggccaggcacggtggctcatgcctgtaatcccagcactttgggaggccaaggtgggtggatcacgaggtcaggagatcgagatcatcctggctaacatggtgaaaccctgtctctactaaaaatacaaaaaaattagccaggcatggtggcgggtgcctgtagtcctagttacttgggaggctgaggcaggagaatggcgtgaacccaggaggcggaggttgcagtgagccaagatagcgccactgcactccagcctgggcgacagagcgagactccatctcaaaaaaaaaaaaaaaaaaagaatactggccttttaaatctcatggaagtcactttaggtggttggtagaggcctacaacagtgggggaaggtgcagcaacagcggccactggcctctttgtctgcacctctgtgatcaaaagcagcaatcagtgataagaacagatgtcttgtgtttggaggacagtgtcctttttgcctaccaaggctcctgcaaaccgtatgccaagctgctccaggaacatgtgcacagctgcctgccatgggactggggcatgggataggtagctctattatgccaagagctgaaattaactgaaaataacttcaatttactgtccaagccttcttctggaagttggaagccttaagtagcctccagagttccaaaatagttatactggacagattctgccagtgcaattgttgtccaggtgagaatacagactcctggttctctctcctctgccatcttcccagaatcatcctctgtatcatttttataatctgaaaaaaatagttgtggaatttggaggtatttttctaggttttatgatcttctcctgaatgttactctttgtccagccttataaatttttggtattattatccagacaaccatgatcctacaagtctgacaaaccatgctgtgactacttctaattgggactgttaaattatcacactcatgcattcctgtgagggaagccttttgcttctatggtgggtcctctgtggaaggtgcgtctgccggggacctgtgaaggctgggcagtgccccagggaactgtgaaggctggacagtgctcggcgctgatcgatggcagggtcagctttttgagagccctgtttgtgttgtcccactcctgttcctggagaaaatcacctttacaaaggctcaactggcaattttggaattacttgggtcattgttctgaatgtgctattggttttcagtaaataaagttcaaattagaagcttagaaatagtttaaggtgtttggtttttgagctcctaatagtctttcttcactattttggccctcttggtttctattaagttggaccatatgtaattgtcattttgtaagtcaaaagcaatggaatagtggcaactgcctatggttcaacctaatactttacattttacctgtagcagattgtggctttgttttgttgccttctcaactttcaaagaaagcctttttttttattttatttttttttttctatttgaaggctgtttcccagaccagatgtatctccagctctgacacatatgtgcttgactggtcattcacactgatgtttctaaatcagcctttcataacatttttatttattagtacctctttttttttcttttttttttttgagacagagtcttgctctgtcgcccaggccggactgcggactgcagtggcgtaatctcggctcactccaagctctgcttcccgggttcacgccattctcctgcctcagcctcccgagtagctgggactacaggcgcccgccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcctagtacctctttaaatgaaaaaattatttgataaagtcttgactgtctttcccacagttgtttgtgaccagtatttgcactgattctcgaaacgagtgaatcttccaccagtccctaactgtgatcctaatcacgtgtaacgtatttcccaccctgcattgtccacaggattcttcattcatcacctaccacgcatcaaagtgccagacactggagtcagaaatatgatagcaactcatgtatgctgtgtgatcagtaactatctgttgaatgaatacatgactgagtgtaagttaatgaacgaatgagtagcatttgctttggaggagctgtctgtcttcagaagagagaaacttgtaagcagacattgtcaatttggtgtgcaaaggacaatcatagatgtgtatgcaaagggccatgggaacactgcagagatgttagtttttcatatgcactgtacccacattctgtttcccagttgcacggtgaaaatctattctgtcagatttgtgttttgatcacttaaggcttctgttactatcacctgaacaaattatgcagatttctcaatcacatttgacatttctggttcaatattatgaacccgatcagatcccattgttgtgtaacattttctggatatatgtcttcgtcacctatctcacaggtttgttgtgaggcgtaaatgaagatagtatgtgaatatgtataaaccactatgcagaaaacatggaggttaagctgtcactctggatgatagttgttcatcactgcctacagtaactgacctataaaacaaccactaggaaaaagaaaagaagatattttgctttttttttttttctggaagaaatacagtagatactcaaattgcctgccaatagaatagtttcctggacaaggatgaatctagaaaggacatttaacagagattgaccttggttttgttacagtgacctgagaatgtcagtcagtagtcttgcataaccaccatatagtgaaacttctcaaaatctccatggtaacatgcagagaactgtatcatagagcacggtgtatacccacacggactgtgatccaggaagaaagatctgtttccacccccacacacacttgctcacgttcacctctcttctgccccagcgcctcagatacctgcttcctcactggtaattgtgatgatatttttctctaaaatctattttgtaactcattctttctgattttactctcaacccccttggcgcttacattggatgagataaaagtgtcactgtagggctgtaaactttgttgtgatgaagactcttgagacgtaaaatgtatgctctaactgcagacctgtgcagaacgcgagtttgatcttcaagtgactttcgttccagccttgatattcagatgcagtgcactaatttgcccttattggcatcctgtttaatagatattcctaagcctttttccaaatagttgcatgtttgaggaagactttatggctatcaaagtgtttactcatataatccagtttgatcctcaccttgtgagatcgtcagggccggtaggatggttgtcattttacagatgaggagacattttctgatgggaattagccaacctgtggctgagctggaaccagaacccaggcctgtgtccttgtactcaggttgccacagcattcctcctgatgtgcccagcagcaggcttctaaaggacctgagccccctctgccaacagtgtcccctcttagctactggtgtgatatgtagctgtgagtccagggtgggtattcacatattttcgattgaccaccagcttaaaacttcccatgccacaccacactgcccatctatatattactttgcaatcattatcataagcttaaaacttcccatgccacaccacactgcacatgtatatattactttgcaatcattatcataagcttagagactttacagaaagtcgtccttaaagtgttgctaaaaaatataggtcaattacaaaaggagacatggtccttttcttttttcttctcccctaattataaacaataaaagccacagcttcatgctgagaaaggatcagcagggaatgatggacattgtgatttggcagctgacattttctaacatgattttgttttacataagtagtttgaagtttttgttggttattgtcttgccttcctttctgacaaagtaacattttttttgcccataaaaatcaagtagagcaatgcatttcccatgccgtcgtgtctcccatcttgtagcaaccagtagtgtataaaatgaaagtcttcccacctttaagcaaatgtttgttttccttattaagaaagaagtttcatttgaagctggaggtttttttttcctaacttatattagtccatattttaatagtagtttcctaaagaaaatatctcagcatgaaaaagcaaggtgatactatattttagaaaatgccctcatggcttagattttaaaactaatgcttttgttaagtgttttggctttgaacaaaaagcctccttgagaaacgctatttcccattgcacggtttcttaactctctgggttaaagttcgtattttctatctttttacatctggcaaatagacccagagaatgtttttgtttcatctaacagttatttctacagatctgaccaggctgcctgcacacatctatatttttacactgacagcataagtgtatgttttgtatttcattgtagcgaaagcacttcacgtatgcttatagtaggttgaagtatttttagatcaaacgtgaatccaccatgttccgtaaactaaaatatatttaatcttaacagagtatacttggcggaatggctgactttaaacataagcttaaacaaaatgatgagttcataattatttaatgtaaactgaataaggttgaagggccctgcagggtcgatttcaaagtgcttcaatgattacaaattatagaccgcctttccagtaaaacactactcaggtgggagactagctggcagcactataaagtacctaaatggtttcagactaaagaatctgttagttttgtaggtttaacatccttgacacttaataggatttgagattccattgtagcagcagcttttattgcatgacactttaattgaatgccttagagtaaaatgaaattaacaaaggcagtattaaattatggatgttccttttttatcatttggctaagaattctgcggagtttcttttctgattatattattttaaattgattgatgtgaaaaaataaacacactatctttaggactaggtataccatctggtccaagaaattgtgaataaaatgaatacagagctggagttggccaacttgtctctcctacgcttcagaaagcaattacgttagggctagagtagtttaaaaatggcctgcaataaatccccattcttgagtggataagagcaaggcagctccgtcttttgcattgtagctaccagaatgacaacgtattctgagacagatgggagacatcgaacagtagttgatttttgtttgtgaagtggtgtggcaaagccagtaacctattttttttaaaaaaaaaaaacaaggacaaatttaaccaaatctgacctgtttatatttaaacatcggtgattggaaaaccgttttcatatttggatattgacgatctttatattgcttctccttttctctaatactatttaaaataagaatctgcaactaaactaaaatattcaaaaaataataaagttaagatgatgagtccgggcgcggtggctcacgcctgtaatcccagcactttgggaggccgaggcgggtggatcatgaggtcaggagatcgagaccatcctggctaacaaggtgaaaccccgtctctactggaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagggagactccgtctcaaaaaaaaaaaaaaaaaaaaaaagatgatgagcatgatgtcagcaagatagtggaatcagaagcctcagtctctactcccctgacccccacacaccaaaaggtgaacttgcagctgtccacagactagaatatctttttgaaaatgtcaacacttggaaacgagcctgagatacctgtgtgatctgcataattcaatgaaatctgaattaggagagtgagaagaatggtctcactctgaccacactgccccttcccatctcccaagttggcacagtgccagactgagaggatttccctggaccaacagtttctgccacagggaaagagaaccagaggcagtcatctagtgatgctaacgttccaggatgcttcacaagaagcccactctggtctcacctcttaggaaacactaggagaaacagcatggccacagtgcctagggtcaggtagaaacaaagaaaggaggcagaggtcatggttaccagcacatggatcttagaggtacctctgtgtttctggcagctgtggctcccaatagcagataccagtcaacttcataacccacatttaaagctaagctggttgccttcattaacgtggtaggaatttctacctagcctgagttcctagaatgctattctccctggctagcttcagagcccacccaacaagcctgcacaggcaggaagacattcacctcctcccatttcagggaagcaaaggggctagatcagcttgacccagaaagtcgagctgtggctccacctagctagaaagcccacccaaccaccctgtgcaggcagagactcccacctcctggcattttggataaatgcaggggctagtcttgcttgatctagaaagtcaagcagcagcactactcagccaaaaagcctgcccaatgaccccaccctagccaggagactcccagctccacagatttcagagaaatgaaggggttagatcagctttacctaggaaggcaagcagtagttccactcagcccaaaagcccacccagtgacccgacgtaagcagggagactcccaccttcatggatttcagaaaagcatagaggctagacctgcctgaccaggaggtcaaacagtcactcaactcagtcaaaagcccacctcatagctccaccctgacagggaggaaatcctgaatcatgaatttcctaaggaacatagcctctggtctgcttgtcccaagcaatgactttgctaacctcagagaacagcctatagccctgcccaactgtagatctcaatagtggccaaggaatacatcctgtaactggcctgaccagaagtcattgcagtacttagccagcaatctcatcaaacagggaagccaggcccacaaccccacctgacatcagagcaaaagcagcagcccaactaagttgtgaactctcatgaagctctgcctgcccaggattatcaccagatggcccttccagaatcacagtctagattagatagtggaaatctattcctgtcaaagaacacctgtaaaggccagaaaaggggactgtcttctcaaatgtgcagataacacaaggattacaatgactcaagggaatcatgacacctgcaaagaaaactaataaagcttcaatagtagaccccaaagaaatggagatctgtaaaactgttgacaaagaattcagaatagtactcataaagaagttcagtgaactacaagaatctatggatagaaaattgaataaaatttggaaaacagtacacaaagaaagcaagaaatttgaccaaaaatagaaacaataaaaaaaaacaaatcttagagatgaaaaatacagtggctgagttgaaaaattcaatagaaagcttcagcagaagacactgtcgagcagaagaaagaattagtgatctggaagacagaacatttgaaataatccagaagagcaaaaagataaaagaatgataaagaatgaagaaagcctatgagagttatgaacactgtcaagagatgacacctttgtataatgtgaattaaggacagcagagagaaaaaagcaccagaaactatatttaaagaaataatagctgaaaacttttctaatataggaacagatgccaatacccatgttttaggctgttgttgcattgctgtaaaggaatacccaagactgggtaatttatgaggaaaagatgtttcatgggctcatggttctgcagacagtacaggaagcatggtgccagcatgtgcttctggtgagggcctcaggaagcttacaatcctggcagaaggcaaaggggaagcacttgtctcacatcgctagagcaggaacaagaggtgatgggaaaaggtctccaactccttctaacaaccagatcttgtgtgaactcattaccatggggagagcagcaagccactcatgagggatctgtccccatgacccacacacctcccatcaggcctcacctccaagaacgtggatcacagtttaccgtgagattgagaggataaatgtgaaatcatatcaacccaagtacaggaagcagagttctccaatcaaattcaacccatagaagagtttaccaaggcacatagtaatacaattatcaaaaatcaaagacaaaaattccgagagcagcaagagataagaaacacttcgtatacaaaggagtaccaatactaccatcagtggatttctcagcagaagccatgcagacactgaaagaacaagatggtatattcaaagtgctgaatttatatttatattttacaataaagtgttgaatatgtaacgcaagggtatcatactgcatattagtagttgagaaaaatattaaaattcaaaatttgaatttaatatgtattgcttttgcattattgtaaagttgaaaaattctaagttgaacttttataagtcaggaattgtctgtacttccaaaaatctttttacaaagccaacattaccttggtaccaaagccaaacaagaacattataagaaagagagttaaaggtcagtgttcttgatgaacatagatgcagatttctcaacaaaatactaacaaactgaattcaacaacacattaaagggatcattcatcatgatcaagtgggatttattcttcgatacaaggatggttcaccatacacaaatcaataaatgtgatatatcacattaatggaatgaaggacaaaagccatgtgctcattttgttagatgccgaaaaagcatttgacaaaaattcatctttttataaaaattctcggcaaattagttgtagaaggagtggacttcaacacaacaaaggccgtgtgagagaatcccacaattaaaattatactcagtggtgaaaaattgaaagcctttcctctgacatagacaaacatgcctattcttgccacttatatttaacatagcattggaagtcctcaccagagtagttaggcaagaaaaataaatagaaggcatcgtaataggaaaggaagagctgaagttgtcactgtttgctgataacatgatcttatatatatagaaaatgctacagaccccaccaaaaaaaaaaaaccctgttggaactaataaacgaatatattacagttgcaggatacaaaatcaacacacaaaaatcagtggcatttctatatgcaaacaatgaactatctaaaaggttatcaagggaacaatttcatttacaacagctacgaaaattacttaggaataagttcaaacaaaggagtgaagacctttacactgaaaactagaaaatgttgataaaaaagttgaagatacaaataaatggaaaaatattttatgttgatggattggaagaattaatattgttaaatggccatactaccaaaaccaaccctaccaattcagtgcagttcttatcaaaactacatcatttttcataggaatagaagaaacaattctaaaatttatgtagaaacaaaaatacccccaaatagccaaggcaatcatgagcaaaagaataaagctgaaggcatcacactacctggtttcaaactatactacagagctatagtaattaaaacagcatgggactggctgaaacagatcaacagatgaaacagactagagaccccagaaatgaacccatgcatatgatttaaatttattttctttttcttttttcttttctttgttttttttttttggttagagaaagggtctccctatattgcccaggctagtctcaaactcctggcctgaaatgactcatccctgagcctgtcaaagtgttggtattacaggcatgacccccatgcctggcctattcaactgattttcaacaaagatattatgccaagaatatgcaataagaaaaggatatccccttcaataaatgactttgggaaaagtagatatccatacacaaaagaatgaagttagattcttacttcacaccatatattaatataaaaatcaactcaaaatggattaaagtcttaaatataagatgagaaactataaaactaatctacagagtaagaaaaaatatttagaaaccatactttggataaggggttaatatccaaaatatataagaagctcaaacaactcaatagaaagaatacaaaaaattctaattaaaaaaatggacaagggactggaatagacatttctcaaaagaagacatacaaatggctgacagatacatgaagaaatggtcacatcagaaatcactaaggaaatgcaaattgaaatcacaatgagaaactacatctcacacctgtcagaatagctgttttcaaaaagacaatataacatgtgttggccaggatgtgaaggaaagggaaccctgttggtggaaatgtaaattagtgcagccattgtggaaaactatgtggagattcctcaaaaaaaatgagaaatagaactgccatatgatctggcaatcccacctctgggcatttaccgaaaagatttgaaatcagtgtgttgaagacgtgtgcacaccaatgtttactgcagcattattcacagtagctgagctgtggaatcagcctaagagtccatcagcagataactgggtaaagaaaacgtggtacttacacgtaatggaatactattcatccttaaaaatgaaggaaatgctttcatttgcagcagcatggatggaatcagagagcgttatcctcagtgaaagaagccaggcacagaaagacaaatatcacacaatctcactcatctgtgaatctgaaacaataactcatagcagcagagagtaaaataatggttatcgaggctggagggtggggggaatagggaggtgatggtccaagagttaaaagatctcaggcaagaggaattttttttttagttttgttgctgagcatggtgaatatagttaataatagagaattgtacacttcaaagtgtctgagagtaaattttaaaagttctcaccataagaatcattaaatatgtgagctgatggatatgttaacgagattgatttaattattccacattttattaatcaatcataacattactttgtaccccatacatttatgcaattgtgaattgtcaatttacaattaaaaagtattttcaaagattttaaaaagtggaggctggactgcttaggacatgtgaaaacagaagacaaaatataagaaaacattacaaattaaataattattttcttaacagactattggtgtaaatgctttataagtaactgtctactggatggaaagggggaagaaatttgaacatatctggtaaattacttagtaaatttaggcatttatttaaaaaaaaatacacttgctcatgattataagacttctgagctcagattgtgagtgtgaggaaagaggagacagcctcttaaaaaggtcccaagcatgacagatgcagatcttggttgagagttgttgcttctgctgtcagtcacatcatcatcctgttaaatgtgaatttatcttttttcccctatgcaaaatagtgagagaaatattccttgaggaaatgtggtctttatttcaaattaacagttttagcgattgcttgcttttattaggtcatgcatcttgttttctggatttgtcatataatgcagttgtgctcgtgtaggtaacacaaatgtggtctctttgaacatagaagctgggattgcagtgaaatagagagagcgaaagtgctctccttaagtcctccttgtttgttctctttcttttgggttctgtctgttaatttatctcttttactctttcccttcttccttccatccttgtcaaaagcatttatgtactggacagaagcatgtcttggatgacttaaagtgcagccctgttttgtagttattatcttcctgcataataagtaatctctgttttccacttgttgcagagttaaacacagctttctagtgaatcctcaccctagagtagaggaatacgtgatattaattgaaatagacttcctacagggcattttgtagcttttctcctctttctcacttaaaaaacataccagatagttttgtgttcaggaccttaaatcctagcctagcaacggtcatacattgtgaaacaaataatgagagagaaggttatagttaatactcttataagcctctccatgtacaagaatacagacaaaaatgcaaagaacagcactggatgtcttctgattaatcaaattatttctgtgtctcagtgaatggactgaaatacagtacagcctatttgccttaataccgatgaatttttatacagtgagtacgttctctggtctttttctcgctgatgaaatggatgtttgtgttagggctagagggagaaaagaggcgtgatttaactgttacctgtgcctgtgctttacagttttcctttttaaaacaagttttgaggaatacacctcggtagtactactgtacagctggcaccctacaactccctttggctcctgcagctcccccacacccccaccaacacactaatccatataaaagtcatattactggagctccacctcatctttttcagatatcaaagcaaatagaagaaatagagtataaacattgttctcttactctgacaagcagaattgatagacatctttccccatacactttagtggtggttgacataaacattgtttttgttttcaggttggaaataggaaatgagacttgacaatatattcgtgtcactaaaattctttattccagaaaagacttagtattgaaatcacacacacacacacacacacacacacacacacacacacactcccatacagaaaacttttctcagtggactattgccgttagtctttctcctttttcccacctaattacctgacattgtttgaaagataattataattgacaaaattattttttctatacataagcatctaaactctgattaactcaggaaaacacaaagaaaatagttacttcatttgcagaaaagcaaaggtgacagagcgtagcaacatgatgcagctgatcacactggagccttgtgcacacgctgtgttcctcccatttgagcttaccctagagatgaacctgtgtaaaaagaggtaaataccaacaggaactgagagcaattctagaaaaactaatggcattggttaaaaaaaaaatcccttctcctcaatttctgtgtctaagtgattcctaaagtaccattttataaatacgaagtatcattcctctggaagaccattcctttttgtttttttcagctggcccgagccctacctgtcctttccttataaaatactggccaggtcatcagaaaacagttaactcagagatgctctctaaaaaactctctgaagttgacctgcatggcagaagtgtagcaagtcaactctctctgctgtccctcacctgttctgtagctttgtgaagtcctgcatgaaagcatttcaacataagacgtggtttcattggggcccttctacctcaggaccgctggagtttgtatggctgtcagtgtcacatgcggttgcacagaagccactctcagaagtctgaagagaaaggaactgaataggagagttagtttcttagagagcccgtgggaggaccggagggcaggctcttggaagtgactctgagaatcatgccaaacagctcgtgtgctccggggagtggacagtctcaaagctgcagccccacctcccggcccgggacctcactccttctgcttcgattgaagcaggaagccactctgcactcactggctctgggagagagtgctcgggcaccagcttcttcagcagtgtccccgcctctcaacagtcatgggtggctactgctgccggacaccagacaccttcatacgcacgcttgtcagaacagcagaaacctggtctcaccttgtgtctccctccatcgcccataacagggtgtgcggtcagtgtgtgaaactccacaaggagtttgagaaatgcagtctcgtgctttctagcttctgccaggccggagagtctgtgcagaggggataaggtggggtagaacaagtctgtctgtgatatctaccacccagtctgcatttgaagtggaattatctcccgaaggcaaagaaatcacatgtcctattagaattctgcatgctgtgtgattctgatgccatgattcctataccttttggtcaggggtgtccaatcttttggcttccctgggccacgttggaaaaagaattgtcttgggccccacataaaatatactaacactaccgatggctgatgtgctaggaaaaaaatctcataatgttttaagtaagtttatgaatttgtgttgggctgtgttcaaagcagtccgcgggttgggcaagcttgctttaagtcatttgtgtggtgtgtcaagtagtgctacccaaaggtccctcaaaaagcatcattcgcccttgcctctcccagttccgagagaggagacagaattcagggctgagcctgtaggctgcgtgagtctcctgctcagtcctgagaagaagacctgggcatgggatgggatttagatgtagaatagaactgtttacgggggctcccctctgttccctgagcatgggttgtcattggttggcacaagtgccacggctgacaagctcctttctgagggagcagagcttgaccatatacaagatatgataatactgtttgtcaaggatacagcctgaaagaatgaaatagattgaccctagggaaggccactaaccggggaaagtaattccacttgtagctgcttttttttttggacggagtttcactcctgttacccaggctggagtgcagtggcatgatctcagctcaccgcaacctccacctcccaggttcaagcgattctcctgcctcagcctcccaagtagctgggattccaggcatgcgccaccacgcccggctaatttttgtgtttttagtagagatagggcttctccatgttggtcaggctggtctccaacccccgacctcaggtgatccactcgcctcagcctcccaaagtgctgggattacaggcgtgagccactctgcccagcctgtaactgcttttctactttacaggtataaataagtgttcctaagcaacccttcttaaaattagttattttaatgggactttttgtgttaggttattttagaaacattggtcacgtgtatatactttgggaattaaaaaagaaaagtggtgacaggttggaaaagtgtatcatccaacttctgatcaaacatggagcattaactctacacttatatcatctcttcctcctgaaaccccatgaagatgatagaaagacaagaagatcaagtgtgaggtacgagggaaaagggattggagaggaggcagcaggaggctgtagatgagatggcttgtgagacctttgcaggatagaaagcacttggagacacaggagctgaccagcggaacggggactgttgcagtcagagagcctgcagatcagtttacccgcgcaccctggacaggctcgaggacaggctgtgttggggggttgggggcgggtagggggcaagtggcaggagtggtgggaagtttacacacagcatggtcgccagctaactctgcaccatttcctgccaccacctctcccccttcccgaggaccaaatagttattcagcggagaagttgagaaagaccccgtagtccaaatgccaggtgtagcagagtgggaggtgaggacctgagaggagaagtctgcagactgaatggtggggccactatcctattttctgccgtccttcctcagacaccagcaactgatgtttatgtcacagtttagaagccagggggctgtctctgaagaaatggaatgggttcagagagaggactttcagatatttatatctgaaaacagaaattatactaggtatttcaacagagggatttaacacatggtaaagcccctctcccttttcccgccctccagtctcctgtggctgctcaatggcaggttctaacgaggagccagctggcaaaggggcctgcaaaaccagtctgcagagaatagtgtggaaaggtgggtttggagctgagaaatcagaagcgaatggcccacacagaggcaaataccagatcacatggttaaaaagtctaacagtcggccaggcgtggtggtcacacctgtaatcccagcactttgggaggctgaggtgggtggatcacttgaggtcgggagttcgagataaccctgaccaacatggtgaaaccccatctcactaaaaatacaaaattatctgggcatggtgacgcatgcctgtgatcccagctactcgggagactgaggcaggagaattgcttgaacccgggaggcagaggttacagtgagctgagatcatgctattgcctgggaaacaagagcgaaactgtcgccaaaaacacacacacaaaaccaagtctggtagtggttgcttttgggctgtggaacttggggctagggaggttgggacaggggaatattcattttgggggcagaagctaaagtgtgtagaaattaacttgacagtaatcaaagaggtagccaccctgcttggtttgaatcacagctccgtcactcacttgctgtgtgaccttgggcaagttacttaacctctctgtgcttcagtatcctcatcggtaaattgggtctaacagcagtgcctagttcctggggagtgacaaaaattatttaatactcttaaagctcttagaacagtgactggtatgtagtaaatattacataagtggtagtttaaaaacaacaaaaaaaaaaacacctgtaccattaagggctgagatggcagacaaaacctgagcttaggtgaagaggagtgtaacctagcaacattgtgctggactagatgaatccgcctcgtggaactacagccagtgagtaggagttgtggaaacagatttaatctttgggaactgttttgaattatttaggtatcggggctccgtattttacaagaagctgaggcagaagccatgtcatatggaccagctcatcatggtgtgagcataaggaaagactgacttcgtggcagatggtcattctaaggttccctcagggtcatcagtcatgagcccaaaatagcacgatgctgcagaggctgccatcctgagggatgcggctgccgatgtggttgctgcctggccttcatcccctcagtacccaggcagagaccgagtgggatggtaccacttgctcccttgggtggggaggacgattggagaaggatgagtgggctcacaacaggtgcccactcagcggaatccaatttcctgtctctgaaaggagaatcagtttgtgaaattgaccttaatcaagggtgatctgttcggagagtgctctatggatgccattcttttctgggtcttttggccagttatggaacaaagctcctcagtacctggcattgctttgacactggcatggagtcaggcatggtggctcatgcatgtaatctcagcgcttagggagggtgaagcgggagggtcacctgagcccaggagtttgaaaccagcctgggcaacacagggagagtttgtctttccaaaaaatgcaaaaaaaaattagccagatgtagtggttcatgcctgtagtcccagctactcaagaggctgaggcatgaggattgcttgaacccgggagttcaaggctgcagtgagttatgagtgcaccactgcactcccgcctgggcaacaggacgagacccccttcctaaataacaaaacaaaataacaaaaaaaacccttgcattaaccttaaactgggcctctcataactgcctggctccagaccattccagccccccacttccatgccctaaaatgtccagatcctgacctgcaattgcctgaggccatgggtcctgaaccccttcaccccttcaccacagactcaactgcatgtgcctttcctcctccctctttgctttcctcttctctttcttccatcatttctagtgaacattagataattaattttgttgttttcctaagatctacgttcttgagggcatgcaccgtgacttatataactttatattcactgttcccctgcccaggcagacccagcagaaaactaacctgtgtcattcatgttagttgatgaataagcgaataatgcaaatcaggcttttatgctctcactctctaacccactgccatcaggtgcctgaatattgccttctctccctttctccctcccatccatccatccatccatccatccatccacctgtccatccatccatctaactactaccccctcctcctgcagtctcccatccatccatccatccatccatccatccgtctgtccatccatccgtccaactactaccccctccccctccagtctcccatccacccatccatccaacccatttgcttctctgtacctctcactcttgagcttgttgacttaacatcaggaccattgatggttcctgcctacagtccccatcaccttcctctagcactggcgttttaacatagaaagcttaatgagtgcattcagttctgctttggaacaatgaaatgttaactttgtaataactcaagcctttcacataagggggaggaaaagattcatttcacaatgatactgagaattgtgtaggagctaatggaaaaaaggtcaaaggattttagatcctagaaatgggacaatgacaaaaattagtactattaagaagagtgatgtgctgttatgaaaaatatctacccaaatgtccctttaaaaagttatatttccatgtaagggttataattttaatattttggtctgtttccgtaaaagacattacatttctaaatttgaaggcaaatttccaatattaaaagatcctgtcaatgattcatttactcagctttaaatcttgtcttccattcctctttgaaaagacctgattattattaataatcagctctgcctaagttgtattctccttggatagaaaagctatgtatttgaagatcttatgctctacaagaaaatcctgcccagcgattgacgtgacaaacgctgaatatttcagtgcacaatgacggtggctttcagctcatgaaaggcttcctcgtgccttagatagtcttcaggtttctttcttagtgcaaacttttaagtggacccgtgatcctctgccctttacagcttttgtatccttcttgtgtcgattctatagctgttgtcagcaactaagcaatcttgttttttctttagatttgggaagctacaaactgtatctttctaaaccttccactcctctgccacttactgagctgttggaagcaaagtttaaagtataaatgcagtgtccacattcacagtactggattctttaatggcagtgagtgtggttattctggcatcacagaaagggagtggacttatgcaggggtgggggtggagagccatatttctgcacaatggcagtcaccttggaagatgtaggtggatctacctaagcctgatgaggacctcattggtgtccgggagcagggtgctccctgccctgttctggggaatgtgaaaatcctctactgctgaaggccttttgttctaagggcacctccaacccccacatcctagtagtcggctgccctcagacttaccacatgccaaatatgtttcatctttaagaagcatgctatctttatacaattgaatgcactctttgaatctattttacgttttatgattttaccttttttaaaaaaagtatcatgaggtatttcagatatgcaaagcaagtataaaggagaacggcgtgaatgtggacatacccagctgaccccttgaaggtgtaaaagatcagcagcatggccgaatgtcccttcccacatctcctgtccctcaagacacagacactgacctgaacttgctatttaacattccccttttagcttctttttaaatttttataacgattttaaaaataggaagaaaaaaaaggcatatatggcaagggcatagctttgggacatgctgtggtttgaatgtttattccctctgaatctgatgtggaaacctaatccccaatgtggcagtattgatatgtggggctcttaagaagtgactgggtcatgaaggctcatggattaatggaataatgggttcatggattaatggttatcatgggagtgagaccaatggctttgtaagaagaggaagagggacctaagttcgcaccctcaacccccttgccatgtcaggccctctactgcctggattctgcagagtcctcacagcaagaaggccctccccagatatagtccctcgaccttggacttctcagaccccgtaattgtaagatatacattcactttctgtatagatcacccaatttcagaaacagaaaatggatcaacacaggatgcatccatgctctacgtggacatcatcctctttcctccatttcattggccctgaagacatctgttctagatcctctgtctgttgcccttcatgaatttttggacactaaacttggcctttaagaaaatattaatgagctttttatttaaaaaaaaaaagatcactattcatgttgttgttactattacagtattaaggacgaactctgtgccaggcactctgctagaaactttgcagatgtagctccctttatttcttgcagcagtcctgcaaggcatcgttcttcctgttctcagatagggtgacagagcctcagtgagggcaagtagcttgtccatggttagtggcacaactgactctaaaatcttttaaccacatcaagttgccctagcatactagacgaaatgtgttaggactcagacatgtctgttttacatgatacttagatgggaccatgtgctgtggctgtgatttttttttcccccttagaggcatgttggatagggtgtcttgtaaattaatgccacttggcatggcaggccccacgagacttggctttcagtacaccctggcacctcctgcagtattgctggaaggagtctgattcaggccttatagatcatttatattacagagaaaggcatgtgagagtctggaagcaaatataaagtgcgctgaactccttcagaaatgggctctgaaaggaatcttagtgactttaaagagcaaagctaggaggattggctgcgctcatggaaattttccttttacccctcactgtatctggctgttaaatgcctgtcttccagctggcattctctttcttatttatcgtgaagagttagattatgttaaattgaaaagtgacactgatgtattagaacccatcacgttagattgaggacagatacctgacttaaaatgtgccctttctgaagcatcaactctgaaagtatttggtgttcttcccatattatacagttatacgataaagtcacaagaatgggtttatacccatttgtattctacttcgagtcaagtagtaaaaatctgtgaaattgactgattttgctcagaataatatcagagagggcaataaatctaaactttggctctcataaaatgtgtttctgggaaggtaatgattcatgatcagatgcacacacagacatcatgagagtgctaagaaatagattcataatctttggctttaaaaatcgtagactgttttttgagctcaaccagcctgctctggagttcgacaattctgtgtagtctttctctttctttggctctcttgatttgcttacaggcataagttcagcctcctgtgatgtgttgaagaggaagaaataatgattaaagtgatagaaaacagttctgcaaaatgaaagggagaattgaatttgtgtaggttaataaaggcaagactaatgtaatgcggtctttaagtataagtgaaagctatgctaaagcatttatcctccgtgtccacggatggtcagaggaaatggaaggggcttaaatagaaatggagaggtttctttggctgtgaaaaagaatttcttaatcaggaaggtaaagggcatagcagtggatctcagaatgatactctgaagctgtttcgctgttgcttccctttgctggacgcagagctcctcaagggcagggcgacccctgcacattccctgcccagagcagtgctggtcccattcatcagtaatgcccctctcccccccagcctacaatccattccaggaccccacctgctggctccactttcagtacatagccaggcgcaaccacttcttaccatctccctcgtgaccaccttggctcaagccaacatctctgggcactgggttcctttggctgcccccaggtttgataacaaaaatggctttcattgtttttgatttgtttcttttgattattaaggctgagtatttttcaaatatgcagtattgattattaattttaaatgaatgtgttgtttgctgtacacatttttgcccattggcttttcagttttcttgttttttaaagagactaaagttatcaatgttatatagtcaagtatattacataaattttacatttagaaagtaagttcaaatgtagcaattagatatatacttaactaagttttattttagatacacataaatgtgatcatatattttctttttttttccttttctttttctttctttctttctttcttttttttctttagagacagggtcttgctctgtgtcctgggctctggagtgcagtggtgcagtcatagctcactgcagccttgacctcctggcctcaagtgatcctactgcctcagtctcacaagtacctgggactacagatgtgtgccattgtacctggctaatttttaaattttcgtagagatggggtctctaacccctagctccaagcattcctcctgcctcggcctcccaaagtgctgggattataggtgtgagctgccacacccgtcccatatataccttttaaaaaggttcatcttttcctgttttcccttttcgcttctttcaccttttctttttttctctttccctccacatatataaataagctaatgtatattttcttatttttctgtatagtcatttagccctatacagccatgtacatgtacaagaggggtgtgtatacacacacacacacacacacacacacacacacacacagtttttattgccgatgttttaaaaaattagatcatattttatatgctttactctatgttttcatacttaatacctaaaaaaaatcatggaaccccatttacatagatctaatttattcttttaaatatgtataatctcccatgctatgtatgtcataattgatgaagtttttccacaatttcttttcctttggaaaagccccctggaattttattttgctgtatggcatgagttaaggatctaaatttttttaaatggctagtgaatggttccttgatgttttcagaactgtttctctcctgttgatttctagctcttcctttattatatattaatgatttatatccactatggtctgtctttcagctcacttttctgtacagatgtcaactttttgttgttgcttttgagatcattcaaatcacttttttatgttgaaataacttgagacttataaaagagttgcaagagagttctggttttcccttcacacagatttctgtaatgttaacatcttacatgaccctagtccattcatcaaaactaagaaattttcattggtacagtaccatttactagagcctttttcccagttttttttcctgattatcttttcctgttctgggatcctttctgcactcccatgttgcatttagtcaccatgtctctgtagacttctccaatctgtgaccttgtcttccatgaccttggcactcttttttttttttttttttttttttgagacagattctgtctcttttgcccaggctggagtgcagtggcgcgatctcagctcactgcaagctctacctcctgggttcacaccattctcctgcctcagcctcccgagtagctgggactacaggcgcccgccaccacgcccagctaattttttgtgtttttagtagagacagggtttcaccgtgttagccatgatggtcttgatctcctgaccttgtgatccacccaccttggcctcccaaagtgctgggattacaggtgtgaaccactgcacccagccaaacttgacactcttgatgagtgctgacccgttgctttttaaaacgtccctcgatttggacttgtctgatggtttctcacgatcaagctgactcatcatctcagggcacttggcgtcaacatgacttgtcactggcagcgacagggtggtcactcggctaaggcggtgtcagccagtattgttccctttccacattctgttcttagaagcaagtctcttagcccggcccacatgcaaggggagagtagttaagccccctcctactagaaggagaagtgtcagtgactttgtggacacacattaaaactaccacaaaaaattaattaaattttgcgtagatacttggaggttatgcacatactctgcttttctttgaagttgtgcccactaattttagcgttcaccagtggatcttgcctgcagtaactgtttctgtggatttctaatggtcatttttctcttcccctcattcttctacatttattaatttgaattctcctgcaaggaaggtttgtctcttcgccttcaattatttattattcaatcattatttgtaattgtatggatttaatgtcattggataaccagtagaataagtccctcatgtttcttctcctctttaaaaaatcttgggcctttttattacttttttgtttcttcttataaacttcaaaatacttatttttcgttttcaggacattcagttggtatgtactttgaaattgtgttaaatcttccaactgaatctggaaagaaatagtatctttaggatccagtaattcttctatctcaaattgtggcatgttctttccattttcccagttactcatttaggccccttctaagttattcacttaggcttctcggtgttgaaggcatacgaatatgttagaccctgtttatcctggccaggtgcagtggctcacgtctgtaatcccagcactttgggaggccgaggcaggtggatcacgaggtcaggagatcgagaccatcctggctaacatggtgaaaccccgtctctactaaaaaatacaaaaaattagccaggcgtggtggcgggcacctgtagtcccagctactcgggaggctgaggcaggagaatggcgtgaacctgggaggcggggtttgcagtgagccaaaatcgcgccactgcactccagcctgggcgacagagtgagactccatctcaaaaaaaaaaaaaaaaaaatgacctcgtttatcctaaaattgccatactgggctcgtgacttctctctacccttgcctgagtttacttgctcctccaaatgctaaatttggaactaggtgcttttgatttgtatgtctaaatttgactaaattactgtaaagtgaatacttagttcatggggttttttaaaatttattctatgcttttctttctttgtctcctgggtgaagttttgggtccttgtctccatgagatggaaaaatattcctttcccagaactttgttactgtttagattactatgcaggttctgtgataaccttcaagtataggtgattttataaaacagatgtttttggtgagattgtagcagggttgtgggtttggctctcagtctccaacgtttctgttgggcaggatttgcatttcatatcctggcatactgtattaggaagcttccagcctgtgtgtctaatattatgggggaacacaaaacttccatttcctaatttttaatcccttgttctctcaattcttagccagctggcactggagtaatggcatgtaaggatcttagttcccattattcattggtgagcatttctaccctgactgatgtgtgctcagctacactaatcgccatcttttacttacttacttacttacttatttatttatttatttatttatttattgagacagagtctcactctgtcacccaggctggagtgcaatggcacaatcttggctcactgcaacttctgcctcctgggtttaagagattctcctgcctcagccttccaagtagcttggattacaggtgcccaccaccacacccggctaattttttgtatttttactagagacgggttaaccaggatggtcttgatctcctgacctcatgatccgcccgcctcagcttcccaaagtgctgggattacaggtgtgagctgcctcgctcggctgccgtcttttatttttttaaagtcaagtactgttttctctgccatcacataccaaatgattcagagtttttcgtctggatcactcctaaatatacacacacccaatccctgaatcagaagaccaaagtccttcataccttttgagatagcttattgacctgtagaaactgtggtgcattggaagcccgggtataccagcagcctggcccagtttttgtcttggcctagtggacttgtccttgttacagttcttggttctagttgaacaccctttaactttcttttttacacgtttttacaccctttgtccttcccaccctaacagaaatgtcctgaactcagacatttgcacaacaaattgaaatttttggcaaattcctttcattttcctagtatattccaaagcacagttaaactagccagactaacctgatggtttttgagcaagggaagacatagatgcggatgattaaataagacacatcactatttcatttatgagacattattgtgtaattagctatttcatataactgggtttttaaaatagctgaatgtaatatttcatcaatataacctttcccccattctttgtggttgggttaatgaaaacttttctaatatgtcttcacttctctttggagcatagtgcatataatttattctctttccaatgtcattgcaaggttataattaaaagcatgaattccctgtttcatgaccctagagtctactgaatgtttaatccttttttaaaaaattcactaactgacctcagctgtgcattctgagttcttacggctacatttatataatttacttatgaccattgtagattgtcattgtgctctctctctatcgtcctctctccttagccctaagggttgagcaaccagatcatcaggtttgacgaaaacaggaaggagggcctgggagggatggattgatgatgagtccttctcattgataaggaccctgagcaaggcctggtgagttctagatgctgtggctgctcccagcttgcatctctgtctctctggttccttctcctcttgcttccttggcctcctttggcccttggaacacgcccagcctgtcccattgcagggcctttgcacttggagctctcttctgggttttctcacctccgtcttcatgtggttctccctgttttgtgattcgattctcaaactccaacatttgtgtctccctgaaaactccagtgagaactctctgctgaccagctggaggatgaaacagcttgttagttttagtttagactttctgctttcatggattgagtaggggtattcctttttcttttcttcagcagagctgttctcttttactttttaactttttactgtgaaactgtacttaattatacattcacagaaggttgcaaaaactattcagagaagttccatgtacccttcacccaatgtttatattttataccactgtagtgcaatatcaaaaccaggagattgacactagtacaatgtgtgtttgtagttctttgtcattttactacatgtgcagatgtgtgtaactaccactacatccacaatacagtgctgggctggtctcacgcctgtaatcccagcactttgggaggccgaggcaggaggatcacttgagcctggaagttcaagaccggcctgggcaacataccaagaccttatttctaaaaaaataaaaataaataaataaaaattagccaggcatggtggcacgcacctgtagtcccagctactcagcaggctgaggtgggaggatcacttgaaccagggaggtcaaggctgcagtgagccatgatcatgccgttgcactccaacctggggagcagaatgagaccctatatcaaaaaaaaaaaaagtgctacagagctgttctgtcaccacagacatccatcccccttgtgctgccctgtaattgtcataccttccctggcagcttcccaacctggcagccgctaatctgttttccatctgtacagttttctcatcttgagaatgttatgtaagtggaccctacattaggtgaccttttgggattggcttttccccccacttaacctaatactcttgagacccatccaagttgcatgtatcaatggcttgtttctttttattgtgatgccggattctgtgcaacagaggtagcagtttaactcttcaccaattgaggaacatttgttgttgtttttgtttttgtttcatcccaaggttttggttgttacaaataaagctgctatgaacatttctattcaggtttttgcgtagatgtaaattttcatttctctgagatgaacgttcaggattataatcggtgggtcgaatgtaagtatatgtttggctttttagaaactaccaaagtattttccactgtggctatactatttttcattctctcagcaacatatgagagctccagtttctctgcattactgtttttttacattagccattttaataggtgtggaagggtaggtcatcatggttttaatttgcatttccctaatggctagtgatgctcaacactttttatgtgcttatttgccgtttacatattctctttggtcaaatgcttcttgttgtactctgcccattttcttttcttttcttttctttctttctttctttcttttttttttttggaaacaaagtcttactctatcacctaggctggagtgcagtggtgtgatcttggctcactgcaacctccacctctgaaattcaagcaattctcccacctcagcctcctgagtagctggaactacaagggcatgccactgtgcctgattaatttttgtatttttagtagagaaggggtttcaccatgtggaccaggctggtctcaaactcctgacctcaagtgactcacccacctcagcctcctaaagtgctgagattacaggcttgagccactgcgcctgttacactttccccattttctaattggatttttttaattgttgacttttaagagttctttatatattctagatatgtatgctttatcaaatttgtgttttgcagatattttcttccagtttgcaactggtattttcctctttttttttttttttttttttgagacagagtctggcctgttgcccaggctggagtgcagtggtggctggaatgcagtggcatgatctcagctcactgcaagctccgcctcccatgttcacgccattctcctgcctcagcctcctgagtagctgggactacaggcacccgccaccacgcctggttaattttttgtatttttagtagagacggggtttcaccatgttagccaggatggtctcgatctcctgacctcgtgatccacctgccttggcctcccaaagtgctgggattacaggcatgagccaccctgcccagcaatattttcctcttaatagagtctttcacagaacaaaacattttaatgttgatgaagtccaattgactgaattttttaactcatgaattatgcttttgctgtcatatctaagaactctgcaatttctctgatatcttctcctaaaaattttacagttttacaaatatatttatgatgttttatgggtttatttttgtattcagttatatgagggtttggctgaggtcagttttcttttttcttaagaatctccagttgctttggtaccattgttaaaaagacttcccttccttcacagattggtttttgccctttgtaaaaaatcttttggccctactgttacgggtctctttctgagttctttattttgccccattggcctatttgtcttttcctttgccaataccacactggatatagctgtatatctggtagacttattcctcccactttttgcttctttttcaaaattgtttttgctattctaattcttctgcctttacatattatttttagaatattttctctataggaaaatcttgctgagattttgaaggaatcacattaaacacgtaggcctgttcggacaaaaccagtatctttactttgttgtgttttccaatccatgaactctttatcactctccatttgtgtagaactttgatttctttctttagtatttttgtagttttcagcatacaagttctgtacgtatttgctaggttctcacctatttctgttgagtgattgtcagtggcgttatattttaattttggctttcacgtgttcattgctattatagagaaatacaattgggggtggaaggattggtgagatattggtcgaaggacacaaaattttagttagaaggaataagttcaggagatctattaaacggcatggtgactatagttaacaacagagtgcatacttgaaagttactaagagagtagattttaaatgttcttaccacaaaaagaaaaaaaatacatgaggtaatgtatggttaattagtttgatttcaccatttcacaaggtactcatatatcatgttggacaccataagtacatacaatttttattcgtccattaaaaagaaatttgtgctatattttatgctactaaaaaatacagttgttttttgtatgtgtatcttgtattctgaaacccttgctgaacttatttattacttcagtgagtgttgttgttactgttgctttgtagattccttggtatttcctgtgtagaccacgtcatctgcaaatagaggcagttcactttttcctttctgacttgaatgcctttgtattgatgctcaaattgcccctttcttgggtagcgggagcctcttcaggttgattcttgagttcttgtgacatgacgtagtctttgctttcttgctatatggtataagatgttctgggttcctcttgtactttttctgccctgacctataattaaccatttctctaaaatgtactggttcttttttgtggcaaatggtattttgagaccatagcagttcccccagtggagactgtagactgtagacttatagagccttgatagtctcttatatattagtaaattccccagtaagtgctcaataattgtttgtcagaagagtaagtgaattagtgaacaaatgtatgaaacacatctagtgctagtctttgcttggtggccaaaccaaaacaagaaaaacatcatccagtgtatccaaaaaagaaatattgtcaaggcaattcagatcattagtgatctgtcaaagaatgaccaaattaatggagaaccaaaacacttctctttaaaccctttttctccttccaagtcacctccttgtagctggcctggctcctttgccccctcttcttcctttacagagctattctagttttcgtgcttctctcctcagtgtgaattttcaaggtgttcctcctcctatagatctctgttgctaccacaaactgcatgataatgccctgaggtcaaagacaaggaaagactgcaaatgcttggcttgtagccctcccaccatcttcaaagtcagcagcgtaaactttctcctctgccagtgactcttctgacttctctctcactgctgggactttgtctcacatggactcacccaaataatccaagacaatcttcccatctttagatccttaacctcaccatatctgcaaagtccctttcccatgtgaggtaacgtatctctaggatgtggatgtccacattaggatgtggatgtccacattaggatgtggatgtccacattaggatgtggatgtccacattaggatgtggatgtccacattaggacgtggatgtccttgggggcccttattcggcccaccacgagaaggctcatgtgacccaacagacggctaaagagttgggccccagagctctgtgatgctcacccttccctgccttctccacccagcagagaccgttacctttatagaccctagcgaagaattttctgtggcctttggtcctttgcagaacttcacacctgttcatttgaatcattttgcaccagttacatactgcttgtggcaaacctaaaacgcctgtggagaaatgtgacgaggactaagaacaaatacatcacaacctatgaaaccacgttgcagttctctgaggagatgaatggagcaattacgttttatgttattgtgttgtgtttgtcatggaaatgaactgcacaatcattaactggcaggtggtggagacgggaaaagtagctgctgcccctttttctatttttatccagttttttcccgtttttatttttgtgtggggttgtctgggaactaagagtgatattacctaaatttgcttcctgcctgtatcttacgtgtgtattgttgtggttaataatgttttcaatttactcagactttctcaaaacggccctttttgagttatcgatagctgtatttcacccaggcaaatctgaagttgtcatcttattttctcattttagatatatcctaatgttaaataaaaaggaatttataaagccttacctgggaaagtccaaagttcttaccttttgagaaaaaaaaatctaccccatccccaaaggaaactgctttcattagtcttcatggacggaacccagggctcatagctctgcctcttattagcgggactgacagctgcctagtggagaaggtaacctccagaacagtcccaaagaaggccaagaaggcctgcctaggagggttctatcaggataggaaggggaagtgcttaacgctgacacacataactcgggtggtgtgggggctccctcttgagacccagcatgctgtggtatagtcgcgctcccggtagatggtaatgccaggggctgcctcaagcccaaagattcagaaaatctacccctgcatttcgtcaccagttttgtgatcccctctaccataggccaggcctttcttagccagtgggggtatctgattggagacctatagaaagggggagacagagacagacaaagacacacgaagacaggcacacagagagaaacagagagagtgggccaaggtgcagaactgttaacctcacaacaaaggtttgcacagattcctctccctggcatgttgtctcactgggtctggggccagggagatgacagagacaaccattaaaggacttgatgagagaatacatttgggatgggcacaggctgggaggctgggttagagtcttgattgttcatgttctttggcaaaattatttgacctctggtagcctctgcttcctttctgtaacatggagataataacagcagctaagcatttctgagttttaagtgtatgccaactgtatgtaccaatcaccttttaatatctcgtttaattctcctgccaacactaagggatggatacaattattatccccatctgacctgcgcattggtgctgtcagtcaagcatctggcccgttgtcaaagcgtcaccagctaggaagtgtcagagaagggactcccatgcagtcatctctggatccaaaccttgatgttaacccctggttgctgcaagggaatttgaatccctgtgggatgaccgtgagggctaggtgagatgcatgcagagcacacagcagttgccaggcccgtggaacgtgccctcctcatcatgacggcgaggagggcagagcagaagctttgtagagaagaagagttgacggggagcatggtgccccttctgagaagtgacaaacaactccaggtggtggttgagtgaggagcagatggagggtcggtccctagggaggtatgtccaaagccagcaggttcactccctctgaaatcctacacagaaaaatctcagaatgctgaaaggatgccagtgtctgtctcccaactgtggctaatggttcagtgggatttgcttactggcaacttctgaataattcccagcacaggtgtaaataatgcaaggcctcaatcccagcccgacctgcaccgtgaggcagaagagacatgtgtgtcacagttaaccaagggtgcagtaagccctcctgaaagctcagtttaggggaccaggattttaaagagctcccagccttgttgataaatcagtttccacctgatggctgtttgatacatcagtttctacctgatggctgtttgaccatttccctgtacttgttttccagaacagtgtccatcgtcacagagagtgatggcactggcgggctgtctgataaagcaaagaacccaacagatgttgtttacacacaaatgccatacctatcgtagtagcgttcagaaagaaaaaaaaatcattaaaaattggattttcatattgatttattttcatcttcattgttgatggtgtttgtgcgtgagcatgatctatccctgtagttaggggagcctgtgttttgagtcgtgcactgaggatccagcatcaccaagggttattaggctgttcttgcattgttataagagaatacccaagacggggtaatttataaagaaaaagggttgaattggctcgtagatctgcaggctgtacaggaagcatggtggcatctgcacctggggaggcctcaggaagcttctaatcatggcagaaggcaaagggggaggaggcgcgctacatggcgagagcaggagcaagagggaacgagagaagggggaggtgccacacacttttaaacagccagatctcacaagaagtcactatcgtgaggacagcaccaagaggatggtgctaaatattcatgagaaatccaccctcaagactctgatccagtcacctcccaccaggccccacctcccatactaggaattacagttcaacatgagatttggatggaacacagatccagaccgtatccctgagatcagctgtgctcgaggtgctgtgagtctgccttagccatcgcaggtgctcccgtctctgctgggcacagctttgtcactcggcaatcgaaaagagtcttaacacgagagtggaaccctttggtcaaaattatgctccttcaaagaggaacaaatgtggtgacagactggaaaggtgatggaaagcatttcaaaaagcagttcactctgctcataattttctagtattcctctgctattatttgcttttaaagaagagccctctgcttcctagcggctgctgcgtatgcttggtccagccacgaagacataatcctctgcgggcagcatcacgtggagcgagggtcaagtcctctgcctggtgcgcctttatctgcacaagggaagaaggaatcctgagtgcctcgttccgcagaaagtgagacacagaaagcatttgacttgtcaggaatcgagaattaccagccccaggcttccccaactcagctcacgaagtaagaatggctgggccaacgcttctctgcagaggctgcaggtgcggacaccgacagccatgcacagtcctcccaggaatattcttgtatctgctgtgtcttgcttagccatggccatatttatttaatttttgatggaattatttattgtgttttattctcttgctatataaactgagctgatttcagaattgactgctgtttgcagagtatcctggggagaggaggattcttcatgaggagcccccccatatctggagcagttttagttggtcctcatctactttttagacgcctttctgtcctcacttttcatggtttccaatttgactggattttacactcttgggaagttccactgtttaaggatctaaagactgaaaacatgtattccgcacattttgtttaaatcatgtttcttttttttttcctggaatttttattttagcagaaaaagtcttggctggaaatgtttctgcctaaacctgggctctgtaaaaactcctccttcatgccgttcctctgcatatgaccacaccaggaatttggcatagccatttatttgtacctagtgctgaaacaattagttaaaataacaaaaggcccctggataagtacaaattgactgaagtgcttttgaagattagcaaggaaatttaagaaacattgctataaataaaaaatatatttattctgggcaaaaatccctgatgaaataaatccttcactagttacatcaacagttaccctataatctcttcatttcttttctgtccctcctactagacagcatctttcctaaaggaaaagaatcaattctatttatgacacataaacacatgtggagaaaaggccagggattttccagcactaaagtcttgtaaagtggattttaacgttcgtggcatctgggtggaagtatccgaagacaagttgtttctaggcctctttgctaaattattacatgtacgctcttgagcagatgggctttgttttaggtaatagaggcttctggtcattttatgactctaatgtgataattcagtgaccgagctgtgtttttacagaagcctattaactaaaactctaggaagtatttgatatttagcccctagaagaggacagtagatgacatttactgttttcttacttgccagtcacattctacacctgatgaaccagattcagacttagcgtacatggaatttgtagcttctgagccagcctcattcacctcactaccgatttgcacttcatcagtgtccttttgatgtcagaattgttatccccattttacagatgagaaagccaagtgatgagcctgtgggagtaaaatcggggccagatccagttccacttctcttgccccacccaggtcacagttgcctgatcgcgttaagggcctctctatattaagacagaatatcatggtgtcattgatggtgttacttcctgtcaactgtgatcatcttgttctggtagaaaagtgaggtgtcttctctgcagaccacattagattttaactttaagtcaggttcgacactacttctggttccaggaaactcagggagcttggttgggagaagatgcaagagctctgagctcacatcttctttgggctttaattcagagaccgacaatatgcacccaggcagatgtccctctgtgcctcttttctgaccacccaccaaagcccctctctgctgctgctgttggccatggtgctgggagtagtcagggagccccaggccagccccgcagttcaggagggagttggatgtgctgcctggccgtgcagaagcccccggccagagctccggtggaaggcacgtgggtagatggtcagcagggatggcatttcctcccacgccacctgcagaagcagccattctgttcctgagttattaataccttgtaggctagagaactgggtctgtcttgctaatgtgatatcccatcagatttttacactttcaaaagctatcactagggaaacagatgtggttggacctgcgtgctttgtggtgactttgctgcctgtgtggcgtatctacttttcctctaaaactctgtaaaatgaacagactggcttcacacacttcatactgccatcatttatctttttatgcctttgcagctcttgccagtaagatatccccttgtgttcaacaaccatattttccagtatgtcttccctggacagtgttaacacacacagtaggcactgcaaagatatttagaaaatggttaaattactcctgtatttgcttgggttccaggtgcctgaatgtgcaagctcagaaaggaatagtcagagtaaaaatgcaaatacaaatacttagagattcccttctttttcttcattaatttaacacacatttatcgactacacactgtttggctctgtgattaaatactggaggatccttgtgtgcagggaaaacaaaggtgtatctgaacgtatttcaaatccaaaggattttaaaggagttaccattttagaaattccaccctgcaacttaccaccgcttgggtctatatttaagagttgagagacagtcaatatagaagagttggatagaaggtgaattcacataaattcaatggaatttttccatatacttgccattatgagattaacaatgactctcctagaaaaggatgcccgcgtagactaacttgaaatgtttttcaaggcatgggccattatggtaactaaactggtggaggcttgactggtcttttcctgcctctagtttcttccctctctggtcatcttttggtctttctcctactgcagaagtataacttaccctttcctgaagaatcacagttctgaagtttaatggctttctcctctgagcaagcctgcctgcctgaatgcagttgtgctgagctgcaatcccatttgcccaggacttcttggtctgtgctagggattcatgcattccattaatgaacacaactcagctagtggtttctgttggtttgaaatcacgagaaacaggtttcccaaattctttcttcttttgcttttaagatgtttttcttacacccagagcaaatggtcagcagcaagtgtttgctcttgatggaataaacatatcactctggcgacttaacatgtactgagcattcagggactcattagtgccaaaactacttgaaagcaattttatttttatttatttatttatttatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgttctcattgttcatttcccacctatgagtgagaataggcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcagtaaacatacatgtgcatgtgtctttacagcagcatgctttatagtcatttgggtatatacccagtaatgggatggctgggtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttgctgttttggacataaagtccttgcccatgcctatgtcctgaatggtaatgcctaggttatcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccgttgatctgtatctctgttttggtaccggtaccatgctgttttggttactgtagccttgtagtatagtttgaagtcaggtagtgtgatgcctccagctttgttcttttggcttaggattgacttggtgatgcgggctcttttttggttccacatgaactttaaagtagttttttccaattctgtgaagaaagtcattggtagcttgattgggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctctctgtttgtatgttgttggtgtgtaagaatgcttgtgatttttgtacatcgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttctatgctggattacatttattgatttgcgtatattgaaccagccttgcatcccagggatgaagcccacttgatcatggtggataggctttttgatgtgctgctggattcagtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccaaggatacccaggaattgaactcagctgtgcaccaagcggacctaatagacatctacagaactctccaccccaaatcaacagaatatacatttttttcagcaccacaccacacctattccaaaattgaccacatagttggaagtaaagctctcctcagcaaatgtaaaacaacagaaattataacaaactatctctcagaccacagtgcaatcaaactagaactcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagagggcaagaactaactaaaatcagagcagaactgaaggaaagagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctataagaaatggatacattccttgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaattgaaagcaattttagttcttgtcgttgtacagctaaggaaagttcatcagtttctaagttgtctgccttgaacttgcttaaattgtgaggcatgagatccagattatactcagaacactaagccttggaatcaacccttttaaaagttgcttaattaaaatggagaatattttgaagtggtttttttttttaagattttacaaactaatattctgcatcttcctgcacgctgaccttctgttaatgtacttgaaggtcaattgaaactagtcaaatgttactttaaagttcgtagtggtaaaactatagactcaaattatgcttctatgtttaatgggcaaagttattattttactaaacattttactgaattttcatcataatgtataaattgatgtggatattaccaccctagtttgtggtaagtgttaaagagcaaaatacttattgataaccaaagacaatttatattttcatggaagccaacggatgggttacagtgcaagttttgggagctcatcatgaaaatgttcacatcatgaaaatatttctggacacctcctggaactcttccccttgggtccatagatactcttaagggaaagttgttaaagtgccccctgttacttcttacagcttgtaagtacacccaatcgaagctctatgggacatgaacagtgtgtcctggttcaggttagtgtctcctccactctgagcagggagtgggatttccaatagttgctgattaaatagtgaaacagttacttgattctgctccagtggtgatcagggtgaatgtatactcttactcttccttcctggtcttcaggcacctatgcagtgcccagtgggctgttttcaccaaccataaatcctgtgcttccaggattccgacgtcagtatcacatccctgaaggcagctgatctggtgtggtctggggaaggccacaacccctggccatgcaaacatagcagggagcttcccagtcgatgcctagcaaggtggccctccctcccccatgcccaaggggtgggtctagccatcatctcaatgcaggtggtcagagacccagctagctactctcttcctcggatttcatcttttctgaaatagagaactatgattttgcctagcacctcaggagagtgttggagaatcaagtgaagaatggccagaagcacttagcgagtgctcactggaaatggtcttcctttactgaactgcacagatactttgctcatcagtctcagcaatgaaaagcaacagattgatttctctcttgtgaaaacccttcctgtgcttataattcgtacctcaggaccggttagcttgttctttatgatgtagcagtgtcttctcccgagcggcagctcatctcatccatattgtactcagttatttttgttcctcttctctttactactatcccatggaattgggagttaaaatgatgaggtttcatttttaaatgtacaaagatgggggaagactaaggaagtaattttatttaaagccacacatacatttgtttcaataaagttaaaggaaaatctctcaggccaaatattgtaatttttctatgaagtcagtgtaagttttaaatgtgtcatctggagctatgttataataaggccaggtaattcatattatgggcaaagtattcaactttgctaccataattactcagcatgcccctgtgttcttttcattaccttctgatagcaaaagtgatatttattgtggaaaaactggaaaatattttaaaaggtagaatcaaaaggaaatggcctgtaattgtaccactcagactaaccactgttaaccttttatgtgtacacacatatgtagaaacagatacataggacttatttgcagtgcatagaacccttaaatccaaaaaagatgtcatcgcatgtgctgttgtgaatctgtattggagtgttttgatttctagtgacagcagccctaacttatcacggttcaacaggaagtatctgagctcatgaaccaggaagtccccagacaggacaggctgctggatggttggttcattggctctatgagataatgaaggacccaagtgctttccgttctctctattctgctgccacaattatcagcttcatgtgaaggtcatttctatcatggccataaaatcaccaccatgaacacgttggacaaaatgatcaagacccacacctgatgctgggaatggggccagctctcttgtgttgcatggctggattgcagggggaaggcatggttgccacgacaaaatcagggccgctaagaaagaagacaggatgggcacacgatacttgctttagtgtctttaaatatggttttcttcttaaggtttacagcagttaccagaatttaaaattaagatgaatggttttggatgttttattttcatttaaaaagtcagtctcttgtagaaatgctctgttcagaaagatttggataggaacaaagacttggtttctgggaaattaatcttcatgatctccaaagatgtagcattttcatggtgtctttttggcagcagcagttttttttttttcatgaattttggcttaaacctttatagaaattaaaaactaaaagaaaaagataagcttaaagataaaagttataatagatggaaactttaatatttttatctttatgtacctttttattttcaatactcttgaaataatgccgtaaataatatcgagaattcatggatattttataaggatacttctgagaaacaataggcatatttgaaattactatggtaaaaatcagatgtcaaagaaaaagttatatattcagtttttaaattgtactattaaatgtgtaacttcatgtgtagtaaatattcatatttaattttagctgccagtgtaacatatactaaaataaaatggaacaatttctatggttctataaaagaatctataaaggagtcataaataattataataaaactctattgaaatatttttatgagactaaaaattgaaaacttcctaatagggaaattttcataaatgagacatgaagtaagtcatagagacctcaaacagtaatatatcctatgggaaccctgaataagcaataacttcttaagataattttatataatgtgtaaaaatcaagagtttttgaaaaagctctgcaaaaggtagcaggaagaaaaaggattattataatgctaaaattcctcatgagagattactcattttgcatgcttttgatgttaccagaatacagattttagataatctgaatctgaaagtgctgtaactattccctatagagtaccacaattgtggtgggtaacacaactcactctagagacctaagatgtttctcttgtttttgaaataagagcttagactaaatgatattttggtgctcagaatgcatcttaccttctatgccaaattcaccagccaatgaatagtttactcacattcatattttttttctttcttttttgagacagagtcttgctctgtcaccaggctggggtgtggcggcgtgatctcagctcacttcagcctccgcctcccaggttcaagcgattgttctgcctcggcctctgtagtagctgggactacaggcgtgtgccaccacgccgaactaatttttgtattttcagtagagatgaggtttcaccatgttggccaggatggtctcgatctcttgacgtcacaatctgtccacctcgccctcccaaagtgctgggatcacagatgtgagccactgcgctcagcccatacttttttaaacaaattttaccaccctcatccacctctttaactggcaaaaagaatacggaattataagtgaaggatcccataaaacacccatttcaaataaaagttccttggatgaatggaagttgtgtctttcttgtttttattcttttttaaaaattaagtagtataatgagagtctttctatggtatgattggatgagtattaatctgcctgtgaaaacaccttctcccttctctgctgttaagttgctgtgttacctaagacaagcaacttaacttctgtgagcctcagtggcgcagagaaagggcaggtgcattaaacgagtctcagagatgcctttcccagtagaatcaggatgaatgagaaggtcttggtcacgatcaagaagactgtttactcatcctttgcacttctaagacatggtgagatagtacaggtgaaaaagacgtggcctggagttaataatgatggtagaagttaagttgaaggggggcagcactgtgcccattggcgactttccttctacgcaccagtgtagatatccatacacaaagcctctgatgaggctccctcgaggtggagaaaaccacaactaattcacttgcgctgggtcagggttgtggtggtccagccttctaattgaagggattccttctaactggtcttgttatgcattctcagaggaggaacctctgagttttaatgaactctggatgtctatgttccagaacattgtcttcttcacagtcaggtgctggcgcagatgtggagcacccggtaggctcagacactggggctgcagtgtgccagctggatcagaagaggctctctctggcgttgtcgtattcttaaagtcggcctgtgtattgtttttgtccttccagctcttcttttaaactctaggcattcctttatagttggcctaattaattttgtcttacaagtaggaagttccctggagtagctttgacactgtcctcttcttttctgaaacagagccatcacattggagaatcagctggtgatcctcgccaccacaaccagtgatgccggggcatactacgtgcaggccgtgaatgagaaaaatggagaaaacaagacaagcccattcattcatttgagcatagcaagtgagttttgaaatcccaaatggtaattctgcaagcaataaaatcttgctttaatcagtaaccactgtctgacaggacattttgcaataaattttctctctctagtgtagtagttacggtttaatattgatccagtgccaatagttcggagagctttagggctcttgctttcttcaaaatgatatgcggaaaaatgtgaatctcagtggtacttctgaatgccagatcttttttgggaattaaaaaaaaaagtatttgctttttatacacagtcaatgcatgttgttcctaacaacaaagaactttcaatttaaatgaattgtatccatgaacctaaatcaggactagattagatatacattatattcttttaatctaacaggaaaatctttgagaaattctacctattaagttgtacgaaaattagcagtatttaagcataatcagttgatcattttttccacctaatttaactgaaagcctgattcttgaagacaatgcacacaaatcatgggtatttgtcgattttatttgaggggactttagtttgagtaaacttagttttacatgtttggactttaaattctactagcaagagttaattgctaaagaagggaaaatcacccaaagcaggaactctgaactaatctagattcagacatccatatcagaaggcttgtcatcagatgtttgcagcatgaagcttcatggtatgaaatgaaattgtcatgcggttgagaaaatagggttgaaactagtcatggcggatggtaaatttcaaaatattattatcatatcatatgagtgaattatattgatttgtttgtatagtagtggattttatctttttaaaaattgtcttgaaggaatcgtttcccctgcaagtgatttgaaaagtatgtggggctaggcatggtagctcacacctgtgatcccagcaatttgggaggccaaggcaggcatattacttgaggtcaagagttcgagaccagcctggtcaacatggtgaaaccctgtctctacaaaaaatgcaaaattagcaggcatggtggtatgcacctgtaattccagctacaggggaggctgaggcaggagagtcacttgaaactaggaggtggaggttgcagtgagctgagatcatgccattacactccagcctgggcagaaagaatgaaattccatctcaaaaagaaaaaaaaaaaaaagaaaagtatgtgggatggagtgatagtatttgcctgacatggccctcgaggggtacaattgccttaggcccagtagaattgcctgggtgaatctttgtagcaaactctgggtgcaggcgtctgtgggagttaactgagtggggtctcagatgcctgcctaattggtcccaagtggccgtgatgtgctgtcatcctgccttgagctccttaatttgaggaattgaatctcgctctgcagaacgtagacttggcacagatttaggatgagtggggtctttgtgatgccatggagaatgatgcacgtggattaggggtggggttcacaaaacccagtgcatgctgtactgtgacgtaaaggagtgtctgcattgagaattacagtagaaatgaggatgatttattaagattttttccaagggttatgataaagaatggaaattgtattatcaaatagattgttattattttaatgattccaaactttacaggtagagccatttatcttgtttagcaaatatgaatctgtactcaattgtaatataactaccaggataataatgagtcaaagggggtgaaattctgcatcagaaacaaggaagttggccttcctctgttagaagaattattccactgaaactgtttaacatcacaaagttataaaacagtccgtacctagtacttgcctacctccctactctgtaagggccagcagaaaataaagcgagtacagtgaatttgcaaaccgctgtactagcgtaataccatggtgttagataattggaatatgtaaatttttttcagtaatttcagtttctaccctgaccgaaaagtatattgaaagctactcataaatattataattaactgggttgcattttgttcctttgtatgtattttttaacttttcattggcaccaggtaaaaatgtgtaaaaagtgagatacaaggcagttgatgatatggacttattttaaatcttaggacaaaacctacattttgttcctttatgaattctttgctttttatgagtgccagataaaatgggagaagtaaggagattgaggaaactgccttattttaattcttaggagaaccttcctggtgacatacgggatttacgtaaatgttaaatggcaaccaattatgcttttttgtttttttgtgttttttttttttgtttttttttctgctaaaagttttattttgaaaacctctaaaagtcagaagtcttgattaatctgcagaatcccccagaattgttttaattgtgcttctttctggcatccagtgagggctctaagcaatgaacactgcagttcaggacctggccaccctgctcctggtgagggtgtgatgtattgaaggatgcgtctcttcaccagatttattatgaaattagatattctcaagacctattgatactgggagtaagatagagtgtgttctgcagacttagatatctttttcttctgatgtaggcttttgtggaaacaccacacaagattgaggaaaatttgtaaaaactttctggccagcgtttctgaaaaatcaaaagatattacagccaattatcatttaatgaagatacatttttgcttgctgtcgggagaataaagcagggaacctttatgtagtgaacaccatcgggatgatcgggtactggtaattaaattcctggtggattgtgctgtaattagtttaaaatcggagtgtcatgcagccccgcctcttgtttgctgttgtggtaataatccgttccttccttgaggacagcaccgtgttagagtggagcggcaaccaggtctagccctgtctcaaaacatctaaataagtgatgcgctgtcacccagctaacaggaggaaataatacattttcatcaacaaccttgtacttgagagttcaaaaacgtcaccccttttcaattgctagatactgtggctacacctgaagcttatgggaagcaaaagatagataggttttagatttaaatttttttttaaagaaagcatgactgttagaactgagatgcagtcccataatggtaccgcctgctgtttagtgcatatttagtagatggcattattatctctcaacatttctcccctcttgcgtggttaagaagataaattccagcatgttctgaaccgatattcctgtagggaaggagaggatttccctgaactctccaccccgctgccctggtgagagcttgctgccatcccaggggtggatccactttgaagttttaatgtgatgtgaagccagcagatgttaaggacataggtgggactgttgaagcatcctgcatgaatttttcatggccagctcccactgctcaggtgcacaccagaaaaagaagggtttgggcctgcctgagagtagatgtgtcttccgaggtcagacccgggaaagctttatgaacctgtcaacctatttttggcttttgctttgaagattttacgttgagttaacctttgtggaacagaacttctgaactgaattactatgtgaataagagtttcttcctctaaaaaaaaaaaaaaaaaaaaaagccacaggcgatgagacgaattctatacagtggttaatcagtcattgtttatacgccattgtacatgccttagacataccatcagttctgatccaatattcaaaatgtccaatgtaatgagattctctactagggatgaagcttggattaaaaagaaatgactgcctctctccttcctgtttttttcacctctttcattttaatgtctcctcttcaaacaacatttgcagataggatatcatttcagctgatcctccttcaggctgacaaacccttgcttttaattctgaagaccacttaacattcttttgtcctctataatgctaatttaactgcagactcacgtagggttagtagttgaaagtggattcctgagaatgtccatgaacagtcatttcagaggactgccctgtaaaacatggcttttgtgtgcccaggtacaactctctcctattttccttgtaccgttaacattaaagggagagaggggaacaggcagatgccttccagatggcctctgacttggctcgggttcctaaaacaataggaactgtttgaaatattactaaaaaccaatctggggcctagccccacatcacaaatgagcaatttagaaccaagcatagttttatagattgtatgacactttactgccagaatttttcagaaacataaataggaagtctattttatagtcaagtcatgagtttaatcatttagccatgcatcgaacctgctgtacggagtgaagtgtgaggcatgctctgccctggcctcctgagctggtgttggacagaactaagtctaggccatggtccctaatgcttttccgtaaacacaccatcaggaaacaagccttgagcatttactccttatgcatgaacacctagttacttatcaattctaagcattaaccatcagacagaagagaggacgggaatcagcagtgctaatcatgaaggttccgttccgtctttacttgacgtctcatggcgcaatatgcactttgtgaatggaaatccatattttacttgattttcttgatacaatctagttttttggaaaaattcttatgacatctggttacagataattgtttcttcttggcgacgtggcttctactaacgacacaagtgttcctgctgccgtttgttgccatctgattgtgctggtgttgtgagtgactcagatctgtgctttcttcccagaaatgccgtcgtcttcagttgtccactttgtgagagttagtttagataaaacgaaatacacaaatacataaatccacctctccgggcaaaggtgaaactgcatcccatgcctatgagggcatcctgtccacttctctgacaatgagaattttcagacccttccttgggatagcttgcgtacagagtgtcacctggggccacctgaccaacagactcaacctgcataataaataacattgaaacttagtttccttcttgggctttcggtgagaaaacataagttaaaatactaggtctaatatttcgtttctgcgccccaaatggatggattggggaatgagttttagaagaggagtgtagctggtggctcccagcaagacttcactcaccacaacaaagaccatcattctctcctcaccccacaaggcaaaaccggatggtttctattgcccactcatgcctccttcaccatatccccatctctttccatcccaaggtgtccccttttcccctgtgtgatttatttcaacctgatttcactgttgttaaatcttaggaaatctaatctgtcttaaatcttaggttaagctatgatcatttgccctcaaagtttgaacacatatgggggaagctcaatatgcccggtttcccaaagcagcagtcactggtctgagtatcactcaggatacatatagatttccaaggcgtaggcaggcatgtaaaatttccaaagaacctattttcagtcctttcatattcacattctaaaactggatctgaggatgcctgaggtcaaattttgcaactgctcctttctttccgaacgagatggaaggctcgtgtcttactcatcctgaatctttaacatgggcaattatctgagggtgtaaatgcccaggtgccaaccaaagggagaattctaaatatcaggggcagaattgagaaagtgaaagactctgataactgagagataaatgattttataaatcaggtgttttcaatcttttgctgtctacaaaacgaggtgggacctacgtgtgttgtcagctgacacttcattacaaataacttgataattactaactgtaacacagtccacttgttctcaggacggaagagatttctagcccctttgcaggtgcagggccatgtcagtggaataaagtgtcactttcaggccatgtgtttaagagccaatgtgttaccttcatgctctccctcccctttggggacaaccatggccaggccacatattgagccacaagatggaagctgtctggatatttgaatcagtacaggggaagaatagcctgggagggccacccaagcagaattggactcgttatgagtaagaaacaaaccttggtatgataagcagtgagatttcagcatttatttgttattagaacaaagcacgtctgtcctaactaatacattactatatgacaacagggcgcattgcctcacgcctgtaatcccagcactttgggaggccaaggtgggcggatcacctgaggtcaggagtttgagaccagcctaactaatatggaaactccatctctattaaaaatacaaaaattataactgggtgtgctggtgggctcctgtaatcccagctactcaggaggctgaggcaggaaaatgaattgaacctgggaagtgaaggctgcagtgagccgagatcactccactgcactccaaccaaggcgacggagcaagactctcaaaaaaacaaaaataataataataaataaataaattactatatgacttttggcatataacttagaaggaatttaaaaaattgagagatattctataacaaaatttcttccattttcatctgttgctttatatgaacgaaattttatctatgaaaaagaaaagattagaattaaactttattcctcatgtcattgagagatgcatttctagttttttaaaatataaaacctattcatcaaaatttgtaatactttaaaaaattaattgaatgtcaataataattgtaacaataactcaatccaagagaaggtttgttttggtttggtttgcccccgagtcatatggttaaaaacatttttttaagaattttttgttcttttttttttttttttgtttttttgacacaaggactctgtcacatggactggagtgcagtagtgagatcatggctcactgcagcctctaacttctgggctcaagcagtcttgctgcctcagccttttgagtagctgggactacaggcatgaaccaccatacctggctaattttttaatttctttttttttgtagagacagtctggctatgttacccaggctggtctcaaacttctggcctcaaataatcctcccaccttggcctcccaaaccactgggattacaggtgtgagctactgaaccccaccaagattgaagtttatacgcatagttttttcagaggctgtgatatgattaatacaattctttgaatcatgtgttttttaaatgggtgatgctgtgtatcaaatgtttagacgtgcttatcaaatatttagattcctttgaatacatatagatgcgctgcggtagttttattaaaatatactgaaatagtaaaacattaaactataccagaaattatgttctttttagtccttcaaatttatgatgaaaaaatggtagatgtcagcttaaaatgtaagaaagatacacagttttacaaaattgttttaggtgatctaggaacaacaactgtttgaagctatatgcagatgtgattataaatcacacatgagagtactgttgatgaccctctaagggcatacagagaggagaaggccctaacatgtcttgagacctgacagatatcgtcacgtatattttccttcttagattccacgacagccctgtgagttaacaatcaactctgtttcaaagctgaggacactgaggctctaagaggttaaattattgacccagatcacaagaatagtcaatgggaagtttgaggattcaagccaaagtttatttgtccccctcccaaaaccctcgtttctccaatgaaagcagaacaacatataccatggaggctgggtgtgctcttgaggtcaaaacgtgtccaagagagaagcccaaggagaaggcaaaacttgggaggaggccatccagcaggaaggctctctgcgaagagctctgtgtgtgcagacctcagaggagcttggttttgttttaaaaaaggaagtcttctgttctgatatcaaaaccactcccgatcaacattcattccagagaacagcagtgtgctgtggctcagcagctttgaggctggcacccttttgcaaccccagtgaggcacgtttgggcggacagcaaacacaggtttggctcaagggtgcagtgggagatgcactggagtcagtgcttactaatggagcatcagaacaataagtcacaatttctgataacaaagtggttgttttgttatcagtaatgcattagacagcacataggacataaagtaagacatgatctgtcccagtggatttatatgactgatgtgcgtgattacactccctaattcccagatattgacatcgaactgttgtggcagattttgcacagtgagtaaacttcacccagggagtaaggcaagcacttggagaattaattcaccaagcagaactgaccagttgggttcagcagacggacgatgagtattcatttacgtctcccaattatgctgcgattattgaaagatacaaattattcagtagtgatttgcctaatcggattttttacaaactcctccacatagctcattgttagtaattcctccaatctaccttcccttctgtccccttgttaaatgtctcaatttaaattattatattcagatatttaagcataagagttctttaattttagcagtttgggggctagaacttaaagtaaccctaattttgttttgttttgttttgtttttggagacagggtcttgctctgtcacccaggctggagtgcagtggcacattcatggctcaccacagtctcaacctcctgggctcaagcgatcctcccaccccagcctcctgattagctgggactgcaggtgtacaccaccacacttggctaatttttaaaaaatttttgtggagacaggatctgcccattgttgcccacgctggtcttgaactcgggctcaaacagtcgtcctgtctcggcctcccaaagtgctgggattacaagagtgagccactgcacctggcctaacaatttttacctttgattttggaacctaatttcttagacttagccagcagcgaatgcctgatttcagtttatagggaattgaagataatttcattgtggaatcatattatgtaaacataacatttcagagtatgtaatatattgagagtgacccaagattataacttatgcattttctttctagctcttatcactctagatgtatagtcattgaagtactttgtctactctccttgtctctgtaattgatatgaaagataaggaatttttggagggcacaaacaagggggatggaaaattgaatttttcctgcagtcattttacaatctctgacatacatccattacacagcttgtctggaaaaatcctaagcaaagtgatggttattggccgagatgagaccacatagaacaagttgctagttgtaaatgtacttttcttagaaaaactgtatttactcagtagttgaatacagcgatgattctggtgaatttcctggggttcagcttttagttactttctagactaaatggttctactcgtaccttcccagtatgatttttccttttacgaatgagttcagtattctgaagctgctaattaagaaacacctgtttaatttcccttccttcagaattcttaaggttttcaaaatccagattgtgtgagttgctaggctaaattgtcttttcatatctcctctttcagaaaaatgaaaatatattattttctgattcaaagggagcacctagagtggtaccaacctcttcaatcataacatggtatttttgctgagtgtaggcctgatatcctatggtttaacttcagtttccaattttaaggacagaaagatgtgatttggttcaaagcataatgaaggcttattgtagtaatagtaacaacagctgttcattggatgtctgctgtatgccctgtatgtaaatatcgtatctcattaaaaaaaaaattaatcacccgggcatgttgactcatgcccagtgctttgggaggctgaggcaggagcattgctcgagcccaggagttcaagaccagtctgggcaacacagggagactctgtctttaacaacaaaaacaaaaaaaacgtgccaggtgtggtagtgcatacctgtggccccagctgctcagaagggtgaggtaggaggatcacttgagccagggaggtcaaggctgcagtgagctgagatcacaccactgtactccagcctgggcaacacagcaagaccctgtctcttaaaataataatataataatcataataaccaccatttaatcatcgtttttaataaacaagaggccataaggtcagtattatcccctttttgcagatgaggtaacaaatcaaagcaacaagttactttcactaatcttatgcagttgattacgtgggttagttttgaacccaggtttgtcttttccccaaagagactttcaccattttacttattgagatgatttatatcgcagaactgtttttgatttttaaaatcatgttgtaatttcttaatctggctgctgctgtagtgaatgcagcctaacgattggtcaccttttggtagcagttcaactccacctttaccacttagtcataatgttttattactgttcattgtaaacgatgttcttttggctcttgtagaaggcaattacagcaggtaattaaaattgtagttctttacaatgtgtttgagaatattaaatcaagcccacagaaaatcaggtaaagtatctgttaaagtgaaaggccacttaacaatgctgaagaccattagcaaatccagagtgctatattccctgcttttccaagaacacttcgtatctgagatgtaaagaaatggaatttatatcagaaataataggaaccagaaatttatctggagatgtagattctttctgtgtgttctaattagtgagttcttcgcaatagtctctctctctgattctttgttatttcaggtaattattctgcctgcacccctttaccttttatgatcttgaagaataccctgtttagcacaaaattagttccttccaatctagtatacctctatgtttggctgagagggtcttaggaaagtataagaaagcctgtgacctctgcttgtcagtgtaaactgttattttgcccaggaataactagcaagtgtagctttttgagacggataccaaagatattattttatgtagttttagagcatcataaaaatgtgagctgggaattccctagctcacctcagtattaggcctgcatgaccatctgggaagtgtgaaggctataacggttttgtggtttttctagggaggaagatacaaatgtcaaaactggaagtgcggaactctagagaagctcttaaaagaatgaaggcttttccattttagttcctaagtcgaacttaaagagtaggagtcagagctgacataagtcagtaatggcgagcatccggctggccccgtgcggtagtttgctgtttcactgatgatgtattttgttgaggtgtgtcccatctgacattaacggccatgtctggtattaaatgcccttctctttctccaacaggatgtcactctgtggttctattaattcagacagggttgaatttcacaaaggcttgctttcatttgggaaagttttcagcacaagtgtactccagaattcaaacttcttcctttctaatccttaaaacattgggatgtaaagaaatggaatttatatcagatttatatatatcagagacttatatcctcattagtcagaatgatgtaggaatagaaaccatatgcataggttgccctttggtgattggttcatttccgaaagcttaaggagtttcatacttcgttagcctactcaagaaaacttcacttgtcttgaactgagaaaatgccacatgcaaaaatggtaccatcatatttgaaaatgtatgaagcgaataggcagtattctgagtcttttgtttctttgttcattttacttacagtgtttgtaaaaaccatgacagcatgttcttgatgaaaatctaggaagcagttctacttgaaccctagcctggcattagatgacctggatcctattcacctcttcagtttgcacttgaaggatggatattaagccatgttgcccccactggcctccattttgattggctagtgaccctgccatgttactacagattttgaatatcatctcaacctggaaggatactgagggatgcatataagagtaaacttattatagagggaaacagctggcatactggcatcagcctacaccattttcaatgtctatgtagaagaaccaagggaagggttgaagtatgattttctttggcttttagagtctctgtctcacttctgtccctaagtgtatgattctccccaactccctgccctttaaacactcagactacagttctgctattccgctcagaaaacgctgagcgtctgatacttatcaggcattacgcttgatgccgaggacacttggtgaatatgacatgtggttcctgccttccctgagctcacttttgccaggagaggctggcgcaccaggaaatgacaggaacacagtgtgttaaatgccacacgaaagggagttgtgtagaagaagcttccgaagcacaggcaagggaacgatgaattctgcttccgatgctggaacagctttgttagcagaactctgaaaatcttttctttcacgtatggagggatgcaccagcagtgagatgattaggaaaagggggttggggtagaacagcactgtctatgaccgggaactgccataaccaccgtcctttcatttgctcccttgttataaatatcagtgccccccaggaagactctgcatttaatacaaccccattccaagagaatccttattgataattgtttttcatcacccactagaacgtaagttccgcgaggatagggatttttgcttatttccgcaagccacgggaagagtgcatgacgagtaataagggctcagtaaatacttgtccagtgagtgcatggaagcctgtgaagtgaggcctttttaccctccctttcctggtcccctctccgtccctggcatctgaggatgctgctcaccggcttgttcttcctgtagctccttttcttttggtgtttattgctccttttggctctcctcgtcccaagatgtgaggattctccagcctttagtcctttggtgcaatgttttcctttgtttttctgcctctcctttttctccttggagatcgcactcaagactcttgagacttcacatatcacagttgatcaaatgttatctctaggcctgaatagcagcctgggcattcaatctttggtaagtataaagtaggacaagtgacttgaaggtcactctgactctaaaattctgatatcttctgatgtttgagcttctttgtctgacttagtaaggtgcccgaagatagaaggcgtgtccacatgcatttcctcaattatcgactcatgtttcttctgttttatgactgcatttgacctgctggttgcgggcgtccctctttgtctcagtcttactcatcaaattaatcatgctgcttctggatacagtggctaaaccttgccctgttgaacctaatatcagggacagtgtgccgtgagatgggctttactacgttgctggacactttcacttggaaattaaattaacctgcctccgtatactttctatcccaaagctattttttctcctaagttccctaggaagtcctctcaccccccttctatgttttcagctcttacctatcctatcctgaactcttagcataagtccctgcttctggaagaatattcatctctctgtccatctgtgcattcagaaatgcattcattaattcattgactcaagatgtatttactgagtgttcactaagcattataggcattgaggatatcatgattgaagcagactggtttctactctcagagcttttgttggtggaatcaaaagacaaacaagcaatttcaatatggattgggatgttctaagtcagggaatagtaattttcccacacatcctgagtttctgccacttacattttcaaacctttgcctgttttaaagacaggattgataaagacacagtaaggtcaagacacacaagattgtaggctgaagaagtgcttccttggaaagacttcacaatagctcttatttatatgagtattggtataggcttatatagagaaaatatgggagatttctcagagatggactgtgttataaatagaacaaatcagtcaaattacagctttcaagccacaggcctcattagtctcatgagcagggccctttgtgggcaaactgaatgagccacgtggaataacactcgtgttcatgttttgcaagctcaacatgtcaaactgtagtgttaaaatgagttgctttacaaatgagctataaatattagttctgcatctccaagccattcaatatgcaattgtgaaaactgatatccttataacttatgtataagtcacatatataacttatacacatatacataacttcaatgtacgagtgagtaaaaagtacggcattagtcagtttgagttgctgtacaagatacccattcattaattcattgactcaagatgtatttactgagtgttcactaagcatcataggcattgaggatatcatgattgaggcagactggtttctactatcagagctttggttggtggaaacaaaagacaaacaagcactttcaatatggtttgggatgttctaagggaacatgtagaagcaacaggctaagattcagaaacatttctctccaaatgggaagttttctaacacaaacacccaacttaagaacaaagaggcaacctctcatccaaaaacatctgcccctcacattgctttcaatatgcaataccttaaaattccacaatgagtattttcccaaaacaaagaatagaccctccacaggaaaactcaagtctcttccttaggagactgggtgacttaaacaacagatgttcattttctcagttctgaaaactggaagtccaagatgaaaccagctttgccagccaggttggtgtctcgttggggcctcccttcctggctcttagagagccacctttccactgatcctcacgtggcctctctgggcattgggggtgcaggaagggaggcgagctttagagagctctggtgtctcttccgcttcttataaggacccctgtcctcttgtgttagagacaccgcatgatctcatttaacctgagtcacttccttaagggccctgtcttcaaatacagtcacaatacaggttagggctttaacatagtaatttttttacagctcagtccataacgacttacacatttcttattcctattgcattttctttcctaaagtacagtatttctctagatcagaagacccgactagacatttgtggcctggatttgctccttgtgttttatttagcccacacaataccttaaaaatacatgagccaatatttaacagctgggagaacattttccagcttctcttaaaatatgtggccatgctaggacccctttccccagtttaaacagtctgtgcattctcctaaggaagagacttgagttttcctgtggagggctctattctttgttttgggaaaatactcactgtggaatcttaagatattgcattttgaaagcaactctaggggcagatgtttttggatgagaggttgcctcttcgttcttgaggtaagttgggtgtttgtgttagaaaacttcccatttggagagaaatgtttctgaatcttggcctgttgcttctacattagctggctctggaagcatttgaggtatgacccatgatccaataggagttgctgtgatgatggaaatgttctctatttttacatggagctattgaatacttgaaatgttactgttgtgactgaggaagtgaatttataatttaatttaaacttttttattttggtaacctcatgtggctggatgctactgtattgagcaggacagttttataaaaatgcatagcattttgcatacaaaagggattcctagtcaaactggccacatgacccatcattgagctttattcgctcctggagtgatctaacagtggtaagagcttgtcctgaccaggaagacttggactcccaggtccccttgagagcccttgcacatatgagcaggatacctccctgtattttgtatactgaagatccatggttggggagccctgtgtgctgggagacactcccttagcaagtatagccgcttagtcatttgccaggctgttgcattgcatgcattcatggtctatagtagtctgtattaatgagaccccgaagagatggttggtacatagcctgcatggctgtacacagcaatccggattaattcatcagttatgcccggtgccaggcacggaagttagggaagtcaagggtgagatggtcatctagatgggtgactaaagcgaaagtacctgagccacggttgagagaagcacagtttgctctggaaaacccagcatggggcacccagacacatcagtgggaattggaaggtttcccctgagagacgatgtttaactgagacctaaaggttgagtaagaggcagtcagctgaggcattgggaagaggtcatcctggcaaaggggagcacaaggctggagtcagcaggtgcctctctgttcacagacttgcagctcacctgctactgtagatagaaacaaagccctgcttggcagagggtgcaaacagaactgtctatgaccagcctctggaagttcagggttccacataaacactgatggtccggtgttgccagcccccgtccctgaacacagcgatctgagggagctgatgggatgctgctctcaactggggcatcacctcatcctgctcaggtctcagcagttccaagctgtgtccctcactaggagaccatgcagtgggtgtcgatcaaaatgtttgcactcttgtctttcttatagtagagaaatcctttaatataaccaagtctctatcaaaaacagggaaatataagttagacaatgaaggaggagagtgtctctgactgccccatcaagttattgatgttacctatctgctcgggccctgaaggcattcgtttgggcagaggcacgtcctgtctgctccctacaaatagatggtgttcatctagagcagggatcttcacgtcaggcctcagtgactccaggggatattcagcagtggatggttctcagggaatccacatcctccatttccatgtgtactctttcctgggatggatccgcctgagaacacgcctggggtcttccctctcagctgtcctttcacgcttgcttttctccctccttgcaagggaaaggcattcctcccagcaaaccctcctcttccttgttgcattgctctggcctgtagaaccctttgctttccagacagaggagaatttcaaacattagggtcggtattgagaaagtggatggctttaataagtgggtaagaaatccccttgcgagccagagagcttagaattcttggttttcaagagaattgaaggtgaacccaatcaagttgtcagccaatagatcattaaaaataatgtttgatgataaatcactgagtgacgatgggcataacagaatgctgtcgaggaattgggtgaaattgttaaaactgttaaaactccttccttcccatctgtttatttatgaaaataagttttctccatgcatacatttataaaaacaaaaaaatagaaataaaattgatgctgaacactttttcaatttacctagaagtaatatccatccatgaatatatgaactaattaaaaaaagaacattcccatttatctcattgagatgtatttccagtaaattttacttttcttattcaataattatttgtcacaatgtataatgatgtgtgatggtttgattaattgtgaatagcaattatgatggataatcaaaccagtttttttaacatttagttttagagtcacaggaaattttaaaaattattgtaatatctgtctttttgctataaagaagtgtagtacagtgataaagctttcaagcttaatatatattacatcaaataaaactctgaattgaaggagaagaaggaatgatgtaaaatttgcagttgttaaaaaggagatttttaaatggtcattggtaggtatcaaatcaaagtggtctctgggtccctccgtatgatagaaaagagtgacctaaaattttacagtacactagaaattaaaacacttaaatgtaaacttaaaatatgtgagagggacatcgtttttcaaaatttttatggagtacctgggcaaaaatatctgaaggccatgttcagtgaaagtggtaataagaggcatatgcgtaattttaaaccaaaagttgaaacagagtgggaggagcggaagaggagggggagaagagaacatgttgggccaatatatttaacaataatcatcaagaaataggaaaagacaaaacaaaaatcttttaaatatctaacactgttttttctaatgctacatgcccatgaaaatcacctgggctgggtcaggactttgttttagtcctcaggtgattttaatacacagccagggttgtgaattatcggactaaactcacagagtggtccttgggctagtactatcagcatcatcctgggaacttgttagaaatgcagaatttggggctccatgtcagccctcctgaatcaaatcctgcatcttaacaagatatttaggtgattcatatgcacgttaaagttttaaaaaaccaagatttccaacaagctcccaggtgatgctgatactgcggttcacggacaactctggtcacggactacgctgggtagcagagttctcgagttgtgctactcagaaggtttatggcagagctactcgcagtatgatccgagaatcgcgagcctcgcctgacttggattcacattagacatgaaaagtcttaggacccatgccagacctagggatcgggacctctgggagtggggtccaggaatctgtgttttatcaagctctccctcactaaaatttgagaaggaccaccctagagagaatccacatcgacttcagatggctctgagcctccagttaatttagggagtggctggggatgtgttattaccaagaggccccacttcatgagagagctgctgcatgtgatgagctccctcatcacagcctcacttgtctccaatcccagggatgcccgttttgcagtgggtctcgaatgtgtgaccagttttacacaggagtgagctgacggtgccttgcctctttcctcgtaccacatgcatgtacagcccttgggcactgcacctacccatgtatcaggtgatccagaaggctgttagtgttgaggggggccgagacccagagagggctgtcaggtggatccaaggacaacttcgcagctgtttgcattgtttgatccagcagaacggatggtgctggaggcatcctttggataatgattctgtgtgagtcagtgcaagccccgttgcagagttgcagctcagggcccaggagttctggagcaaaaccatttgcttggcagcacagaactgcgtattatttgagaaggactaacatcttgcgctaatgagtttctgggccccagtagacactgagctccaggtggctagaaccagaactgcccaccttaggtcaagtattatcagattatttttttctctttttctttttttttttgagacggagttttgctctgtcacccaggctagagtgcagtggcgcaatctcggctcactgcaaccttcgcctcctgggttcaagcgattcttctcagcctcccaagtagctgggattataggtgcccgccaccatgcctggctaatttttgtattcttaatagagatggggtttcactatgttggtcaggctggtctcgaactcctgacctcaggtgatccacctacctcagcctcccaaagtgctggaattgcaagagtgagccactgcaccaggtgttatcagattctccaagtcataaggatggccagatgcaagaccgacccattgggtggtggaaataaagaagcaaattacatgacaggtggcctcagactactctgatgtcacccacctctttagtactgacacctctcctccacctccatggctgtagcctcaggggtaagggatccttttaaccagctggcaggaaactaaaaacttgggactaactcacagatgggtcagaatgacatgttggtggcagctaaaaatgtagttgttcaatactgtccttcccagggctggcctgaatcaccaggggtaatggaagtcccttcagtgggcagagatgtgagcagtacttgcaccaccatccccactggcccagttgtggagttatccttcctctccccagaccttaagctctgctgtgttagagtcctgcatcccgggagatgatgcctccactggagaatacccaagggtgccctggaccaacagtcaaagaagtcaccgtactggcctgggtactgggtcactgtgctggtatgggtagtggatcactgtattggcatgggtactgggtcactgtgctggcgtgggtactgggtcactgtactggcatgggtactaggtcgctgtactggcatggtgaattggtgccagtgaccacgaggtgcctgggttgctgctatacagtggagcagaagaaatctgtctggaacccaggtgactcgccaggtgtcccatggtgctcccacactggtatactgtcagtggacagttgtgacgaacaatcgtgagtccactaaacactttaagaagggtctggggtaccatgacaccagcaccctagaccagctaaaatgctggctaagagtgggagggttgtgctccttttctccctcacttcttcttcacgggaattccgcttcctgataatgctgaacccaggctagggcagagctatctgaatctgtagagcaaagagaagacagtgtctccacagagtcaagacatttactatgacatctgtggctccagcgttcaccacaatggtctctttaggaaaggattcccagaagaacatgtatcggccaaggagaagacggtggctcaacgcacattctcatttggcgaaagtgcattgaacaactgcctaacgcccgtcagtccgtctggacttaggaaaacccatgtgtaatgaagagcctgtggccgcttagcattagaggaatgtcagcggctcagggcagcacagctctttctcggggccctgatttatggaaccctgggctttgctgaactcacaggcatggacaccaatcttaagctgtagcatgaagcctcgtggtaactcaaaagggaaaacaagaaccactttcctcaactgtttgtaaacttatattagcttcagaattctgcataacgtagactcacatggctttgtctatgtgagtgggatttgaagccaagttgaatctcctggcttcggattctctattttgtaactgcagatgggatatgatttattaactttgtcgctagctatttgaaaaaggagctcttactatggagaagaaattgttacattcctatcacccgcaaaataggacttgactctttcttcctcaaattaactaaagtcaacctgttttcaattggtgatattccttcattagttttaattcatttttcagcacacctgattttttaattcattatgcttttgatggaaattaattagtttcttttagatctaaaacaatattattgtgggcactcagacattgttacacaaaagggccttattatgaagctggtctcagaatgaaagcctgggtctgtttcataggaaactcgcctgacgatgaagccatcgggacgctgaggctttttggctgcctggttctgagcctcagttttcccatctgtgaaatgaggagcttgagccagatgaactctaaacttttgtttgatgagcacaacaaaatgaaataaaatcttataaaatagatatatgaagatgtatatgaaggtttatggtaatattatgttgatcaaacattttcttagcccaatagagaatgaaaattaatatcctactacaactttgcagaaatcctatttatttatttattagacagagtctcaccgtgttgcccaggctggagtacagtggtgtgatctctactcactgcaacctccacctcccgggttcaagtgattctcctgcctcagcttctcaagtagctgggattacaggtgctcaccaccatgcccagctgatttttgtatttttagttgaggtggaatttcaccacgttggccagactggtcttgagctcctgacctcaggtgatctgcccacctcagcctcccaaaatgctgggattacaggccatgagccaccgcccctggcccagtttaataattttagaccgtattgccaattatttaaaggagaagggtgagtttgtatttctttaattaggtttaggtaacggcctagggaaaacgggaattgcttacacagacaggtgaggaggagagtactccatcagacccaccctaaattgaattaagactcaggacccttgatgtgctcagctggatgggccttggatgtgctagcctggctcccagggaactgtcgagctgggcacccacagtgttgctcatctgccccagatggacaactgcctgtaatttaatgtcttttccaacagggagctatgaaactgaattttactacaccaaagaaaaacccgcttccctaactataatttcaacaaggaagagtttacacagaaaaatcccatttaaaaagtgccacttaatgtaatacagacagcagctctccagcccgagtgccacacagagaacctcactgtttgcccaaggccttggagacagaagtcagacctgtgagcctctcgtgctgctgattcagcctgattaaacaagagccctaatttttatcaaatgtgcagtttggtattcacaatcctttatgagtagaacctcctgaattaatcaaacgactggttaccaaataaaatttttttcaagaaaagagcttatgacatcatactttattagctaggatgtatgtttcatcagaacatctgtcatcacacaagagacagagaatggactacctgaaaaatctacgcttaactacctggagcagagaggcaaagtgggtcagctgcccaaaggtgcagcttcggagagcggaggtcgcgagagccaggttggcggggagggatgctgggtggtgaggctgggccacttcagcctggagggtgagggcagagccaaaatcttaattgtaggttgttaaccaaacccattgaaagagaggccaggtgcggtggctcacaccttcccagcactttgagaagcccaggtgggtggatcacaaggtcaggagttcaagactagcctgaccagcatggggaaaccctgtctctactaaaaatacaaaacttagctgggcgtggtggtgcatgcctgtaatcccagctacttaggaggcagaggcaggagaatcgcttgaacccgggtggcagaggttgcagtgagccgagatcgcgccactgcactccagcctggtgacagagtgagactccgtctcaaaaaaaaaaaaaaaaaaaaaaaaggccctagagaaaagagcaagatgtggagtggccaggcctgaaatttgggtacgttaggcaggccagcgagactggaaaccaggtaacaaaagtgccctaaaagccactcttggctcagggtctcttcagcagtgggctccctttagcattcagagagaattctctccacgtgcttctccttttttttttttttaaacaaatgcagcctagtcaattaaaaagaaattccatttgcagtgtttatttaacactgaacaggttgcttgctgtatgaaaccaaaataataaaagtaaaataaaatttgagtgaataaattactggtacatttagaaagcggatgaattggcagcataaacagattgaaactgtggtttctagaataaattcagtagaaatgaaatttgatttgagctgctctgctacctacaactttgcagaaatcccatttaataattttagaccgtattcccaattatttgatgcagaagggtgagtttgtatttcttgataacacatatgtatttctgtttgaagtaaatgagagtaacttgcacataccagaaggaaagtgcgtcccaggaattttattaactatatgtttaggttgctgagaaatgacattctctcttaatttcatgaactgagtagtaaaagagctcactggggatgtgtgcccaacacatgcatgtacacacacacacaggcaaggaaaaatgtgctggcatatccttttgggtatgcagttaatatactgtttaaagggatctcaataaagatttcctataaattatgtttattgcatgaaaataagtagagtctaaggtgtgcattctaaatgtgcttggggaattccagcctttgattttaaaaggagaaggacatttgtttaaggaatttgattatctactgataggtcatttctgaaaagaatatggcacattcatcttggatcccagtggaggctttactgcggactgccttccccaaggccctgctccctgcacacctcactctcaacagcctcctggttctttgcgaaaaggaagccatccaccactctataaatcctctctaaacatatgtatgtggactcattcttatttacctccctcctgtcctaaagagtattactgcttccgttgaaggctaaaatttcccccacttctctgaactcatcttttccacaagcttggctctgttcttgcctttatctggaaccctgtgagcacactcagcacatttcctagacagccgtgtctttacccctggttcctatcaggagatccccttctcctcccgctacgaggggcagcagcagccctctcccctctccacgaccctctttagtctggctgctgcttgtcaggtccgcactggaactgcccccagcaggtgaaaggtgacctgtccatctccacctgtagaggtctatgttggtcctcatcaccttggccctactgcgcggctggctgtccccagtgccaccccagtgttctcaggttttctagtctctgacagctgccgcttagtgtaatcacgcttctttttttttttgctttcccattaagcattgttcttgtggagagctgcaatgcctccagctcttctctgttcatgcctctcacgtacacctgaaacctccaaaccctgcctttgcgatttcaacctttactcctggaactcacatgtgtgccctgctgtctagatgccccatggactcctcgatgtaccatcgacttcatcaagttcattatttcttgcccagaccagttcctctgtcactatcgacttggtcgccataaacctagaaatcctgggatggtcttaaattctttccttcttccattaaatggccagattttcctgattctatttctaaaaataattgtaatttatttagtatttaccgaggcctttaacaagctatgctgaggcagctgtctgacagaggagactccttatggccatggccacaagagtagtaagtgacagaaggaggattggaagcaagcgtgtgggattgcaaagccggccttcctcctcttgcctgcttctcacgctggtctttgttgacgctgtcatgctctcattatctctcactggattaatgctctcagatgtttttgctactgtttatcctaaaggaatttttgaaagccgtgtgtccccttgcacattttaaaaaggatattaaattcattttgtacctgcaaatagttgcaaggaatatttactgtaagtaatcacattttaaaacaaaaccatgacatcattcttctgaatggagcaactagaatatcccttagatgacaccattttctatttcaaaagtatgtggaaaacattttctttgacagttggaggtggtgctgatacactattgcactccgctgcacccctcccagaattagaccctaatataatgttcttttatgcttgaaaaacagttattaatcatactatcgtactttcctgcaacatacgtatcacatctacccatacacacatgtgcatatgtgcacaagcacatacacatacaaaccgtatttgaaatgtgcttatttccagtgaccataaacttaaaaaacaaattccatctcgagctgttatgatgatagttcttatgacacagttgatcaggattctataatatattacaaacttcataaataattattaaacctataaaatgttaattggaaacgcatctcttaacgagatggattcaggggcatttatgttttggggtcctgatgaaaggaattccagttgttcctttgttttggtacccagaaggatgttattttaaaaatcccttatcggaactctccaagcatcttcagcacttttcctgacagtcctgtcttccttacgtccttcagatgcaggatgacaggagccttctcttgttaaagtaggaggagggtgatcgtgaaagggaagttgagagggagtagctggagtcaggcaggcttcttgagcaggcagctttcagaaggaggacgcatggaaggtggatatctactaatagaagttgattcccttaaaactgcctgtgtttgaaaagttcatagagtacacacttagccccaggggaacagggaacatagaagaccaccacccaggccacgttctgcaatgactatagagttgtcttttcttttttttttttctgagacagtgtattgctcttgtcactcaggctggagtgcagtggcgcgatcacggctcactgcaacctccgcctcccgagttcaagcaattctcctgcctcagcttcccgagtagctgggattacaggcgtgcgtcaccatgcctagcaaatttttgtatttttagtagagacagggtttcgccatgttgaccaggctggtctcgaactcctgaccttatgatccgcccacctcggcctcccaaagtgccgggattacaggcgtgagccgccgcgcccggcctggagttttcttttctaaatatgccacttctcttcttccggacccccttgaggcccagcgcatcagatcttcacttcctggcctggtatttaagacttttcatacccgtcctttctctgtttagagtttccatttgccgtccgaactttccctttcaaaggtttccttttctctccaaatgaatgcacccctcctctgctggactgttcttgaacaaatcccctggcctggaatgcgcttgtactacatgtcttcaggatgctccagcatcatgtcttccccggagatgcacccactcctggctcattcactctttatcttcaccactcagcgttgctgctcctgccctgcctgctgaggtctgagctcctttcctggcaacactcccctttcgaccttgtatccttgagtagtgcaaagcccaggacacagagtttagaatggaatttgtatagtttctaatggcaagaaattagacttcctggacatttgtgggaacatggatttattagtctttaggaaggtaatttttaaggaaaatttgtttaaccacttcagtatatgttcaatggttgagagggtaatttttgacttcagagaatattacaaggaaataccatgaatttggaagatcctgtgagccttattctgactagtgaatttcaatttagagcaggccagagaattcattttgatggatgattcttagagggcggcgtattttgataatagattggaatgttgctgatagctggccattgcctgtgttacaacaagtagtcttttagttagcaggatcatttgtttattttcttgttactgtacctatctgtgtaacttaggtctttcttaaaaaagctgttccaaagctcacgtggagagtttgtgatagaagagttgacagacctttagttatgaaggcagtgcttggcctcacaataaaatattagcttggctggagagagaattcagaagtttggaagaataatatgtattttcataagtcgaaatgaccaatcattcacaagttgagaaaggacttaaggctcagtagagtttcttggagttatgtaacatcagtcaaaacttggaggatgtaggcttctatacttacaaggtattttcttccacattgctgtcctgtgacaaaagccaggtaggagaatgaagagcacctgccctgggaatggacccaccccccttcgagtctggccctgccactcatcaggcacatggctttggcaagctaagaagccttcttctctgcatccaatcctcatctgtcaaaggggacagcaatgctatgtatctcatgagaacatttaaagtactaagtaaatatatggaaagcatgtgtaacgttgcttggcatggagtaaggggtgacttattttactcttttctggaatgaaaataagatgccttttacactgttggtgggactgtaaactagttcagccattgtggaagacaatgcggcgatccctcaaggatctagaactagaaataccatttgacctagctatcccattactgggtatatacccaaatgattataaatcatgctgctataaagacacatgcacacgtatgtttattgcagcactattcacaatagcaaagacttggaaccaacccaaatgtccatcagtgatagactgcattaagaaaatgtggcacatatacaccatggaatactatgcggccataaaaaaggatgcgttcatgtcttttgtagggacatggatgaagctggaaaccatcattctcagcaaactatcgcaagaacaaaaaaaccaaacaccgcatgttctcactcataggtgggaattgaacaatgagaacacttggacacaggaaggggaacatcacacaccggggcctgttgtggggtagggggaggggggagggaaagaattaagagatatacctaatgtaaatgacgacttaataggtgcagaacaccaacatggcacatgtatacatatgtaacaaacctgcacgttgtgcaagtgtaccctagaacttaaagtataacaaaaaaaaaagaagacaccttttattatttctaagcatcctctgagttcttgaccaaacctgatggtgcaactaaataaaccccgtgcatgcatgattagtaattcaaaattataccctacgtgttggcattttcacttgttggagtgaaaattatcattttattaaaattcacttaaagcttgttgaaagcaggcagagatgctatctgccccaaataataagcttttagagacaatgtctttcttgaagacatgatatagtcttttttaattgaattatttggcgttattaacattttaatgaaggaattattctattttcatatttcttagaaactaatatttaatttcctttttatgttaataatataagtatttagcatatttaaaatctcagttaaaactaatttatacttatattttcataaagatagaagcgtaatatgcttctttgcattgcgtgtttatgttcttgctttgtccaagttttcccttttccttagctatattttgaaaataccagtctcaagggaataataattgagatcagtaatatcttggatgaaaaagcttgccaatcatgccggtgttatgaggatgtgtatttttaagaggagacttactaagtaagattcactggcattgggcggcttgatatatgtgatttatgggaacacctttcagtaattttacacagtccaccagaaaaccttcctcataggtagaaatgaggttgaacccagaagaaacggcctttggaaaagaattggacattgaagctaagcggctaaatagcttcagacatccctagaggaagaaaaataagatttaaagtgttattattaaagaatatgatctataaataaaatggtatattctcatacccctgacagattttgacaaataagagaaaaatgtgtgcttaataggaaaaatgtgtttgaagtatgttttacactatttaatgccgctggtgcactgagaggttgctggtggacttgatgttgagttaatcttggtgaacaaatagagaaggaaggattgcttggcgctggaggtctgctttgtgcagagcagctttgttgacagtcaaattagaggaccggcctcagtgccagttctcagcacctcgcggataatgagctttggacgagagtgtgggtctaggcttttttttttttttaacttgagattctttaaatcattttgaaattttgattttaaaaatagttctggctaatattccgtagaagtatagaaaactggccagccgagagcgacggatggcaccaggcctttgaagggtagcttgtgtgtttggaagatatgtgctgcattgctgtgggtaccgtgctgtcactagccatcaccactgccaacacatcagtttcacgagtcttgcaaaaaatgagatttaaaagtttatttaaatctcatttatttaaaagtttttttttggccgggcacggtggctcacacctgtaatcccagcactttgggaggccgaggcgggcggatcacgaggtcaggagattgagaccatcctggctaacacggtgaaaccccgtctctactaaaaaatacaaaaaaaaattagccgggcttggtggcgggcacctgtagtcccagctactcgggaggctgaggcaggagaatggcgggaacccgggaggcagaggttgcagtgagccgagatcgcgccactgcactccagcctgggagacagagcaagactccgtctcaaaaaaaaaaaaaaaaaaaaaaaaaatttttttccttgaaatttgcttttaaaaacatgccatttcaggaaagaaaaatatgtttctttattctttaaattcttaaattccatgtacttttgccataatagtcacccacccccagagtttttctgagagaatcatctcatatgggtgcagaatgttaccttatggtcaaactaattagctctgttttcctacctgaccgtgtggataagggagcatttgtcatttggatgatgctcagtgtatatagtcatccctccattccaggacccctgcatgaaccaaaacccacacgtgggaaaagttagttctccacgtacgcaggcttcacatcctgtgaatactgtattttcaatccacacttggttgaaaaaaaaaaatgtgcatagaaatggacccatattgtttaagggtcatctgtacattgactttccattgcaaagatggaaagtaacctattgctcagcctcgacttggacatggtttgtagtcctaagtggattctggagttcatttagtaaacaattttggagggcatctattaagtaccagctgctggcaatatagccataaacataactgtcctcaaggatgtcacaatccaatctggcctgtgttttaaaattattgtgtgtgtgtgtgtatgtgtttaatcaagtgattttaatattaaaaactctgttagaaaattttataattaaattttatatatatgcatttgtatgcattaaaataagagttgtatatcccttattcaaaattcttgggaccagaagtgtttccagtctcagatttttttggattttggaatatttgcagaatacataccagttgagcacccctaatctggaaatccaaaatcccaaatctgagatgccccagtgagctttcctttgagcatcacgttggtgctcaaaaagctttggattttggtctggcacagtggctcaggtctgtaatcccagcactctgggaggctgaggtgggcaattcacgaggtcaagacattgagaccatcctggccaacatggtgaaacctcctctctactaaaaatacaaaaattagctaggcttggtggcgcacccctgtagtcccagctactcgagaagctgaggcaggagaattgcttgaactcgagaggcaaatgttggagtgagccgagattgcaccactgcactccagcctgtcaacagagcaagactccgtctcaaaaaaaaaattttttttggatttcagagcattttttgatttttagattagggatgctcaacctgtatttttttaaaatgctttacacatttttaaatttgagagtatggaataggggttataacttctagagacaggatacttgagaaggatattatagatcttactttcttagaaaacttttaggagccaaaggttatgtacggtgtggtagaggaaccatagaggttttgaaatcatctgacttcagttcatatctcaactctgttccttcctagttttgtgactgagagaagactacctaagctctgcagaccttagatgccttatctgaaaatataaataattaatgtaacaatacataccttatagagtatgtgtgcagattaaatcagataatgtaactcctgcaacacagtagatgcttgctaaatgttaatgattgccccctgtctcatttccttacctgaaatctcaatactaattactggtgtttgttgttgagtgctaaaggtgatctgattagtatagggtcacagagcaaccatattccgtaatgccaacacgaagatctttcaatgagaatgaaatgcaatttttatatttttattcatgaaattttagagtcacataactacacttgaatgcctttgttcatgagaaaacatagaagtgacaatttagtatttctctgcaatatcttctgtaaacattgaaagaatatttgagggattttcgatcagatgtcagactgaagtaccttctgcagccactccttctcactccaaataatagaaacaacaaaaaagataggtacatagataacagaaaagatgggaagggatgtattatgaggaatcgctatagagaacagacaaagttggattgaaaagaaacctacaaaagatgggacgaacactagagttaggagacactgagagcagggtggacccaggtgcacatgcagggtggctcagtgaactctaactgcttcatctacagtgtcctccagaccctgtacgtcctaatccagccctgctgtggccacagatttgcctgcccacttgtgacagctatcagtatcaggacttaggcctaagagagaggtcacttttctagtgagctgggaggacagaagagcccttcactcccagaagatgatctagataagatcctcaagagcacatccaggtccttctctcactgcaggggatagacacagcagatattcttacctggaatctcaaatagaaagatgagcaccacaccaagaatcactagacagctggggaatgacaacaccatgaaagagagacacccactcaacaaaaaatacttatgcaaggaaatgctgaatagaacaagcagaagagaactacagaaaaggtacatttactattttaggagaggtgcaagaacatattgcatccattagaaatggatgaacctgtaaattaaacattgattgttgcaataaaaattaaacaggctgaagacaaaagtgaattcaacttgagaacaagcttagaaattctcctaggatgtatcaacagaagactaggagaaataatgtatgtaaaaaaaagttaatggacatagaagatagagccagcagtgccaatattcatcaaatgacaggagtttcataataagggaatgtgggggaggtaatgtacaaagaagccctaggcaattttccatagctgcagaaaggcaaagaggccattaggtgccaataaaagagaaacaaacaaaaaacttacaacacaatatactaaaagatcctggggtggatgtggaggctcttttagtcaaagttctgaggggaaaacttaagaatgtggaaatctgtgctgcctttcaagggtcaaaatgaagtgaagactataagactttttcagacattcacagtctctaaagcttcaattaatgaatggtgaaagaattaataaatgatgtactccagcagtaaaaaagctgcataaaaatgaataataaagaatttactgaaacttactgttaaatctaaatgtttattattgatagcattaatacagaactaacattccaagagttatcaaccagagattttggaagactggggagaagagagatgtggagtaagggaggaataaagaaaatgcatactaattttcttatcttgctcaagggaaggatatgcttattgattcagtctagatacaaggaaaaagtaagtttctgtaaatgttaaaaatttaagggtagctagtagaagaatagaaactgaattcatgacttccaaactactggagaaaaaaataatgtaaatctgatcaagaaaatatatgaaaagagggtttaaaaaatgaaacaacctagaattttggcaaaataagtgcataaaatatcaggtagttcaaatagattaataatctcagtaaatgtgactaattttgactaacaagactaacttcaacccaactctaaaggacagagcctttcaggtaatgttaaaaaaaaaaaaaaaaaaaaagcagctggccgggcatggtggctcacgcttgcaatcccagtactttgggaggccgaggcaggtggatcacctgagatcaggagttcaagaccagcctggccaacatggtgaaaccccatgtctcctaaaagtacaaaaattagccaggcatggtggcgggcacctgtaatcccagctagtcaggaggctgaggcaggagtgtcgcttgaacatgggaggcggagattgcagtgagccgagatcacaccactgcactctagcctgggcaacaagagcgaaactccacctcgaaaaacagctatgttatatgctacttataggatataaattttttaattgcatagtatgaaaacatgtcaaacattaaccatgttgattaggttgagcaacattaatataagaaaacttagaattcaaggtaaacagtgttaaaagggacaaagagggatatttcctgctgaaaaggaaggctctaccaagaaattacaaggcataatcagtataccataaccaagtagattgaatccccgaaaatgtaaggatggttcagaattacactatgaaaaaatcaactcctattaactgaaaaaaattactcttagtcacctgggtatagagggaaaacttatctaaatagaggaaatctaacaaaaatctactggaaacaacatactgataaattattagaagcattaagtttgaagtctgaatctggggaaagatgtctactattaacattgtactcaggacacagtcagtgcagcaggacaaaatggaaggggaaggaggaggagaaaggggaaaaagaaactgaaaagaaaaaggtatagatattagaaaaagagcaaactgtcattatttcaggcaatatgattacttgcgtagaaaacctaagacaggctgggtgtgacggctcacacctgtaatcccagcactttgggaggacatggcagggggattgtttgtgcccaggagttcaagaccagccttggcaacatggtgagaccccatttctacaaaaaataataaaagaaattaaccacgtgtggtggtgcatgcctgtagttccagcttcttgagaggttgaggtgggaggattgcttgaggccagaaggtcaaggctgcagtgatctatgatggcaccactgcactccagcctggccgacagagtaagaccctgtctcaaaaaaaaaaaatgaaagaaaacctaagataataaactgaatattaggattaatgagagttctgaagggtggctagatagaagatagatatggaaaaattctttttcctgttcatcaggaataagagaaatttaatagaaatacagtaaaataggaacataccattcactgtagcaagcaaagctattaaatatttttgaataaactgatcaagaaatagttaagaatctatagaactttaatgacgatttttaaaaggaacaaatagtgtgatataccatatacatggatggaaagactcaattatgtaaagttgtcacctctccccaaatctataaattcggtaaatcatgaaacttgtcaagatgattctgaagttaatatggaagccttaataatgaatggtttaaaccatagtatattcatgctatggaatacaatggattagttaaggataatgaggtaaatttgtacatatgagaatggctacacctccaagatacgtttttgtgtggtgaaaagagaaaattgctaaacagtacatataatatgatatcatttttttaaaaaaacacaaaagataagtcaggcaccgtggcacatgcctgtaatcccagctactcaggaggctaagagcgggaggattgctgagcccaggagttcaaaaccaccctgggccacatagtgagaccccatctcaaaaaaacaaaactgcaaaacaatactttatatattttattactacatgtatatacatctaagtgaattcaaaaaatacccaggaaaaaaaaatcacaagaagcttaacttcctttctggaaaggaaggatgaagactgaatgtagaaaaattttcaaaagggtatttgacccacctttccaagtcgtctatgtctgctttgtgtataagacccagggttttttgttgttgtgtagcagggggaatagggaatggtatatctgtaccatccttctaggaagcacaagtcccagtacaagctttaaaagtaagcaaaaaacgaaggaagaatttccctatcaggtgtcaaagtgtattgcaaacatcaactaataaatttgtgatactagaataagaatgagcaatagtgttgtttttggttatctagtataacagttgtcccaaaatttagttgtctaaaaccttgtatttttcttttttcttttttttttttttgagatagagtctcactctgtcacccaggctggagtgcagtggcgtgatctcggctcgctgcaagctccacccaccaggtccacggcattctcctgcctcagcctcccgagtagctgggaccacaggcgcccgccaccatgcccggctaattttttgtatttttagtagagacggggtttcactgtgttagccaggatggtctcgaactcctgacctcgtgatccgcccgcctcggcctcccaaagtgctgggattacaggcgtgagccaccaagcccggcccatatttttcttttgctcaagattttgtgggtcatgaattggaaaagggctcggcaggtgatggttgggggctcaactttgatccacctgcctagctgggaggctgggctggaggtctccttccaaggtagctcctcctggggggcctttgctcatggcttgaggctgtcattgcatgatggcatcagggtagttgcagttcttccatagtgaaatccacttatcaggcactttgaacttcagtaacagaaaacctcaactcacgctggttttggtttttttttcagtaaggtaattaaaagcaggctgtaggtgcccactgtggctcatgatgttgtaaagacctgagttttttctgtctttctgctctaccattctcagcattggcttcatcccaaaccaagatggcagctggcagcagtttggacatggtgcatcctgttacattatcaacagacaaagaaagtcaccccataaaaattccttctcttttgtcttataaggccaacttccattaccatccccaggggacagccagatgctcattggctgaaagtgattttcaggggttaagtcaacactgagttaccacactgcccaccacacctgtgtcactcacgtcacacttctccagatccattgcaaataggtgaaacatatacatgcaaaatacaaaactgtacatccttagaaaataatgacgtgtggggaagatcttttttaagaaacaaagttttaaagcaacaaaagaactgatagaaattttttttttttttgagacggagtcttactctgtcgcccaggctagagtgcagtggcatgatcttggctcactgcaagctccacctcccaggttcacgccattctcctgcctcagcctcccgagtagctgggactacaggtgcctgccaccactcctggctaagttttttgtatttttagtagggtcggggtttcaccaagttagccaggatggtctcactctcctgacctcgtgatccgcctgcctcagcctcccagagtgatagaaatattttattgcatcaaaatttaaaacctctatgtaacaaaggccctataacaaaattgagacaaaagacagactggaagaaaacatttgcaacatagtcaatctacaaagtctttttagaggtaatcactcgaaaaaagacaatgaaaaaaagatgggcaaaggatttgacaagaaggttgataggtgatgaatacatattgccagtaaatgcatgaaaagatggtcaagttgacttttcatctaggaaatccaaattaaggcaaactataaattttcactcaagttgtcaaacatttaagaagtttgataatatcaagtgttgagcagggtaaaaggataatggaattttcaaaatgcaattgatgtgtaaattaatacagccatttttgggagcaatttggtgatatctattgagaaaataacttttatttgagggatgtgagtccttttaaattatcaggcccagagagacattaaaatgacgtagcagtcatctcctcctctccccttggaggcctgtattcatctcttgaaactgctattttttgccacaagtagctataaattaacttgataatgccgcacctgacactgtaacccacaccctatagtttaacaatatgcagccaatcactaatcaatgtgattcctgtaaaccaatgagaattgctgaccaaaaaaacttgatcagcccactccctgtcccccactttttgcctttaaaaacctgcttgcaacaaaggccgaatgaagctcacatccaaggttaccggggtctcagtcttctgggcagctgtccccactttggctcaagtaaactgtctatattttgtgcctcagccacttccttttaggccgacacgattataatgatgaatgtccaagctctgtaacccttcagtctactgctgtgaaaaatagttgcacatgatcacagggagacacgcgtaagggtgtttgtcctcgtgtcaactggaaacagttgtaatgttcctgagaaggatgattaaagagcctattatgtagctaggatgcaatattatatgcaaaggtcagtgaagcgccgtgcaaaaagatcaggaaagacattgctgtcattttactctccactagttatttaagtcatctatgtatttgtttaagcaaaattcgcttgtagttccattcggtatctttaaagttgaagcatcttcttgcttgattgttttggtgcttgtaggagggtagtaatcactgtgcaggcatttttgggcttggggagtgcttgtgtgcttcaaactgaacagtttccactgaccccctgctgcttgggtgccaccaaaaataaatggaatgagtaatttgaacacaaatgggagaaagcacgactcatttccatactatggagaacttgaatgtcttcaccagaagggatgtctgttaacttggtgctcattcaaaaccttatttggggctaacacttctttataagctgtcttcatgagcctgaagtaattcaccaagattgatttgtaaaacattctgaatcaattaaggctttaatcagcaaagtagcaaacttcacatggcttgtggactaattttaccctctcccgtcaatgtgaacctaagttgaaaaaagaaaacaattaagaggatgtaattatctgtcctgattactgaattaaaagagtttgtgtttatctgtcccagtgtaaaggtggtaaacaatgccaggagctgtggcactccggagctcctacacaaaaacctgcagagcatcctagaagactctagtgaccctgccttaagtgacctggcagcaaacaaaggctgccgagtattattgtgtataaatgtttcccagagcacggtttgaaaaagctccttgccaatggtgggtgggggagtttcctgcagaaacatctcatttgaattactacatggacagatccatctacttacgcaatgcttaggaaattgctttcctttatttagaccagttctcagcagtggctgcatatttgaaccacatggcggagctttggaaagtcccagaaaacactcagaccaattacatcagaatgtctgggggaggaagcagggcgctagtaccttttcaagttccccaggtaatttctgtctgcagccaggattgacagatccctggttcagacagcatttccaggctggtgcagtctcggtctgtgttgttgtggcacagcgagcaaatcttgtgggaatagaatgatttttgacaatgtcttctttttggtaaagggtatgtgttaatgcataacataactaggataacttttgtaactttgtcagactttaatgtttatgcatcagaaagattcctttctcagataatgcttcctaattcctgagttggaaaaagtggttatctgaattatttgttaggcaaagcttgaatagtcagtgactttcacttagtctcttccttattttcacttcaaatgtcaggctttttaatacgtcaggctttttctgaaaaaaatttgagcttgagttactagtggtttatttgggacctctcttagttccatacttcagtgttccttagagcagccgtccccaacctttttggtaccagggagcagttttgtggaagacataaaacatttttcatggtgggtagggatggtttcagggtgttcaggcattagattctcataaggagcatgcaacccatatggatccctggcatgcacagttcacaatagggtttgtgctcctatgggaatccagtgccaccgctggctgatctgacaggagggggagctcaggcggtaatgctcactcaccagcagctcgcctcctgctgtgcatcccagttcctaagaggcctggaacccataccagtctgcggcctggagggtggggacccctgccttagaggatgagcagaggactgctggtgcaaaccctcagcctggttcctgtcctcctgagccattcacttctgttccaggctggattatctacttagcaagatgacccagactccttaaaggaacacagggaatgaatagtgttagccctgcttgcctcctgggttccttacctctcccaccaattgaattatcagagacctttccagtgagggaaattctgcctgaaacttttctccacttgtcagcatttccactgatgccttactgcccttttgagattggcaccccattgcctggctggcccattttattttaactgtggcaaaatatatatattgcataaatgttaccattttaactatgtttgcatgtacaacttcatgttattaagcacattcatattgttgcaccaccattaccaccatccatttccagaacttttccatcgtgccaaacagaaacgctgcactcattacaccataactcttcatcatcctccctcttcagcatcctcactctctctataacttttgttctactttctgtctctgaatgttcctactctgtgaaggtcatagaagcagaatgatacagtatgagtccttttatgactggcttctttcactcagtgcaatgtcttcagggttcatccatgttgtagcagttgtcagaattccttccctgttaaggctgaagaatattccatcgtacggatggaccccattggtttatccacttattccctgacgggcgcttgggttgtttctgccttttggctgttgtgaatctgctgctatgaacatgggtatacagatacttgttcgagtctgcttacagtttctttgggtatatacctgggagtggaattgctgggttgcatggtaagtcgatgtttagctttttggggacacatcatactgttttccacaatgatcacagtggtcacattcccatccacagtgcacacaggttccaattttttcatatccttgccagcacttaatttctgttttttgtttttgtttttgttttcataataaacattctacttagtacaaagaagtaggctggtctatttttcattcactgtgcctggaactggctcacttctaatatgtttacacatagaagaaaaattgtgtttatgtcaatttgggcagggatcaagtttacttctcttctccttacgtttcctattctgttctctttgtttttatagtcaatcatttttacatatcttttgctgtcattttaatggggctttgggagggaaagaaggtcgatatatgttgatagttgttgtgggcagagattcagtaaactgtcccttccctttcctgcctgacgtctccatctgttgaagaataagacaaaagggtaaagcagataggaagttaaaatattgtctttataactaatacacggatattagagatgtggctaatatctctgcaagaaagtaggtttccagacaacaaaaccagagctgaacttggccacccagtcttagacagccccaaggacgtgaggggcacagctgaccttggccgtccagtctcagacagccctggggatgtgaggggcagagttggtgtgcctcctgatctagcctgcttagtaacgggaaagaggaaggagccccagggaatacaccctgtttattgctcccaaattcaccaattagctcagtcacacttctttccccagtgagggaaagaatgagggagcagagaaagagggaatgacaatagtggatcactaataccagtagtgacgatagtgcattctctccacaaagaagaaaacagatgtgagtaagaagcattttcccccagcacaaatcctccatgtttaacagactgtcccatttgagcttgctctctgaccactggtctctcaggggtgctaactctgagcacatttcctatacgtttcttcagtctcctaccactcagacgtcttggctgtggcatgaggtccccgtgccctccagcacgttttactgacaggagtagaaaggaagggcatgtcatacccccatcttgggaagtgatgaacgtccacagagatgagattcataggaagccccatctgagccacagcagatggggcaggagggcccagggggctggaggttgtggaagcagggagtgtgggaggcctggtgatcctcctgaagaagtgagaatgggttggcctaaagggtgagttggtgggagaaaggagagaatgcagaagggcatttcatcccactccctttggagggatgtgggaatgtggagaggagtaagaccgacagactcaaaatgttttgacatgtgacacgccatttacaaatatgtatgctttgtaggcagaaatgaaagaatagccaccagatagaaaccaggtgtctattttccctgagttcttttattttgttttattttattttggagacaaggtctcgctctgtcgcccaggttggagtgcagtggtgtaatcacagctcaccgcagcttcaaactcctgggctcaagtgatcctcccacctcagcccctcaagtaactgggactacaggtgtgtaccaccacgtctggcttatttttttcttttttttttttttagaaatgaggtctcactgtgttgcccaggctggtctgaaactcctggcctcaagcctcccaaaacgctgggattacaggcatgagccactatgtctggcttcacctccattcttaacccatcagttttatggatttttcttctaaataacccaagatcactagcaccaacatcttttcagaagttattttgggctccacagggaaaagaagccctcgtagtcctacataaacacacttaaagtgtgtatttgaaaagcagagagagcagcagcggacctgctggtacacagatcagaaaggagatggggatgcgaaggatgagatgggattgaaaggaaaaggaggcagagtgacagaatacagaataaaacattatgaatatattttgttagttgactttttagctattttagaatacatgcataaagtcctttcagttcttgggaggctgaattctctcattcacaaccaccatattgagccttactttggtctcagatcacactgaagagctgattcacttatgcattcattacttcaataaatactgattgtgcatctctcactggagaggccccattccaggctcagggaattctaggacaaggagaacaaagatgaccctgctcttctgagctctgattccagtggggaaaggcaacaagcaagtcaacaagcacataactgtgatcattccagagagtgatctgtgctttgaacgatgaaagggggccaagtgattctctcagcagagagaacaagtacacaggccttaggaaggcgggacttttttgtgtgtagggaaagaaggccagaatagctgggttacagctcccaaggggagggcaggatgagatgatgaattttgaggagaggctctccagaacagtgcatgcacgcactagttttcatgcaattccacggaggtcgtggactcccctgcccctgcccataatccatggaccacagattaattgaaaagagagactgagcattgattgtgaggcatacagacaccaggctggttagagtggggaagtgtactgttcccagggcacaggaatggcatgctgtgtttagggatactggctgtggaggaaccacttgagaggaggcgtaaggacagactgtgaaggactttgatgtccaggctgaagagtttgaccttgaacccattagccatgggagctggactgccgagagaacacgtggcctccatccacagccctcagctcagtctccttggtaggccttaggctggtgaaatgcaccagctctgccatcctctgtccttctggcaggttaacaacaaagtggctcacatgtggaaataaacgtggctggtatgagtgggcgcaggccttcattccccgtgctaatggaaaagccgtatttttccaagtggtgctgtaaaagctaagaaaaattaagcttcaatcaaacacagaaaaagcttgattttaagttagattgaagtgaaattaaaattgaccttggccagttttgttctgaagagatgagttcaaactggccaaagaaaaaaataggcccctaacacaggagagagaaagagtggactcttcattgaaagcatgtttttctcaagcatgtgaagaaactagaatttgattattttggtgtgaaggtatataaaaatgcagcccttttgattaagccatttttaaaaacctaatgtattagtccattttcacgctgctgataaagacatacccgagactgggaagaaaaagaggtttaatggactcacagtgtcatatggctggggcggcctcacaatcatggtggaaggcaaggaggggccagtcacttcttacatgggtggctgcaggcaaagagagagagcttgtgcaggggagcttctctttataaaaccatcagatctcgtgagacttactcactatcacaacagcagcatgagaaagacctgcttccatgattcggttacctcccaccaggtccctcccacaatacatgggaattcaagatgagatttgggtggggacaaagccaaagcacatcacttaaaatatggtttttgatatctggcttattttctggctttggggtagtgtgcttgtttcttaaatcagaattttctttagaaataactatgttttatttcttcgctatcattccttgactatgcatggatctctgctgcatgaacatgttctttttttttcatggaagaaataaatatcatttctggcagaccatgacttatcctttctatctttctcgagatgatcagactccacagattgtgtaaaacttctcggaaaaaccctatttcataactcgagagtcatttttgtttgaatgtttcacggaatgttaatcctggcatatttggctgccatcatgaaggactgcagctgtgtggcgtggaaagttcaaaagaaatgacccaaaggaatgagtcataggtcagccttacaaattgggaagaaatataatcaggtaacctgtcatcacccactagaagtgttattatttattgtttattggtaaaaaataaacctgtcaccaatcattgattctgaaaaatgtgccgcttagtttattccaatgattggtacatgagctgggaggatttgtctcagggaagcactgtagttattaaataccatcaagcggacccttgatataatgaggttaaaactgtctgtgtggaggaactatactttattaaagaaggaataggaaaagaaagccaccttatcaaagtcagctttacagactaggtgacaactggttaatgaatttgctattttagttgaaaacataatttgcattactgttagacaaaatagatggggggcctttacaatcagataatgtaatctgctctagtattatggtccaaccctgttctttcatctataattttctcccacaataatgtattactattttaatactgcattctgccctgataaagtctagacttgcatcccaattccaaacgtcagcataaatgtacatatgcaccttttattgtgtgtcttcataaaccaagggcacttccaggggtacatctgttacctttaatttgcacacataggtccctgttcatgggctgctgtttataaaaaggggtttcattggcatcatttcagccttcagagtgagaaacattgaccctgcttgcttttgttacctaatattctgagctgaataaatgatgtgtacagtatcattgctccgtatgagaaaatgtaaatgactacattacattgttggaaggcagtaatacaaaagggaaatatgaagtcagccgacatttctcattcgggaaaaacaaagctgattctggtgattctgtgtgggagattgtactgggctgcaaagcgttgtcaattgaagatttttttttcccccaaaaaagaggaaactaacagtgtgctttttggcacagttgtatttttcatttcttttttttttttttttttttgaggcagggtctcactctgtcgcccaggctggagtgcagtgatgcaatctcggcccactgcaatctccacctcccgggttcaagcgattctcctgcctcagccttccgggtagatgggattacaggcgtccatcaccaggcccagctaatttttgtatttttagtggagacggggtttcaccatgttagccaggctggtctcaaactcctggcctcaggtgatctgcctgcctcggcctcccaaagtgctgggattacaggtgtgagccaccacgcctggcctgtatttttcattcctctaagatttcagtcaggtgtgcaagcccagagggaagcaggatagctgggcttcggggtcagctccaggcttcctgcagcggccaccctgtgcccccagcccgctgcgtcctcttcccagcagctcctcccctccctgcttgctcagcactcggcttccacaggccacatctatttttcttgcaaatcagaaaatgtgggtacagtgtttttaacttttgaaattttagattttgagatctcacctgacattgagagacactggctctctcaggcagtccactgcacatggagatgtcttactactcagcaaaaaggaggagggggctacagtgtacacttaaattaaaaaccaacctaacacgttgcttgcgaactttaacaaataatacattggttcctttggttcccacagggtaggaaaagaaaatgctgttgaaattattttatttgaaagaaatgccatgttgtatttattgtttcctcagtattgcaagttaaaaatctcatggatttatttaggatcatccatctaagtgcagtgcaaaaggttctgcataaatggagttctgtcattgcatcattaaaagtaaaaatgatcaaaataataaaaggcatttaaaaatgcatcattctttaatacaaagccttggtcagcattcagggaagtttatgtaaagctatataatattttgcttttaagactccataaagatgttataaactaggggccatagtttccatggatttttgatatattcaacttaattttttcattctataaatttattctaatatataaagtgattgctacttttcgttatttttacagcgacttggccccttttaagctgagggaactgaccttatgtgtcaatttccaggggaagatgatggccatcaggagtaaaaggagtgctcaataaggatgtaggtgttatactgaacaagaaggacttagcgggtgtcataattttaaagtaaatagtttttattcctgtctcccactgctccttcaagatgctctcgttatgctagtccttccctgaccttttgagggaagtctctagcaggtaccatttacctttttgtaaaaaagaaaaaaaaaagtaaacttttaattttaaataattttagatttacagaagagttgcaaagttagcacagaaggttcccatatacccttctttcagtttcctgtaacattaactttgtatataaccataataaatttatcaaaatgaacaaattaacattggtacattaccattaaccaaactacagagtttatgtagattttacccatttttccactaatgttttttgtctgttgcagtatccactccaaggcatcatgttgcatttagttgttttatgttcttagtcttctccaaaatgcataataacagtttctcatcccttccttgttttttatgaccttgatactttggaagggtactggtcagttattttgcagagattatttgattggtattgtattaaactatagatcaaattggacgaagttgacatcttcacaacattgatctaccagtccacgaacatgctgtacctctctgtttatttcggtcatctgatctttttcatcagcattttgtagtgtttagcagatagatcctgcacatatgtcaatagatttatacctaagtatttcttgactttttttttttttggtgctagtgtaaatggtagttttgggttttttaatctttcccccaaattcccattgttcattgctggtatataatacaattggtccttacatattgaccttttatctcgccatcttgctaaactcatttattatttacagaagattttttcacagattctgtgggagtttctacatagacaatcacttcatctgtgaatagagagaattgtatttcttcctctcgaatctgtattgccttgttgcactggttaggactgaatagactgtagtacaggggatgtgtcttagtccatttgtgttactgtaaaggaatacgtgaggctgggtgatttataaagaaaagaggtttatttggctcatggttctgtaggctgtgcaggaagcacggtgccagcctctgctcagcttttggagaagacctcaggctgcttccattcattgtggaaagtaaaggagagcctgtgtgcagagatcccagggcaagagcagaagcaagtagcggggaggcgccagactccctttaacaatcagccctcccaggaactaagtatagtgaatgaccaaccctttcgtgagggatctgcccccatgaccccaacgccacccaccaggccccacctccaacactggggatcaaattacagcatgagatttggaggggacaaatgtccagattttatcagagtggttagaaaaaaccacctctccttattcctgatcttaagggaaaaagccattatcttttaccattaaatctgatgttagctatatgtattttgtggatgtcccatatttggttaaggaagttcccttcaatttctcattttctgggagtttttgttatgaactttctcaaatcttttcttgcatctattgagatgatcatttgttttgttttttcttatttagtctgttaatttggtgaattgcatagattggtgaacttaccttacaatccttggatgaatcccaattggtaataatatgttattctttcgtgtacttttatatatttctggattcattttactaacatttcggtgagaatgtttatattctctattcatgagagttattcatccatagttacgtttgcttgtgatgtgtttatctagctttggtattagggtaaatgctagtctcataaaatgagaagtattcccttctcttttattttctgtaagatatcgtatagagttgttatgttcggaagatttaactagtgacactgagtctggagttttattttattttgtttttaaaggtttcactataaatacaattttgttaatacatataagactattcaggttgtttttcttcttaagtgagtttttgtagccttttttcccaaggaattagttcatgtcatctaagttgttgaatttatggtcataggattgtttttggtatctttttttttttttttacatatgtgatatcagcagtgataccatattccactcgaatattgtagttgtgccttctcttttttcttaattagcctgcctagaaatttactgcttttattgaaattttcaaagagtagcttttggtttcactgatttaatgccttttttctgaaaactttcatcatggatgctatagagttcacaatatacatttaaaaatctgaatctacctccacataatgctatgctgcttcacacggagtataaggaccttataacagtgtatttctaattcccctctcccattccttctactattattgtcatacattttacttttacatacagtatcaacacaccagatatttttactattacagctttaaccagtcagtaatcttttagagaacttaaaaataaataattttaatttaccttcctttattccatttatgatgcttttcatgtcttcgtatttatcccagtctctgacctatatcatactccttttgcctgaagaattttctttaatgtttcatgaagagtatgtctactggcagtaaattccatgagatttgtttttgtctgaaaagtctttctttctccttcacttttagaggatatttttactgggtgtagaatcctgtattgagatgtttttctttaaacatttgatgtaattccactgttttcttgtttgcatgagttctgccaagaagtctgctatatttcttatcttgctcctctgtaggcaatatgtctttttttcctctggcttccttaaatattttttatttgtcccttctttttcagtagtttgaatatcataactagatgtagagtttgtgttttgttttgttttgttttgctgcttgatgtcctctaagctttgatgatttggtgtctgtcactaattttggaaaatcctagcccattattttttcagccatttcttctgtcccttctgtttttctttctgattttataattccaattatgtatatgttaggctgtttgatattcttccacagtgcttgcatgctccatttagttttgtttgccttgttttttctctttgcatttcagattgattaattcctattgacccatcttcaagttcagtagtcttttcaagtctgctcatgagcccatcaaaagcatttttaatctaaatactgtttttctgatttctatcatttccatttaattctttttcacttaattatttttatagtttccatttttgtgtgaaattacccgtctgatcctatatgttatttactattagagcctttaacatattagctatagttgttttaaattctttgtctgataggtccaagatacatgtcatgtctgagtcttcttctgatcattgttttgtctctttgtggagtatttttccttgctttttttcatatgcctcataatagttttgttgttgttgaaagcctgttatgtcatataataggacagtagacactgaggtcaatattttgtgtggttggagatgagcatgcttttctttccactgggccattaatatgaaggtttttgttcgtttggtcagagatttggctaggtttaaagtttatcattgccatggttaccctcattctactcgaggcctaagtttctctagtggaatcatgtgttcatagcatgggataatttttcagacttgtctccgtatctgctccccatttgtcttttgagtttccctgacttgactttgagtcttctctttgcactggtcccctcagggaatctgcttcttgcagctcccctgctgtatccttcaattatgtttgcttagtgcttttgagtgtgtgcaggtcatgtgtgtgcagggattgagggcattcttttctgttctgattaagcctcaggcttaggcaggtgcctgtgaatctggggcctgaggctgtagtcctgacaagtgttcctgctccttccctacctgtcatgctgggcctagcatatattcccgcctcccttccaggggtagaactccttctccacccccgttcccctgccctatctgcagtgcgatcccacccctgccctcatgctacagtttttgttttgttttttgctctttctcctgcatagtaaggctttcattccttagggaagatgggggtgatgagtgtgtgcagagtttggtggtagctaccatttctttctgaccacagtaagattctagcagtgccttaaagctttagttttttgtccttcaccctatagattaaagcttttgttcttccaggaacataggggagatacgtctcaggagagttttggcagaggtgcctgttcttcccccacatccagcaccaagtgggggaagctgtcttaggtttctcattgagctgccctgagagcaccctttagggttcctggaggaaaatcctactctaggctcttaacccctttatgtcctggtctgtggggctttatacacgctcactagcccatacttggccttaggcagtttattcagacttctagttgaatcttcctatgggcttatagtgagttcaaggtgtctgtcccagataagcaaatggttgggtctgtttctccctggaaatgtctatctctttctggattttctaggttttgagttagttttttccctgtacccttggttctctgacagagtcaagaaaagtcattagtctgcacttcgtccagcatttttcctgtggtaagagtgagagcaatgttctttccagctctctacctctaggagctgaaagcacaagtttgctgtagccagtttctgccacttaccttttaagtcactctcagaaaaccaaatcgttctttagttcctttaatacccaagataatccccagatcacaaattaaactgtttagtcccacatagaggaaaggctctcggagcgagtttttgcctctcctatgcaatcgtgtgtcaagctggctctctgcagtgggaaaggggctgtggtaggcgtcccctctttatccccacttcagcttcttctccatctctctcagctctatgggttccacggaaccctcccagtttgtagatgtagagactcgggtaggaaagattggcaaaaactggggtgtgggcagggatctaaaggaaggagacagaaagttcagacttgaccagtactttctggaactagcagaggtggttggttataggtggtgttctcttgttagactctttgtggatacccctgaaacccctatatccttgggaatctccaccttcaggccccttaatatgtaagagtgtaccacctgcagctggtaggtcctggtgtcccctccttaactcctaccatcaggggctacacttccagcttctttgttctctcacttgcctggcagttctcttgagcaaagtctaagacactgtttctcacacaatgtgggggaaagttttgcttggtagcctcttgccataggtggtggaagtatgtcattccaatccaccgctcttccactgcaggtgctctggccagaactgctgtggtgtgagtcaggcactagtctgctgtttccctccaaattgccggggacacatccagactctcccagtgtcctcctgaagtcctcacgcttgacttgaagtgaagtagggtaggggctgaactcccagcatcctggcaactttgttcaaagtatttctcctaatttccagctttttgggcagcattttccccagtcttctttggggtagaaatgtgtgaccagctaaagtttgcaaaacaagtttttgacatccaatgctgcaggtcctgttttgaggaccttctaccatgggatgtggaaagaatcatcacatcaacttcttgggacctcaatataaactaagccaggaagaattcaatatttaaatctttttgtcctcattctcctaaaatgaacagatgcttttagaaactggttctaggaagtactttttctctgggtattatttttataattttaaaatgtaaaaacaggcattgagaactcataacatcttaagatatttagagtttaagatattgaaaattacatttcatatttcaaaacctaaaatacaatactatagtagaccttaagtggccaaatgaaagatgtttttggagaggaatggatacttactgtcttttcttttgacacagtggcacttttaatcaagataagtgaccaggcttccatgtgaagtctctagagctaaggtaggagatactagttgggctggattcaccaaatgttagcattttaacacagctctatcagacttcacacaggggccccaaaataatttttgtgtaattgaattatgtccattttaatagggattttctttttaaacgaattctactttgttcttttcttaaagcaaagacttttatgctaagataaataccttctgtccctctgcccctctcccatatttcctttgtataaatcttcattcttacattcagaggtgacgtgggcatagttgaaaggtcacagttaaaagctctagcttcagaaccagagaggcatggatacaaattctggctaggaacagaccccaatccattggaatgaataaacaactcatcagagtggccacttggtctttcagtccctaaaccctcctggcccatggcagctgagcgttgcccctgttttttccatgcattggagagtccgcctctctgagctatgtttcctccacacttgaggccaataatcatcttgcagagttgttaggaggatcaactgagggaccaactgaggttccttgcacatagtaggccctcagcagaaagtagctgctatgacattgttaaacgttcgacatctcaaagagagaacaaccgtgttccctctccaccccacagttcagtgtgcccagcttggaaactcacatctttttggggattagttaattgattggagatatgaactgtatctagtggaggcatgtctttatcttctagagaaaaatctttagatggtttatcccttttaactttggttataaaagtattaaaaaagaatacacaaaagatctgaaaaagaaacaaaatcatctgtaatcctatcacacagagttaaccactgttaacttttaaagcatatcttttcaaacttttttttctatgaaaatatggagattcgtataagacggggtatcatcctaaagtcaatgtggataacccctttcactcagtgctctatcacagacatgttttcatgtcagcaattaacaccttcatagaatgccatgatatggattttctaaatgtatttagccatcaatggaatttaggttacttgcagtgaactgcagtgaactgccttacacataagtcttttaatacatacacagctgtttccttagagtacattcgttgaagtaaatttgctggaacagagggaatgcctattttaaataatgagacatatcaccacattcactttggaaaggctgttctaagttgtacatactcccattaaagcatatgtaatgtccctgtctctgcatttaaaagctcttgaataaaacatttttatagtctttgataaatgagagaagtttctccccaaaatcaaacagtatcttttcaatttttttttcatattaaaagagaaaaactcagttgtttaaaaaataaataaaggcttttggccgggtgcggtggctcacgcctgtaatcccagccctttgggaggccgagacgggtggatcacgaggtcagcagatcaagaccatcctggctaacacggtgaaaccccatctctactaaaaatacaaaaaaattagctgggcatggtggcaggcgcctgtagtcccacttgggaggctgaggcaggagaatggcgtgaacccgggaggcggagcttgcagtgagccaagatggcaccactgcactccagcctgggtgacagagcaagactctgtctcaaaaaaataaaataaaatgaaataaataaataaataaaggctttttaaccacaaacgaagttctcttgtcatgacaactattaacactgtatttatcggaattggtgaaatcttaaatatcatctcatataatcctctctctttgtagatgagcaaagttagatcagcacttagagggttcgaagaggaagagtctcctctgtttctgttatctcttttcttctcacccaccttctcatattcaaataatcatcttttttttaattcctagaggaaatattatttttctcctaatatcagggcagccctgtgacatttaaaattcttttattggaagtctaacatgcatacacaaaagtatacaaatctcaactgaatgaactatcacaaagtaaaagcctgtgtaatcgccactcaggtcaagataaaaaaaaattttaattaacatttgctaatacagatgatcataatgaaaaatgtaaaattgctgtgacagtctcttggactacaacttctatatccgacagtcagtaatttcttgggagaaggtacccagttggtctccccacctttacgattatacttctctgggggacaatctgtaatattctgtgtgcggtaacttgcatagttttaaaacgatccacaccactgaatattcttactattcgtgaagccaaaccaagcagttgtaaggacaaaacatggcggctgcaagagtgtgtgattaggatgacaccactgtggcctaaaaccaaatgctttggtacaagtcaaaaataaatggtttggtttcaagtcacaatttggtattacccttgcagttactagatgaaggtggaggcaaacaactgggcgctttgcatctgagaagtctgcagagagtgagaagtatttgctgcagccgctgggctcagccacttgcccctgatgtcagaactccctggaggcagagaccgcagcaccctgactcctggaccccacgcccttttcaaggggccaggctgtgcttcagaaccttggcagagaaggttccaattctgtaccggctcctggcagccagccacgctcccggtactcagcctcactcagccattcgctgcgtgtccaggatggacacccagtttaatcttgttgttcagtcaatagcttttgcattatctttctttttgtggttaatgtaccatttttcttcttttcttcccctacacaaacactgccatgcctgaagtacttcccctgcttgtagagaagttatagcctgggctgtagtggaacagtgctctgattaaagtgattaaaactatatacagcatgcataattaacctttgcgcggctgtcacagcaagctgatgcatggagctgataccatatctgtctgtggcaggcggcgtatgctacatgaccattttttttttcctgcagaattttaatcacttgagataaagagccaggagagagagatcaaggctgtattaatcttctcaatggctttataatttcccttctattctgctgctggtaatcaagaaaaataatgccgccttaatcctggatgccaaggtcaatcatctctgtgccctttgatagtaaggatgtcattatgaaagggtttttaatgaacatgaacataatgctcgccgcactcctcagggagatggatgcgttctgcaacttcgggatggccaggtgggccttcattgctgacaaaaatgattttaaaacattagctctattagaaataaatcccgaacagctggttgaggttgcagaccagccgtacccagcagtgattgagaaattcaggaatgagctgcagcaggtcaacaggtgagaagggcccaagccctgattagcggttgggcaacacagcgagaaccagcacggggcgggggccttgggtagcctcagcagcaggagcccggcccgcggcgccaacaccagcgcctctctggagggctgccaagatcaaaaaagtgcagcgatgcgcagatgcgtggtgacattttaaaacaatgccctggtcttttttttttttttttttttttttttaagaacatgcagacaggtgaaaaacaaaatcctttcagctcaaacgcacctgaactaaatcccagagggctgagtgctgctgtaccactccctcccgctcttacttggttttcccaaaaacacattccccaggtcgaggtggtggagctgacccagccttcacttcactgaaagacaaaccagacgggctgagagcagttcccgggcctccagaggctgcggctcgcacagctttgccggctgtggttatgaactgtgatctgacagtggaaggcagcacttgttaggaaatctttatgtagcatgggtcacttaccctggtgaaggaaaggcgaggaaggcgtcgagttcagacttcaaatacacatgaggtacctgggattaggggaaagaaatgagtaacaagccgcccactcacccttgagaacaaaagaaaagagagaccttcatctctggtagacaggattttaataagatttgggaaaacacacaaacattcttttttttttaatctttatttttcatttattttcttcagcttttaagttccggagtgcttgtgcatgaggtgcaggtttgttacgcaggtaaacctgtgccatggtggtttgctacacgaatcaacccaccacctaggtattaagcccagcatgcattagttattcttcctgatgctctccctcccctacccatgcaacaggccccccagtgtgtgttgttcccccgccatgtgtccatgtattctcatcgttcagctcccacttagaagtgagaacatgaagtgtttggttttctgttcctgcgttggttttctgaatataacgtcttccagctccttctgcgtccctgcaaacgacaagatttcattcctttttgtggctgcatggtattccatggtgtatacgtaacacattttcttcatccattctatcattgatggacatttgggttgactccatgtctttgctattgtgactagtgctgcaatgaacatatgcatatgcgtgcatacatctttataacagcatgatttatattcatttggttatataaccagtaataggattgctgggtcaaatggtatttctgcttctagatctttcaggaattaccacactgtcttctacaatggttgaactaatttacattcccatcaacaggaaaacacacaaacattctaaagtgagccctcacaccagaatggttcctataaatggttcttctttgtatgtcttttaaaatgcattagatttactttctctcaagtggttcatggtacagcttcccttcacattgagggatgggctacggaagcttggagctctgttcccgggaggctcctgaattaccagctatattagtccattttcacgctgctgataaagacatacctgagactgggtaatttataaagaaaaagaggtttaatggactcacagttccacatagctggggaggcctcacaatcatggcggaaggcaaaaggcacgtcttacctggtggcagacaagagagaaacgagagccaagtgaaaggggaaactcctataaaatcatcagatcttgtgagacttattcacgaccacgagaacagtatgggggaaactgctccatgattcagttatctcccagccggtccctccaaaacacgtgggaattctgggagctacaattcaagatgagatttgggtggggacacagcccaaccatatcaccaggtggggggtggctgtagaggcccacttgaaatgcctttcactcctgagaatgctgcagggagggcgaccttggatgggcagagtcaaggtcaatgccgtatgagccaggagaccctgatgcgggaggcccctctttctcttcaagggctttgctcattcttctctcttttatcatctgaccccaaacactgattctttccttctagaatttgtgtttggactcagtaaatacctccatttggattctactcatttagaatgtatgatgatctgacctagtctgggatgaaatttactcttgtaccatctttgagagaagtgtacatggagccagtgtagaatgtaaatagcattgttggagcgtgtttcacctccttccatgaacaaactgtttttaaggacttagacaccgctgttgtcactatttacaaatgagccttctttttttttttaaaagccaacttggcagggtctctcctggaaaccactttgttagcaattctcttcaccagttaaaatgaaaactgaattataaaaaattctataatttagacattctctgcttcctctgagttactctattgacgcagaaaacaatttagtcatgcatacctaagagattgttctggcttttttccccttcaaatgtaatttaggtaatggaacatttgccccgtttccatagatcagttgaagtgctggctggaagggccgcccagatgtgatcctcataagaaattggaacataggaactgccacactgagttattggtgcagtttatggagctcagaggttttctactggtttctacagagcccacgggttccagggaggtgcctagaggtcttctgaggatgaagcaggagattcacggggtggccagtgggcaggaccccacacacacaggcttcgaccagagaagcctgctttcctctgttttctgcattggggttctcctaggatttgttagggggaaaagaggtttcttaaaagcttaaggccttgtatatagccctttgctctgtctcaatagaatttataaagacaagattgatctccttgataagtcttaagcgaggaacgtgcctgaacggctaagtgcttgttgcagacattatgagcctgtctgccgcacatgaatccagctgtgtgtgtgcacatgcaggtgtgtgtatgtgtgcggcccttcattatttgaggcccctaaaaaatcacgtcgttgccaaaatgagttccagaaattcatccagtaaccagggcacatggggaccaacagaagactttgagcttaaatagtcctggaccccagatcgtgcaggcctttgacctctgttcgaagaaatcaaaactgtgccatgaagacagaaccagaaacctagagtcgtcctctggacctcgctccctcgctccctccctccctccctccctcccattgtctagcagagggatcatcactcttcctccacggtggttcttgaatacagtccttcctccattcctcttgccctagttctagtctcatcattttggcctaaatgacttggtatcttaatttttctgtctccagcgttttctccttcactcaaacgtccacatggcctcaatattcctacttttaaaacatcaatacgatgaagtcaccaaacttaaaaataatctttagttgtttctcattgccagaggatgaaagtccaaagtccaacccccttaggaagatatttaaaactttacacaatgtcattctaagtgattggttttttgtttgtttgtttgttttttgtttgtttgtttttttgtttttttttttttttgagacagggtctcgctgtgtcacgcaggctggagggcagttgcagaatcatagctcgctgcagcctcgacctcctgggctcaagcgatcctcccacctcagcctccgaaagcatggggattacaggcgtgagccactgcacccggccgcctttctttccttgtagctttttgatggctgtgcattatttcatgtcccactagactgaggctcagtgagggcctcttgcgtttgaaagccttgtgtctggcgcataaaaggagttccatgggtttgaactcagtgcgcgggaagttgtgctttgttgtttgatactgttggtttgtgagtatcactgcacgccaggcctctaacgtttgcctctttctacctcctcacaactactttactcagtgagagcagttagcgccgtttctcagatgaggacactgagtctcagggagattaggcacctgggttaactttattattatttaccatcctttgcatcccccatctttgagcacatattgtgtgccaggcttgttctaggtgctgggaacacactcactggaggctgagggcaagtgcacgggccagtgtggggaccggcccctccagctccagctcccaggaactacagctatgggcagagcccatgaagcaagcgtggttagatctctataaatagttacatctctggtgtggctccttccaacttgtgaaggacaaggtaactcctcagcgtgagtcattactgaattacagattagctgatggggccttctctgctacagagtgggcctgggctttaaggcctgggactaggggaggtggaagcttatccctttctcgccataagcgctgtcactccagagcggtgctgcgcaaattggaaaggagataggaaggtgatgtcctttcacccttgacctcctagtgtgtctcccccgacccccaccccgccccatctctgccaatagcccctggggactatggctaaggggtcaggtgcacctgagcctaaacctgcccatccctaaggctgttctggtaattcgggaatgagggatgtccacaacgcgagggctgtgggtccgagaggccttccctgctggccatggcagtccctagtggctggttttgagcgagtgctataagtgcactggcagtgactctaggccggctgctttgggaataacgtctgtaaactgactgacgcccggtggcaacagagttccttgaatttggtaacttgggggtgggctgcgtgggctgtgggggctgaagccacctatgacacacactcatcacattccacagagaatgcagtgcagccctctctgatgatttatttgctctgttttctgtttattgtacgttattatccctgtgctttcggtacacgtgtcacttactaagaacccaccatggctttgtcctatcaagtcggccccgtctagcacctcaggcctgtaccacctggctgcggctcccagccctgccttcctccctcttgatggtgtgggagaatttcgtgtgtctctgttttctttcctaagttgataaacgctgtggtatcaattatcatatctttcaataaataggttagatgttgcttaattgtttagttaattcctggcctactttatttcctgtgatgccgccatgccaagctgcattagttgtacagttccattgaagcctttcccttctcttgtttcctcccaaagttcaaaataagtaacaatggtgatgacaaatgctaacactcatttagcactttctggagatgccggagaaaagtatgcattctgctgttgttttgttgcgaattctcccacttactcctaagttgagttctgagtttggatggtctcagaggcatcccgtgaaaaaaggatttcagtgcaaggggtttatcgaggaggtgatcctaggaggcggtgccgtgccacagggaagggaaggcagcagatcggaggttatcaggcatggtggccccgcagagacctgcagctcagcccctcaggaacaaagggaggtggtgcaaaacacggactgtacagttatcctacgtcagggatgaaggatggatctgggccttctacagcaactcccagcagtcacctttgttcagtgctgcacatcggggattctaattctctggaacatctggtcattgtggaagaaagcagagtggactccagccaccagagagagaaagctgttaggcaaagagatagagatgccggacataggaagtcggccagcatgcgctgtacggctgtagaggacacaggcagcagcagcacggctgcaccagaccatcggggtatttttactttacagataatgaagctgagtcttagaggactaagtagcttgcctccagtaacacttggaagtcttttgtgttctttactctctgaaaaattctgacaatacaaatatttaactttcagttgagttcaccagttgttcagtgagcttggtttctgcctatatttgggttgggtatattttccacttgaccctgcctcaaaagttggcttttggccagacatggtggtaacacctgtagtcccagcattttgggaggctggggcaagaggattacttaaagctacaaattcgacaccagcctgagaaacaaagcaaggacctgtctctacaaaaaatattaaaaattagctaagcatggtggtatgatcctgtagtctcaactacttgggaggctaaggcaagaggatcacttgagcccaggagtttgaggttgcagtgagctgtaatcacactactgcacaccaacctgggcaagagaatgagatctcaatttaaaaaacttggctcttgaagtgccaagcctccttgcatccatgaaacattatgttgcagcctactctgaagagaaaccaatgaggctacgttaatattttttttgaatgatatatttttaattcagacttggagtaattgatgggctaggttatgccgctgttgcaaacaactcggtaatctcagtggtttgacacagcctgggttcatttctcacctatacagcgtccacagcaggtccatgtgggtactcaggggtccaggctgctttgatcttgtggctcccctatctgaagctcagcagtagccctggcaaatcacaaggatgactggagacttgtgcttggacctttcactaattcactccagaaatgataatgacatttctatttccatgtcattagccaaaaaaaatggccccaactaattacatgaaagctgacaagtacaatcttccttgtgcctcgaacaggcaggggaggaaccgtggagtattagtgaacatggaaagcatgtttcccagtagagaagtaataataattgagcaatcatgatcaaggcccgcctagggcatttcctggggatttctgaaaggctggaagaattttgccttgggctgtaaatgtcaattgctcattaattcctcagaaatgcccacagccaaggttgctattgctaataaaattcatttgtttggttatttaacaaaacaaaaaaagcatgttgtcattttcccctggcctgatgattcctgaagcagatgattattctctatgttctacatcatatgagtttgtatcatctttttcttttctacctctccaagtgggtggggagtaaatctcattggcctgaaatatcatcacgggcagtactcagccattgttctcacagctgttttgaaatataaataacaaaaaaatgcattttaacgttaatttcaatatttctttccgccttagcaactgacgtaagatttgctggtattgggttttctgcaaatttttattcaaatgtgttgtcttgtatttcttttgtctgtctgactgttttacagaaaaagtgaccactatgtagttcttgtcaccttaacaataaaggtgcttttcaagtggtctatatttcttttaaatatgtttcagtcaaaaggagaccaaaagagttagtaaagaattgggtcagccttactgaaacaaatggttgaagtttgacttctctcatcagtgaatgatagatgccgcaccttctgcctggctggcacagactccatttgatgtaggaggaactcatacccttgtagcttttcccacgttgttgtgaaaactgcggaaataattccttgttccatgtgagaacgagtcatcacttaacttgatgctgttttcatcatattgtcccatcccacagtctggcccacagcctggcccacagcatcggggtggaaccagaaatggctcctgcggagagcaaagcaggacatgaaccgtaccccgcctctgcaaggcttatgctgttattagtcctgatgtacagagtggattcacagaggcccttgaggaccaaaagagaaaatatattcagtaaatcaatggtgatgcgttaatagactgctgctgtatttgttgttcacagaatgtaattccttgataatggcattttctacagtatatcatcacagaacaatagcaatatcaccacaacaggagtgactttgataaattatacaagaataggatcttataatttagtacagatctaatttaggttaaaagtattggtggagaaggagatttcatttttaacattgttcagaggtacaaaaaatcctgggagaaaaaattcagacatattgtgagaagccaatgcacatattaagttattggtgcagatttcgcaaggttttcacatcttttgactcattctcgtattctatatgttatgctatatgttattttaatgtttcattttactagaagttaatctatgtgtctaaaaattgcaagagtgttaaaaaggaactatggctctttattattttaaaagtggagatctaggaatagcataattttgttgctattgagtttttaactagatgtgttgatattccttgataatgtttcaaggatcctgacataatcaaccgtggctcttgcttcctctgggaccttgaagctcaaaaacccagtagcagctcttagcactcttaaggctgataaaaattgagactgaaagtgatatctaatcaatgcctctgagattcaatcaaatattaagatccttgaggccatcacactatttaattggattcctaatacttctttatactcagatagactcctgtgtccaaaggcactcacattggtgaagctggcagcacatcgtgagaggaggccattctccctgtcctggcccctggcatcccagagtcaggcctacagttgggctctcccaggacagtgaatgaagtgcaggtggcagaaagacaaaaagagggtcgagttccttcatggcagctgtagctgcattggaatctaccgtggtggtgtccagaggtggcatgccctacagtggtaccagtggcattctggctagatgattctttttttttttagggatggtgtcttgctctgccacccaggctggagtgcagaggagcgatctcagctcactgcaagctctgcctcccggcttcatgccattctcctgcctcagcctcccaagtagctgggactacaggtgcccgccacctcgcctggctaatttttttgtatttttagtagagacagggtttcatcgtgttagccaggatggtctcaatctcctgacctcgtgatccaccctcctcgacctcccaaagtgctgggattacaggcatgagccatcgtgcctggcctatatgattcttactagaaggcggaggttgtgtttcagaggtaactagtctcctgctggtctgtcttccaaggccagtcaacctcttccagcttttgtgaactcttgagaaccttccaggaaactccccgctcctcctcctcacttttgtgtaagttaacctgattggtttctatcatttgcaaccaagaacctctgactggttcagtggtcagtattggctcaacatttcctaaatgctcaaatcagacagagccttgggagaccgtctgtccctcattttacagatggatttcagacatggccctagctcagagtcctgcagacagttggtagctgagcagggactagaactctgtcctcttgattccagatacagtgctcttttcacctgtggcctttctagtctagagaattactctgcagacctgcactgcatggtaggcgctagccacatggagttgttgagcacttacaatgtggtacaatccaaattgatacgtgctatgtgtgaaatacacagcagattgcgaagactttgtgccgggaaaaatgtcaatgatctcacatttatgtttttatgttgattgcatgttgaaattgtagatgtgttgggtgagataaacaacatcattaagcttgttttttacctttttctttgtactttattcaacatggctgtcagaaaaattaaagttgcatgtgtaacatggactatgcacacgttgaaccaagctgctgtatgcaattataagaaaagataacacttgagtctctatgggtaacattgggcctgtggttattgtgctgggatattgtatttgtttttgctgtggttaaaaaaaaaaaaaagtagcgggtgtggtagctcgtgcctgtaatcccagcactttgggaggctgaggcagtcggatcacctgaggtcaggagttcgagacgagcctgggcaacatggtgaaaccctgtctctactaaaaatacaaaaattagccaggtgttgtggtgggtgcctgtagtcccacttacttgggaggttgaggcaggagaatcgcttgaacccaggagggggaggttgcagtgagccgaaagcactccagcctgggtgatatagctagaatccatctcaaaacaccatttatttttcactatgggtctaccagttggctgtggcttcactgggcccaaccaggccagcctaaccttagctgggctctatgtgttttacattttgggacccaggctctggtggagccatcactgtctagagcacatccttcaagcaccggaatagaactggaaacacagtagagactcaaagacaggataagcccagtggtacttccactgggaaagaggatgggggaggccccacagtccacagcagtcctagtgtcctgctgggcaaatatttcaaggacccgtaggctgggagtagggggtgtcgattgggcctcagtcgtgctcccggggaggactttccaggccgtggttttcgtggctctgaatctgccctctgccaggtgcactcttctgtcatcctccatggctacctctgaggaaggtgctggaagacatgctctccttcatggctgagcagatttcttaacctgcttcctgcccataggaaggatgaatgccgaggatcgttttagatctcaaatgccacggtctatgttaatccagccgaaagtgtagttatcgatttgtcccttttgaagctgtcctgtttgtttttaatctctttgattccggtcaaccccgtgtgcctacagtcatttttcgtgcatgtcctcctttctctaaactcaattccaagtacactgagcacatcatgcttccaacaggccaaattctgggtctctttctctaggccattttgtgcagttgaaagatttcattggggaccttgataatccaactaaaggtttcggcgcaagagccaatgattgcatctttgatttggtctttacccgtaggctgtgctttcacggccaaccttaatttggtgagaaattgcttcactttaaaatcctgaaaatgttgtattttctctcttccctttcaattgtatttgcaaagcagtgagttttttgggaggaggcaaggtgcatttttttttccttatagcacggtgtcaaaggcattctataacaccagttcacacaggcaagattctgttttgaaaacaagtttagttaggccaattttctaagttatcataggttatttcttttttctttttctttttttgccgggtgttttaacactgcatatcttgggttgccatttttccaacttcctttaacaactttccagcttgccatcacctaaacccaaaaccaatgacccatatttcaggtttttgtaatggcagccctacttctgtgtaccaatttctgtattagcttttgctgcagtaactagcaattctcaaatctccatggcttccaacaacaaacacttatttttcacttaagaatcctgcgagtcagctgcagctctgccgagcttggctgtgttctccacgtctcctcatgccaggctgaggctgaatgagcagctgccatctgggccctgctcttctcatgctggagggcaggagctccggaggggaagcgggaacccccaggatctcataaagcctctgctgggacctggcagccgtcccctcctcccacaagtcatatggcaagcccaaggttaatggggtgagcctgtacccttcacctcctggcaagtcacgatgaggagagggcagagacaaatcattttgaacaagtgatacagtctctcacaggcatagattccaaaaagaaacccaggagagagtcaccatgcctcaaatcaagaacagccatattgcatttctatcaaggcagaagcacaggtgtgacagtgtgacaatgaaccctgagaccggaggccctccagtccaggtggacatccagctatgcagccagctcagtgcagccgaaagaacctgggaggcagtccggaaagctgagttcctcttacccgtatccctgcagcaagccactttccctctgtggatctcaagttcctcttcaatattaaccaagagttaagcagaatcgtgggttgctttcgaggatgccgttctgatctctgccagcgcacttcacatggcagggaacaggctgccttcccaggaggccgagctgcagtagaaggagcatgagtttaggaatcaggccaatttgagcgggaagcccaggcagccgtttaccaggtgtgggtccatcatataccctctgactctgtttcctcatctgtgaagtgaacatcacagcatctaactctcagggctgtgggtaggataattattttatacagtgccttttgctaggaaattttttgttgtgttgagtcaaaatctgatcccttaaccagtgaactccggccccggttctgcctctgcctggggcagcaaaacagtgattaggaatatgggcacgggggtcatcccacctgggtctgaatcgcactgtctgctcctggtcaggatggccggggggaggatccttaatgcccccgcggttggcttgctatgcttatctgtaaatgagctactgataatatcaacttcatagttttgttgtggggataaatgagccggtgcatgcaaactcaagtagctgttattatttcagttggcagctcctcaggtacctgagcctgctttccataccttctgggtcatcccgtatttcttcagggtaagcaacctcacatttctccagcattctgtagatgtcaagctttctgcaatcctcccccgtctagctgtcctcttgagaatctccttcaggagctctggttaagagataaagaaacagtgagggcattcgagttcattatcccagccacgatggcattctagatgtctccacagacattcaggatctgcccagggtcccacatctgtctcttctccacatcttaccctgccttctccaggtgatggtgatttcgtgatcccagtcacctgcccccaccctcaccttatctgaccctggctcctgggccacccacttgccacttggaatatttattgtctaactgattttccagtattaaggattttacaggtttacactggaattagaagttcatctgaactgcctgtgatgtccctgctggtttcccaatggccaggcactgcagagatgtataagatacgagaatacagtcacctaaagacatgggaagttttgtaagcaatgtctcccgagattccccattctaaatatggcaaggagtgttttaagtacttcatgcttgaagcttttcatgcatttccatcgttgcagttggaccagttttaaaatatatatatcataaataatcttcagaacattttaatgtactaccgatggtattaaaagtcaaagctttcacaaaatttaatttacttctccctgtaacttaagaacagttttaaaatgtgcatggctcctgctaaatttaacagcttccccttttgccttctcgactggaggctgcaacaacctgagccaggaggtctggcgactacaatgtttgagtgaagctgtgagatccatgcctgtactggaagctcctgacagcctctgcagggccttggtgccaggctccgggggtggtgggggagtgggctttccttcttagaaagcctctaggctttgcaggttcaggaagaagctcaccagctgggtccagccactgaaaggaaccctgagcctcagtttgcagcccagagatgctccggggtctcgcccagtgcatattcctggagagctacaacatcagggcatcagatccacagaagatacatgtgcttcactatacaccaggtgtgtattgaaactaaagcagagtaatactattttttcttttttttttttttttttgagacggagtctcactctgtccccccggttggagtgcagtgatgcaatctcggttcactgcaacctctgcctcccaagtttaagcgatttgtacttcagcctcccgagtagctggtggcacgtgccaccatgcctggctaattttttgtgtcttttagtagagaaggggtttcaccatgtcggccaactcctgacctcaggtgatctgcctgctttggcctcctgaagtgctgggattacaggtgtgagccactgagccctgccaagactctcatttcctaactcttgattaccagcgtgtctctaatgtacattttactgattcattcctctaaaaatattgttgcttttactcaatatggtaaaagtttctattatagggtaagaagaatagcacaaaatattcaccaggcatggaggatatcattgcagttcaagaaagaaatcataagtagtaattaaggggcttggtacccatagagtcatctcatcatcactgtaataaatcattcttatatttatttattggagcctgaggatgttaaacccttacttttgtatgaccattcatagcttattggtgctttcatctttatagaaacacattagagtctggctgcctcagggcccattccctagtcacttccagccagacatccatgtatcaaagctctagccaatcaacatgtagtggacgtctgctaagtagggcttccaaggatgttttctgtttagaataaaaagggggaaatgtggctagccacatttgaccactatcccttcttctggaacatggatgtaaagctggagacagtgtagccatctcgtgaccacgaagcagtgatgaggaagacaagaagcaactcacggaaggacccatgccccctttctctttccactccgctgtcctgaggcttcttcttcttcctcttcttttcaagttgcgtaaagtggatacttagatccctgaagtcagacctttcttcttttctagtgtaagtgcttgatgccatcagtatccccaggcactgctttaggctcatctccccatttttatgttgggtcttcattttctttcatgacaaaatatcttctaattccctttgcattttctcctttcacccatggattatttataagtgtgttgttaagttctaactctttggcgattttccagataactttctgttactgatttctgatttaattctgcggtggccagaaaacatactctgcatgatttcaatccttttaaatttattgagatttgttttatggcccagaatatcttggcatatgttctgtgtgcacttaaaaagaatttgtattttgctgttgttgggtggagtgttctgtaaatatcaattaggtcaagctggttgatagtcccgttcaagtcttctgtttactgattttctaagttttaaagacattttaaaaaatgaaaaacgaaatgtttatatatttactcacatattgaccatttctgctgttctttatcccctgtgtacattcagcttttggtttggcatcttccttctccctgaaggcatgtccttaatacttcttgaagtgctggcctgatggtttaaattccacccagtgccctatgcatgagcgctggtaggagcacaccctcttcctggccttgtgtgggctgtcaggattatgttgcctcctcctgttatttcctggccttggtagtttccttacctgtatgcacagatcaacactcagcaaaagaccctgaagctctgtctgccacagctgcctcttctgtggcatttttctccactagctttagcctcctgggcctccgcagactctaaactctggcttgttaactcagcaagcccactgggatctgtctggcttccctcagcctggattgggaactctttcaaggcagcgagctggacactcttttgttttccttcacccaggaatcactgtcccgtgctgccggtggtccagtgtcagaaatcgctgcttcacatattttgtctggttttcaagctgtttaaggtgggggaataaatctgattcctgttactgtatcatggctgaaagcaaaagtcctcttcacctacttaaaaaaacttaattgtagcaaaatatacatgtattagtttgttttcacactgctataaataactacctgagactgggtaatttataaagagaagaggtagaattgactcacagtcctgcatggctggggaggcctcaggaaagttacaatcatggcagaagggtgaaggggaagaaggcatgtcttacatggcatcaggagagagagagcagaggggaagaactgcacacttaccaaacaaccagatttcgtgagaattctatcatgaaagcagcaagagggaaattcaccccttaattcaatcacctcccactaggccactgccacaacacatggggattacaacttgagatgacatttgggaggggaccagagccaaaccatatcaatacataacataaaatttagcatcttctccattttaagtctcccgttcagtaagaagtattatgcacattaacatttctgcacactcatcaccatcatgcatttccagaacatttccagcttgctcaactggaagctctttccccatcaaacaatgattctcattctccccttccccagcccctggcacccaccattgtacttcctgtctccttgaattctactactctagaggcctcatataagtggagacacacagtgtctgcccttttgtgtgtgacttatctcagcataatgtctttgaggctatccatattgtagtatgtgttggaatttccttcttttttaaggtaaaataatatgaccttatatgtatagaccatattatgtctttcctttcatgtgacggacacttgggctgctcccccttgtggctgttatgaacagtgctcccatttgccacgttcttcttaatgttcaacaactttgttaaaattatttaaatgcaatgatagtcatctcaccatgtagttcaacttgtttttacagctgtgtgtgtgtgtgtgtgtgttataatgggaagaagatgaaataaatggttatagttaatttgggaactttgatcaaatcccctttctttccatattcctttccttttttcttttcttaaatttcccttttcttatcttttctctcatcttttactcttctctttgctctttcttttctctcactcttttcttctcctttccttttctgctcttattccatttcttgccctcctttccttccatgtgtgcacagtacactgacccaggaagccgccgtgtgcacacacaccccaatcaacatgactgaggtgctacggtattagcatgaagcaactcatattccaggggcagagagaagatgtgaacatccatgaatgtaacctgagttgaagtggcctgaatagaagaacagaagtgcagatacggtgctttaattactcagtgacagaggttatttttggttagggagaatctggaaagtcttcattgtagggccgacagttgacctgaaacctgagagtcgggcacagttggggtttccaacaggtgcaaagattttctaggttacagaaccactagagcaaaaagcgcagacatgggacaagcctgctgtccggtacaatgtcacatcatgatgccattcagacctcttttcccaaagattctaactagcttttttaaactttacagtgatatacagaaaatgataaatacaagtcatcattaaaatggaacaatgaaaattactcacttttcatgcactttgcccttttctgattggttttagactcggtacattgcaaatatttttccaattttatcatttgtcttttgtgttttacatcctgttgtccttaaggaaataactgcaacaaaagagcagcatctcaggaattctcactgatgaaaatgagtcatccgaattaacaaaaagtttgaattactaacttattaatagaattttggttttattatgtcacgccccttgtgtcatccttgattgccaaactaagtcttagtaattagagctcgttgggaacgtgttttaataaatagatggtgattgtttcatttttaagtgccaagaagttcattctttactaggctaaattcatctgtaacatcttatgttgttaatcagtttaaggaaatattttacctttaaataaatgtatttttagcctaatttgtaaacaaattatcataaattctaagttaatggtttcccaattctatagtaaggtgaaacagtccatatctacctcattttattatcgtatcagctcaattttaggcctccttttggtttccatttaagtcatgagaaatttactaaaatatcatatttcctgtgatcctgtcagtcttactggtgactttaagtgaaacaatgtgtgagaattgtctttggaaagcaaagttgttcaccctccctgatctgctgttgaggaacctccatgctcttcttaatatatgagtatgtatcaccctcagtctccctacagaaatattgcgctttaacacttccactttttccatgacacatctgtccttgcccctccttggcttggagttctttcatatctccccatcatctacaggctaaagtctgtttgagagcagaactttgtagccaaaaggcccatttaaatcctatgtctaccacgtgagatgcaacttacaggataatcactcattttctctcggcatcagcttccttgtctaggaagggggagcagtgtggctgccctacagcattggtgggaagactaatgagaaaaggctcagaaagtcctcagctgtccccgggtgcagagtgggccctcccgaggtggcacactgccttgacctcctgagcagtggacaggttcctcctccctcccaggcctgctcagccaggtccaagctgcaccagctccacaggcacgcctgccacgcagccccgtggaagcacctcctctgtcggccatcagcatgtgggccatgctgcatctctctccccagatgtccttgcccaccctcagatatctccacgcatccctgaaggctgacactcctctatagggggcgttaccaggcccctgccaccccaggcacactgagaagtgctttgtccctgcttcccggacctggcacacagctctgctgcaggcattgtgtggaaatcacagttcttacctcacacattcccttgaccgcatgcattttaaagcatttgaatgaatttttaaaaattctaactgtgaaatatttcagccatgtggaaagctgtaatcggataccagtgtatgacactaacatttaacaaatacgaacattttaaagagaaagcagttttacaaaaaaacctaaccctcctcccagtttcctctttgctgaagaaaccatgaacctgaagttggtgctactccttctaatctgtgtctttatattttattacatattttcatccccataattctctggaatagcatttgtatatttttaaaatttacataaatattttcacctttaaagtggttcccctcaaatatttaacacgcgtaattgaacagagtctaaaatttaccaacatgttctgcctgaacaggcttcaatttctcttgcatcgttcatgttttgtggtccgctgtttaggttttatctggtttttcatccccaggttggttataataacaacacaacgtcattttttcctgtttggtgctgatttagcctttccagtgtgtttaactcatcattgcttctctcgtcctgcccatccttcttggcttcatatccttatagaatttctccttcagaaatcatttcccactggaaggctggaaatagctttatttaccctccctctctttttctcccacctttattttggaagatttcaacctgcagaaatgtaaggtgaattaactgaatacctgacacccttcacctagattcacccaccatgagcatttggccgcttcgagtcccctctctccccctctccatttccctcccctctttccctctttgcatgctctgtcacacactcgttttagactgacacatttgcagatttgttgcagacattcctccctaatactccagcgatcttcaacataaccaccataaaatcattgctcttgaaaatttcgcattgatttatgtgtagttctgttatctaatatatcattcaaattcaaatgtgcctaattgtagcaaaaaaaaagacctttatggcttttctttttcaattctagcgtccaattaaggattatttactgtctttagtaaaaacatctccttacccataatctaatcgttccctggcctttcattttttctcaacattgacatctttgaaaactccagaccagttgtttggcagaatgtccttcagtcttgaatttggctgactgtgtattctttgtcagattcaagttaactgtctttttttttcttttttctttttttttcccgacagagtcttgctctgtcaccaagctggagtgtggtggcacgatctcagctcactgcaacctccgcctcccgggttcaagcgattctcctgcctcagcctcccgagtagctgggactacaggcatgtgccaccacgcccggttaattttttgtttttttaatagagacggggtttcaccgtgctagccaggatggtctcgatctcttgaccttgtaatctgcctgccttggcctcccaaagtgctgggattacaggtatgagccaagttaactatcgtaatgaccccatgtccttgtcagtgcaccacatcagaggccacctgatgtcaacttgtcccattattgattattttgagtgtgattattaagctaaatggggaccaacaggtttgtccaaagggaaaggtgcatttttcctttgtgagttatcaataatctgtgtggtaataccttgaaactatgggactattctgtttcttaacactctttactcactcacgggtgactcttgcctcagtcaactattaccacgatgtttgtgtcctaacttctaccatcctttgtgtgtttattaggttagtcttcttctgtaaggaactccttttccttcttcacatttccattcctttttttaggaagggactcttgttctttgtgttaattgaatatgttataatatcccgttactcatttaggtgttaacattgtttcagatttggctgctgggcatggtttcagagtatctcctctatcttttccggatgttctcctctgtctttgagtgtgtctcactttctagcacaacaagctgctccaggctcacctgtatttttcctgccccagccctggaatcagccattgctccaagaagctttggtgcctttgagtgcaatatgatatttacgaaccaagatctggctgctaagtgtgcttattacttccttggtgttcttactcccagactcttcagtggctagaaatgtgcgcgtgtgcatgtgtgtgtgtgtattttaaatcatgagtttacgctgacatctctaattccagttcatcatcacagggttcttcctctcctcccattccatgtttgtgtctcccttctcccacaataagaaccctgattccccatcacattaatgtatttacccacttattcaatcctacaattcacacaaaattgtttttggaattgctataccgatactactgctcactacaaattcagtaagagagatttaatatttccttctggttcttcttgtgcctggaagatgtctcattaagggttacagtcagatattgagttctaaactttcttgccttaatttttttttcctcttccatttgttatattacctatttgatgtatagctaggtttactggtttctttgtaggaaaactttcctgtgtcttaattgaataatatatttgtggatatataaactgttagtatagttcaaaagtctaaattacatgaaaagatgtggtcagagaagcctcatcgccttccctgtccatgccttgtactccattctcaacaatgcttcataaagagctgttttcaaagttcctggtatatcctttctatgttttattgtttgctagtttttgtttgttttgctgaaataagaatatagcacagaatgacagaaaaaattgcaaaccatatatctggtaaaggtcattgtccataacacataaagaatttttaccactcaacaataaaaagacaaatggcctaattttaaaatggacaaaggattttaataggcatttttccaaagaagataaaaaaaacgggcaataaacacctgagaaaatgcttaacataattagccatcagggaaatgcaaatcaataccacagtggggtacctctttactctcactaggatgacaggttttttagtttgtttgtttgtggttttgttttttgttttgtttttttttttttgagacagacgagactccgtcgctcaggctagagtgcagtggtgtaatctcggctcactgcaagctccacctcccgggttcactccattctcctgcctcagcctcccgagtagctgggactacaggtgcccgccaccatggccggctaattttttgtgtttttagtagagacgaggtttcaccgtgttagccaggatggtctcgatcatctgctgaccttgtgatccgcccacctcggcctcccaaagtgcttggattacaggcacgagccaccgcgcccggccgacagtttttttcttaatggaaaattggaagtgttggcaagaagtagatacattttaacccttatacattgtttataggattgtaaaagggtacagctgctgtggaaaagagtttggcatttcctcaaaaagttaaatacagagttactatatgacctagcaataccactcctaggtatgtatgcaagagaactgaaagcatatgttcactcaaaaaatggtacacacatgttttttagcactcatgaaatactgctatgtggtatgtgatggtttggatgtttgtcccttccaagcctcaagttgaaatttgatctcccgtgttggaggtggggcctcatgggaggtgtttgggtcacggaagtgggtccctcatgaacagattagtactctcccttgggagtgagttcttgccctattggttcctgagagagctggttgttaaaaaagagccttgcacctcctagactctgtcttgctttctctctggccatgtaatcttcgcacacgagacaccccttccccttccaccatgagtggaagcagcctgaggccctcaccacatgcagacgtccaatcttgaacttcccagccatcagaattgtgagccaactacacctcttttctttataaaccacccagtctcaggtattctgttaaagtaacacaaaacagactgagatgtggtacaagatagatgaaccttgaaaacattatgctgagtgaaagaagctagacacaaagacccacatactgcatgaatcagtttatatgaaatgtgcaaaatacacaaatctatagagacagaaagtagagtagtagttcccaggggctgtggggagaggggcaatggaaagtgagtgctgaagagtataggatttccttttggagtggaaaaaatactctggaactaggaagtgctacacaacctggtgaatataatataatataaatattctgtaatgaaactagcctggtgcagtgactcacacctgtaatgcactttgggaggctgaggtgggaggatcgcttgagtccaggagttcaagagcagcctgagcagcagggcaagaccctgtctctacaagaaatgtataaaaattagcagacatggtggtgcacacttgtagtcacagctactcagaaggctgatgtggaggatggcttcagcccggaagatcaaggctgcagtgggctacgataacaccacttcactccagcctgagagacagagtgaaaccatgtatctaaaaaaaattaataataggccgggcacggtggctcacgcctgtaatcccagcactttgggaggcctaggaggggggatcacaaggtcaggagatcgagaccatcctggagaacacaatagaatcccgtctctactgaaaatacaaaagattagccgggtgtggtggtgggcgcctgtagtcccagctactcgggagactgaggcaggagaatggcgtgaacccgggaggtggagctttcagtgagtggagatcgcgccactgcactccagcctgggtgacagagcgagactccgtctcaaaaaaaaaaaaaaaaataataataataaaacctacttatctgtgtattttacagtcgtaacttttatgatatatgaattatatctcaataaaaatacaatcatttttaaagtataatcagcaccttttttttttccaattcatatcctggaaatcagcccacatcagttcatagataacttcaccattttttttattttttaaatagctactacgtgtttgttataccacggtttattctgtcagtctcctatatggacatttaaacgactttcactatttttctattataagtaatgccgcaatgaatatttgtgcattatttttgtatcactggaggtaatgttactctcattcttgaatgatagtctggatgtatataaaactctaggttgatatttcactttctttcaatcctttgacacttttgttacattttattttaggctttttatttttctggtaagaaatctgctttcagtataattattctattgtggataatctttccctatggtttttagggttgttttttccttatctttgctgtctacagtttcactaggtagttattttctcctgtttaagaatcattatgtttcttgtttctttagaatcatgtcctttatcaattccaaagttttttttttagaggaacgttcttgctctgttgtccaggctggagtgcagtggcacaatcactcactgtaaccccgaactcctgggttcaagcaatcttctagactcagcctcctgagtagcaaggaccacaaacacatgccactatccctggctaattaaaaaaaaaaatgtggagataagtgtcttgctatgttgcccaggctggtcttgaactcttggcctcaagcgatcctcccacctcagcctcccaaagtgctgagattgcaggtatgagccactgtacctggcctcagtttcaaaattcttagccttattttttctgaatatttctttttttcacttgttttggtctccttctagaactccgatttaagcatatttgcatcttctcattttgccttattttctcttcccattcatcgtttctgtctctctttgctacattctggaaactttcctcaatctctttttcattcagttattttctctttagctttgtcttacctgatgtttgtcctcacctttgagtttttaattccaatgactatatttttcatttgtgtttccatttgctactcttcaaatccaccttttcatcgtgttctattattttgttagaactttaattattttatgtttaatcatttttaacttattttgtagtgtctcccaaattattgtagtaagttcaggggtggaaattctgtttcagaacatactaatctttacaatggtggctgtatgcgtatgtgtgtgtgtgtgtgtgagagagagagagagacagagagcgcgcgagtgcaggagctcatcttcattaattgttacattcatggaacgctcatgctccctgaactgtgccttaccatcaaatggtttcacctctgcttgtgctattgtcctgctggtttcaatggtttagagctggtttaaattaatttttcagattaaggagccctccaagacacaggtagcatttcagtgtcttttttttttttttttttttttttttttgagacagagtcttgttctgtcgcccaggctggagtgcagtggcaagatctcggctcactgcaacctctgcctcccaggttcaagcaattatcctgcctcagcctcctgagtagctgggactacaggtgcacgccaccatgtccagctaagtttttgtattttttagtagagacggggtttcaccatgttgcctaggctggtcgcaaactcctgagctcaggcaatccgcccacctcggcctcccgaagtgctgggatggcaggcatgagccaccgtaccctgcctctgtgtcttttttgatctcctttctagcgcatgctgtcttcttttctccatcaagcttaccttttcatttaaaatttccttcttatatttcacctagaatcttacgtccttgtagcaggaatagggtctgagccagtgtattctaatatgttgctaaaatcagatatatttaaatatattctctctttttttattatgaagatttgtctctatctgtaaaacttaaaacttgccattttagccatgcaacttagtagcattaattacatgcacattgttgtgtaaacatcctgcatatctatttcaaaaatgttttatcacccaaacagaagctctgtacctattaactcctctattcccacctcccctttcgccactggtagctgcttttctgcctagtgtctctgtgaatttgcatattcgaaatatttcacatattcgtccttttgtgtctggcttattttacttaccgtaatgtttgtaaggattgtctacattgtagcatgtgtcaaaaactcattgctttttgtggctgaacactatttcattatctgacataccacactctatgtatccacttgcccgttcatgtacatataggttgtttctgcctattggctcttgtgaataatgctgcagtgaacattcgtgtacaagtatctgttcgagtctctatgttcagttccctgggatatatccctaagagtgcgattactgaatcttatagcaactttgcgtttttaaaacagactcttaccaaaatgaaataaatcacaaaggtgtagcaccgcaacagcagaggtggtgagggtcttacatcatccctcatctgtttaggttaacatatatgatattcaaaattaagagcaaactgcttagtcctagaactgcccagttcttgtttcttattgctcagctgtgtacaccatgtctacccagtgtgagtttcagtggaactagaatactttgattgagcaagggcttgtgtgtgtattgtttacttttaaaaacattgtttcaagagggttttttgttgttgttgttggcttggggcttgggggtgatactgaaccaatactcattcctgctttgatacattgtttcctgagccttctcatctcttctctgcggcttagctttcattatttaacaaacatttattgagtgcccgtaatgtgctggcttctgtgatacacacagagaaaattaaccctggagtaacgtgctgagggctgcggtacaggaaagcacagaatgggccgtgcgcataacccggatgagcgccttgtgtcccgctcactttgcgcgttgggctgcaaacagtgaacactcactgaagttctgtcatgggatggaaaattcattgcacaaatgcaagtggaagcagggagggcaggattcttgggaatgacgccagatccaggagacgatcagcttggtctcattccccaccacgaacctcgtgtcccgacagcgtcgacacatcccttcatacacggctggccagatgctcacccgcagtccactcagcggtccactcagctgcgtccaggattgctgggtcatttggaaactgcatagagattcataggcagcttcccctaaaaagggtgatattctgatgcttagcccatctggtacagccaccattcatctcttccttccttcctttaaatattccgcaagtactcatctcaacctcttctcacacctaagcctatcctgataattgtcttttcctccaaatcctctttaatatatttttcatgtcaaaggggaaatcatcttcttttgtaagagaatacatgataaatttattttccctgtgtctcccggatgtctagagcgggagtcaggaaaaggaagcatttttggggggacttaggaggaaagaattcatttttttttttttttggtaccttagaatacagagacagtgatccacattagaaaggtatgggttggactctcctacttccctaggatgtttcttctaccagtgtgggtgacactggagttggggtgggccatcaggagatggaggtgagcctgccccggatggctgccccctgctcaagtgagccagggtgggaggagatgaggaagacagcccctctggctgtgccttttggcccccttttctctcagttgccctaaaagttatttattcctggagttggctttagaaataaataggaagtatcttggcataagtcagagaagggtccaaggcagaccatcttcagacgcagtgagaccctcatcctctactccatcatacacctgttttccattacggagttctgctgtcctctagttcagctctgctctccagcaggctctctcgggtggtgaccagatggccgccaataactccagacttaaatcctgcctgggctgcggggcggacaccccatctactgtgcaggcactgctgttggctcctgtggagcagctgtggagcaggggtgggtggagtagcctctgcccatcctgagggacctcctccgtcctccagttgtggcctctgctcaggttcatatggccacacagcaacactgtctaccttttatgcttctgctgatccctacctctcccaaagacagtaagctcgggaaaaggggacagtgacggtgttagtgaccccaccacacccactacagtgttgagcactcatcacatgtgtgtccgtggagctggcctatatgcgctctccagtatgaggctgtattatgtctaaggatacacaaatacacggctttaaagtaggaatattttttaatttactacaaagaagctcagggattaaagaaccatccgtctcttaattctcatggtcgatggctttatctttttgcatagcgtgcttgcctaaagcgaggcacctcttcatatataaatcagcctttttttgaataaaagttaaatacaacaggatggaaatgcagctttgaaaacctataatgagcaggagggattattatgcatctacaccccggggaagtgaatatttcatgttagaaaaagtagaggccaagggcaaggttcatttaaaatgtataaagataataaaagcgctcatggatggaaaggccatctgaaaggactgttcactttttggagaggctgatgtggaatcattgtgtttctttgcagggggaaaaagaaaaagtcctgtgtgcgaatggccccctgcgtggtgctgcgtcagcagacaggagcattattttcccctggaatgtgcagcgcttggtgcctctgttctctctgtagtgcacagagccaagcagagagagaggctgagcgtttcaaagagagacaaaacaaaaacagattattctgctgtgctgccacatcaccacagcacaatactctgttcaaaattgtctcttgtcaggcacattcttcaaacagtattatgtgtacaaagactctctgtgttggagaatttgcatgtgtagggaaaatagctgcatagtgcggaatatttcctgaagaggccagatttctgtgtgtgtatgtgtgtgccgggcatctgtgtccttagcattttggaaggtgcctgagctttcggaggtcaccaaaaagtactgagtcatcgtgccattcggttaccttcggcgctaccatcctagtctgaagcttttacaggcctctaagaaggtcttcctgagaccccagtcttgttttttgcataagtacgctgcccaggctccggtgattgacaggtgtagaatgggacgtcctcctttcccagttgcatgatacatagtgttcagtgttaatttctggaattcaggtcacttgaaaggccaattcttgggcctttctgcctgaatggctgatgattcctctccttgcatccctcgtgatcaattatccagaaaaactgattattcagattgttaaatccccagttagtccggataatcggcattctgttgtatcccataaatgtggcccacgctgtggagcagggtgggcctcttcctggggccctgtggctcctctctccccaagctcaggcgtgctgctctgtctcccgctgcctgctcttctgggcattccgctctcctccagcgccactgatgcacagcctttccaagagggtggccttgcctctgggtcagctctccattttggggggactagggtggcccggctggaggcctctgcagtctttgtaactgggacaaaagttgaaaggacacataaaaaaaattacagataaacctgaaggcacatgtgctcacatggctgctgtggctgtgggattgttccttctgcctgtgaaatggctgaatttaaaacccatgcttctttgtcctctagatcctgtacccccactttaggaaggggcagcaatcagaattaggcagcctactgtctttgttggggggctgtaacaaagtgccatagacagagtggcttgtcagcaacagaaacttactgctcacagttctggaggctgtgaagtccaagaccaaggcaccagcacattcggtgtctggtgagggctcatttcttggtttgctgtgtcctcacatggcggaaagggcagacgggcttcctcaggctacctgaggaagggcactaatcccattcacaagggctctgccctcctgatccattctcctccccagagctccacctcttaatgctatgaccttgggtagcaggtttcaacatatgaattttgggaggacacattcaaaccacatcacctgcccaaggtcttacagccggtggtagcccaggccagccatctctttactgtacccattttgtctctagttctgtattaggtgttggaggagggaggtcacacagatgtgaaaatgagtcagctgaacaaggagcaggccctgccctggaggagcttaaggggaaattataaatttccctcagtagtgaatcatgctataatctagtgcagggtgcaaatatgtgacctgagggagctggataaagtactcaccttgctgtggagacgtttgacttgcacctggaaggatgactcagagcagagatgaggtgggggagggcattctagggaaggggccaacttgagcaagagcttgtaggtgcgggggcgtgcagggcaagggggccctgttcacttagaacaaaggatcggccaaggaagtctgggaaacaaaccaaactacagaggagcttgagcagagtcgaagtttattttgttccctcgttgaaggtttaaagccgaggagctacgtgatgagcgctgtgttttaggaagaggactccgtaatagagaggatgagccagtggatccatttctaaatgtgtttcttaggctataggaggaggagctttctttatttattccaaaatttgctttcagatgctaatgcgtgtattgtgaactctgagaagagagagttccaaaatgtatttgaccacaaaacctctttttcacggtaactggtgcacagtaggcactcagtgtttttgcatgaccaaataagcaagtacaacaccagcgtgccacagagtgtggttcaagaaacattgcattctgtgaggcgctgaagcaagaagaaaggccagtgagaggctttgatatttatccggggaagaggtactgattgctcaagctaagcttcagtggactgaagatagggaagccaaccacccacaactcctccaaatacctccctctcccaggcaggcatggctggggcacccgcttctgggctctcctgccccctgggcccaccccacggatggcttttcatgcatttacttatcattctcctctggcagagaccggcacggtctggcccgtgggggctcaagacagttgacagaaggaagaggaaggagacctaagggacttggcagctgggtggagaagaagacccgatttctttatttatacatggacttgcttgaaaaagatttctagtccttaaccaaaaaaaagtgcagtgacctttccactacgacatctgttcccacgagatgcaagtcacagttttcatgtaagggctcaaagcaaccgtggagggccgaaggcaagcaagatgtggatcaggctcttgtttttctcttctcttcatcttcccctccccttctaaagtgagagcttgtgattaaggagggtttaatgacagggaaaacagttaaaatgaagaaggagttgcctgaaggaagcatctgggaggtgggcagagcaaggggtaccgggggccctgccatgaagccttcagggcatcggtatggaaatgcctccagctcctggctcgcgctaagcgtacctggttctctagatggctcccggtcttcttgcctcctggcccttccctctcccctcctctgacctttctcttacacttatctttttttttttttttttttgagatggagtctcgctctgtcacccaggctggagtgcagtggcacgatctcggctcactgcaacctccgcctcccaggttcacgccattctcctgcctcagccgctcgagtagctgggactacaggcgctcgccacaacgcccagctaattttttgtatttttggtagagatggggtttcactatgttagccaggatggtctcgatctcctgacgtcgtgatccacccgcctcggcctcccaaagtgctgacattacaggcgtgagccaccgtgcccggccctgttacacttatctttattcccctcatccattcttttctctggactatgttagtgctctggtaacatcctttccctcattcaatcccaactctcctaaacccccttgagtatgttcaccagtggtttattgacatccatctattcttgttctctccaagcccagcaaaaataagaaaacatattttggggtagacagatgctgacccctgacaatttctctttgattttcctccacattttctctttattttttgcttcactaacctttaagccagagtaaataaaaatgactggagatgactgatttgccccagattacacattaagttagtggtgatactagcgccagggcccagggctgactctgctataccatactcccttccctgatggtgcctgcttttctgaaagcttcttgccctattataaaggaagaagcatctactccagatgttgaaaaaggtaaggagcggttatgaaggcccagccctggggatagcttagcattttgcatttagtgcaaacccatttgcagcttttcctcatatttggttgaaagcatttgcattatacagttcatttatgcctttatcataattaggtgcaagttgctgctgcaatatgcttgtctgcattattaccgtacttgcctattttcattcctgctcatcctacgttattgtgtcttactgggttcatgtcaaatcttttcaatgtgtataatattctgctttcggaaatcaggagggggcaaagattgttatgtcaaaaattcagagaaaatgaagaaatgtgtgtacatgtgcacatatagagagaaactgcattgaaatcacagcgagattgtggcagaaatgagaaaacctaagattaacggcttagagggtttttatgctcctggaactcagaaatggtatgtttgcagttgctgcacaaacatggtctaattgctgaagctatttttaaaaagcacgctgaaaccatgaagctagggaagttcaaaggcttgctcttgcatgtgctcagtcatctttcccaactcttattgcaaaatgattttttgcttgaggacagagtgttgggtatctgtgacagccacggtgacatgggctgggaggtgtctccagagcagctccagcagatccctgatggcccactgggtaattaaaagctaagtggaatgttgaaaaaacgtccatacaatttgatcggtcaatttgcttgcttttttgagaatttaaatgagaccttcagaatcatttgaacttttaaaaggaaatcatttcaaaagtcgtcgaaagcgagtgtgtttgatgtgtcttaagtgacgggcaagactgaactcattttaggtggttgttgatagtatggatgcagctgtgaaacttgaatcagaatcatgcgccatccttcagtcaactttgtaaggcacatttctcccggaaatcccacaactgttgattattctcttgtacggccgtggaatctgagagctttcaattagcccctaagggcacgagaagttgagggtattttccaaataacagggtctacatgcaaatgacgtggtaggagcaggggtaggatgagccagagaaagctggagcctggcttctgccccattctctccagctcactcgctgtagaaagccagtggctaaaggcccttgttggagccaggggagtctttggtaggagacccctgaagagcatgtaccctgatgtggtttggctgtgtccccacccaaatctcatcttgaattgtagctcccataattcccacgtgttgtgggagggacccgtggggaggtaattgaatcataggggtgggtttttcccatgctgttcttgtggtagtgaacaagtctcatgagatcggatggttttctgaggggtttcccctttcgcttggccctcattctgtgtttcccacctccatgtaagacatccttttgctcttccttcatcttacaccatgatggtggggcctccccagtcatgtggcactgcgagtccattaagcctctttttctttatgaattgcccagtcatgggtgtgtctttattagcagcgtgagaatgagctaatacatacactaaccaagcaccctctgtggctgactccaagttgtcatggaagttgataaagtacccttgagagcttagtaccaagtcacgtgctgactgactgggttttacacgtcctagccaccttccacccagaccactgtatccaaaacctggcctggccacgttttggataactttttacttacttttttatttagtgaactacagtttatttgatcattcttgatcactttattaagcggaaggagatgttaatctctgaaaagtctatccttttacttccctaaaccaaaaagtgactggagcagatctcaatagatgagaagtttattttgtcaaggttgagggcacacccaggaaaaagaaacacaagtcatagtaggatctatggcctgtgctttttccaaagagggtttttggaacttcagtatttagagaaaagaacaagcaagagtagcggggggtgggaaagagggagggagaggaggcaatgaggccagtggtcacattcctgtgaagccctgaccagccctcagtggatctacattttacatgtgaagaaagggaatcagggaaagtcaattatgattctctctctgcttagtaaatctacactttacatgagttaaagtaaacatgtgacatcatagctgtctgtttgggaacaaaaggaaggcagtgttttgcatgactcagttcccagccctaacttcccctttggcacagtgagtttggggtcctgagtttctattttccttgcacacgtcttagtgctgtgatagaaaaggggtttatttgaactcttgccatctttgtcttaaaagatgatggaaagtcaactgtctgtggatgtgataggcaaatcagttgttttaagcaattcttaggtaagatttaacatggcctcaactaattacttaagagacagctaggaattatttctgtttgcctgtactttgcctctgtatgtgtgtgtgtgcattgcatttctagggaaaatattgaatagcagtttcttttttgaataattatgtattagagaaatttagcaatattcttcccaaattctatatactttacattacccttcattttaccttccagctgatagaagagggaaaattgtagattattaattgatagatagatagacagacagattgtcagggagatggatggatggatagatagataatagaggactttagcttatatagcaattcctgatacaggcacagatgcagactcatagtataaagttgcttatcatggcaagtgcctgacatttcaccattttgatgactattctaggcccaaaagctcacagactgggggcaaatcttttccatctaaaaacactcccatcatcccttaacaaactgatgacaacataattgttttctatcaaatgaatcctgaaatagtataaaacatacaaaaattcagtctgtttcatggagcatacaccttcaaaattcttttcaggcttatttttgtcactaaataaaaatcaatcacttgaaagcatacgtctctgatttctatcccttgtcttataggcaggtgtctctatttccaagtcagcattcattatgcacttagctaatatttattgaacctctgtgttctgttggtagttatgagtgtgatgcaggggtggctgggatatcaggtgtcctctttgagggtttctctccagggtagacgggaagcctcattgcatccagggtacagaaaggtgtgacagattccccaagacacgggctgcactttggggcactgtggaactcacaggtgagcccctccctgtgctcaggggcatcaggttgtccttcaggggccagcaggtaaaacggactctgagagcagaggcctgctaagaaggaagtgggggtgtgggcagtcaggaagtcatggcttctgtttgagtaaagcctgatgaaccacactccttacccagggttagaggaacgtctatgggaccagctgtcaaattaaaagcataagtcacacattctatttccagagcccacaaggaggaaaaactgagacttcctagacatgaatttcatttctgacaggcttctctcctgctacatacatgcacattatctacacacatgcacatgtatgtagatagcgtggcaagtgcatgcacacacaattctgcacacacacctcctcctgcactcaaggtttctggtctccatacaaagatgggaagatttggggctcagggattttgatcaaaccctcggtaaagcagaaaccacctctgttgtacttctagttttctgtttcagggcccaagaaagtccatttcaagggccttatgtgtaattcacagttttgttggagtccccttctaggtagacaaaacagaggaacctttcttagactggatctcagttcagccatcccaggggctaccctctcacctcaaactcaacagaagatcaggaatctgggggtagcatgggccacgtgtcttccctctcaacaccgcggtaccctggagcaggggttcccaacccccccagccacagactggtatcggtccatggcctattaggaaccaggctgcacagcagcaggggagcagcgagtgagcaagcaaagcctcatgtgtatttacagctgctcccatcgctggcattaccaccagagctccgccccctgtcagatcagcggctgcattagattctcgtaatagcacgaaccctattgtgagctgtgcccgcgaggcatctaggttacacacgccttatgagaatctaatgcctgatgatctgtccctgtctcccatcacccccggataggaccgtaattgcaggaaaacaagctcaaggctcccactgattctacgtgatggtgagttgtataattatttcattctgtattacaatgtaataatcatagaaataaagggcacaataaatggaatgcacttgaatcatcctgaaaccatccccccgacattggtagaaaaactgtcttctgtgaaaccagtccctgtgccaaaaaggctgggaccactgccctgaagcactcaggagacacctgcatgccactcaggtctctgcaggaaatgacgctggaccggcggttctaccgagagacttcctgtcttagttggccccatttatcctctgacggtttcccacatacatggcttctcacactctattcttctcatggacatattcgtgccacttgcagttccacatttcactgcttttcagattgatgtgttaccggagaattattcttctatctattattattataacattcaccataatcatcattagcccattaactcataactattactatcattgctaatataatgactgttaactaaatatgaataatgtatgctatcactaatataattactattattaactatattccatctcacataatctatctcagctgcttcatctccctctgcctcctttcaccttccccctgcctgatgttacaaactgaacaacttagagttccttgaatattccatgagcccggcttctcccccaggccataatgagggtatgtcagtgtgcagtgcacaattagttcctctgccaaggcaagatctggggtgcatggccggccttgcagcccgtgtgggtgtcccagtcttgctcttgctctttaagtcaggtgtttgcctctgctgctgccatgggaaccatctactgctgcaggtcaggcatcagaaaagttgtgtgtcctgccctacacccgtcaagtgacgacagatgacaattggaggggaaggagaggaggtcagaggaactggagttgcactcgtaccctccctggtgaactgaaagagcaccctccctggtgaactgaaagatagacaatatccataatgtcgaggcattgaccaaaatcttaccacgtgttttgtgctccatagaatctatttcaatggagcaccggctcttagagcgcttaaagattctgctttattaactgactccatgttgctctactgggccctgtggagtagttaacagctgttagcttgaaagaacgtatggttttgttgggaactgtaaggtgtaattaattcattaggacctgctacatgtcagaggctgcgtgagacaccgggctgcactcatacctcacgtctcagacacagacttggacctcagggaggtcacatccctctgaggaagagaccagcaaaacaccaatcagatgtgaccagtggcactggccactagagtaagcacctgggctctggggtcacagcagagggggcaccaccagctctgggaaggctttagggagtggatggcaattagaactttcaggatgaaaggatgtggttcagaggactgggggagagggcagcacagacagacgaagccacgtgcaggggcactgagacagctcaggaatggcggtgagttcacccccaccgggtcgtgtccgggaaaatgatggagagcagcactgaggatcagcaggggaagatcacgctgtgcatcctgagtcttctgggcttcatgctgtgggtcggggtgattcgttgaaagatcttagcctaggggtgttttaggaagatggcacaggctgcagcatgtagaccaatctgaaggaaagatttgcagtcttgcaggtgagatgtcattaggccttggactgagacaggagtggtaagaggggaacatacttgggagtctggggggaaggtcaaggtcaaggtcagcgggatttatgacatggtcatctacggggagaaagagccagggagtagcttctaagactgtgtttctagctggagtgactagaggagtgagggtgatcttttcagagctcaggagtatgtaaggaacagattaaggtgggagggcaggaaaaaagacaaaacagaagttctgcttggattcgttgcattctagctgccaagatggaactatccggaggcaaggcggcacttaaactgcaagctggggctgcaggtggagattcgggagtgactgttttaggattaatttctaatggcctcagataagatgacccagggtaaagggagactatgcagagggggagcagtgagagtgaagaggaggataaataacaatagatggcattgcatgggacataaagtgactgctcggaggttatttacgggaagatggatctcgcaattgagtgctgaagaaggcatttggtaacaactggagccccttctctgtgccaggagcgggcactgaggggcacaagtgattaaataccacccctgccctcaaatgaaagccaacatagaaacagataaactatagatcaagtttgcaattcctagagttgagatataaactaggtactatgggaacacagagctcatttttcttttttattagatgagcaataagtgttaaatgtagaaaaattagaaaatacagagaaacagaaaggacatatatgtaactcataattctacaacccagacatgtggctatgaacattttcattcatgtctcatacaaataaaaaatacattttttagcaaaatgagatcatacagcacacactgttttgtaaacatttttacttcatattttattatttctgtagtattaactatgttatcattttcaataactgcctagtttctttttttagcaaatgtatcataatttattaacctgtctccatcattggacatttagattggttcctggctttcaccacattagacggaatggcaaatattcttgtagctacatatatgcaaacatcaacattatttctttacaataaattcccagaagtggaattgttgtgttacacgatgttctagttaagctctttagctataagaactagacctctcttctctatagacttgctagctccagcttaaaagtagagggaggggatttttatgaacaaaaggaaatgagggaatctaaaggcgccaagaagctgattcctgcaggcctgttgagagactagaaattaaaactccccgggccaggcacggtggctcatgcctgtaatcccagcactttgggaggccgaggcaggaggatcacttgagcccaggagctcaagagcagcctgggcaatattaccagaccccatctctataaaaataaaaaaaatcaggtggacatggtggtgcgtgcctgtggtcccagcttcttgggaggctgaggtgggaggatcacctgagcccaggaggtcaaggctgtggtgaaccgagatcacaccagtgcactccagcctgggcaacagagttaggccctgtctccaaaataagtaaataagcaatgaagctccctggattccagcccctgttactcaggagccgcagggcctctcacccatgctcctctgtgcctctctgccacccttctcttctttaccagcctggtttgcttacttcttttgccataagactcaattttatgtcatggcccctcagcttcagtggctgacggtagtctctgccttttagttaagacgccggagaaggtgagtctgattggcagattcccaccagtcctgagttctggccagctaagctcgggcagccatggatctgggggctgggagcaggattcagtcgggatgtgctggagcccacttaccccagctagtgagagctgaccctgggcacctcctcccagctccaagttcactgacgtcatattgggagcttgaaatcggctgtgccggatttacttacagcaagaaaaccagtaagtgctgagtcagggctggtcgtgagatgttcctccgaataccactgggtgtcacatggaacaaaactctctgactccttgagaaatgagtatggccagtgactgacatctttagaatatttctgaaacaatgtaatctcattaacattccgtagatgttacttcattctgttattgtgtttaatgtcccagagaagaaatctagttttgggattttcatttcttttctttagattgatatgttgttttatctgtctgcactcttgtcagtttgatttgcttacaaagcgtgcacgttttactgggctgcaactgtggtggggcgctccctttgctggttctcagtaagtccattttatttgaagatgcaaatctttttccaagtcggggaagtttttccacgttgttaatttgattaatgtgtttctttcacttacagtgtattcaccttctggaattcctactgtgcttatatttgatcttttgggtcaatcttccattttgcttatcttttcctcatcatagctaacttaatctattttctttgaattctggagaaaactcttgattccagccaggttcactgatttgattgtatgcactatccagtctgttctttcgagcttctgttgcattgttaattttggcaattgtattctcatctgaaagtagtcttttctgatctcagatgattccattttcatatttacagtgtgttattgactcctctcaatgagttatttgattcagattctctggttgatctcaagcagtgtaattcagaaatttcttaaatgttctgtttcataagggtgatatttctttatgttctttaaattgatcccattattatggacttttttttttattatgagctttattatcagggctacttcacttttattttgccacattaatgaatgtgcaggctgtattgagagcctacagttcactgcaattgaatgaagggaggtttgttacggggctaaaggaattcctttccctgtttgttttaataatcgagaagttgcccgggctctactcttctctcaccagcacttagtgtgctcaagaggttctctcaatggagcccgggactggcagtgtgggcatcccctgagtacctgccagaaatgcccggtccagaggcaccagctcagaaactctggtatggggcctgggaatgtgtgtcttcacaagtcctccaggttggtgccatcaaagtttgggaagtgcctatttgctcaccactgggcttccagccacagcaagggtgagccaggtccaagttcacgtttagtcccctcatggcaacatctgtgcactttcacgaggcatttgcagatttgcccagcctgtacctcagccctcaagctgctcctacccggaattctgacctctgtggagtttgcagggttcctcaggggttcctttcacttcgtgtccaggtggacttgtcttttgcgggtggggaatttcaggttgggcagcctctcccttagacagggcttgctcatgctgtcctgcaggagctccagtgtgggtggtcgtgattttgattctcagcagaaatgcagactatttccctactattttttctttggatatttctatagagatttaggaagaggtgcagaatgggaggctcaaatcacctggaggcagaaattcctctttttttttttttggatgacctaagggagatttacagagtaaaggggacgctgttgtaaccatccaggtggggatgaggagggtctggcattggggatggggaaaaggtggactcctgagtatttctgagatccagtggatcagcctgaggagcagttgcgtggaaggagaggatgagttaggatggctcagttcattcagttacagtgaactgtaggctctcattttctagcgcagctgccctgatgacttcttggaagacatcaaattgtgtttgacttgggcagaaggatggcactggatgagtgaatggatggggtggccattcccaaccacagctgagcacgtcgtggtgacggggtgtgatctcccccacccctgctgcacccagagctgtcctggtcacatgcacattcactgtcagacgacaaacagggagaatgaccgatgctgccaggaattctgtttgggtctcgtacgttatcatctgttaccagtgacagtagtgtttgggacatttcgccagcttcccggagaaacagccctttttcctcggcctcccggcacctgcagtccgtccgtagctttcccacaacccatccctcagagagttctggcatgctaattttcaggtttaccaagtggcatgaaagatactaatgaatttctttacccgtcgccctcctcctagctgtcatagctcttcccacttgaagtgtttgttttccttgttcctgtgtgtgtgtgacagaggtgaggggtctgctgccttcatggtggacgactcacttgtctggtgcttcaagcctggggtctgccttcctaataatggccactgtcattttcccccagctggaggcctgaggacatcagcttaagcctctccagggctctgggacctgcaaggtccagactcttaatgtgattcttgacaactgatttgtcagctcattttccccttttctcaatgtcctgttgtagctcagtctgtctgcttgtcctcagcgtgtaataaaacaaccccagacaccccactccaggaaccagggccccagagctgtcccacagcctagtttaggactgaagccccagatggcaccccctgccattgggaactctaaggagactgaacaggaagaaacacagagcacatcttccaggaagaacctttgataagctgagaactctttgccctttatttaaaaagtaaaaagaagcgaggaggagaagctgcgtagaagccctgccctctgagtttgcttagaaaaagcacattcaagtttgcatttaggaatcgcagtcagtgacgcatgcttgggttccctgctcaagctgttagggcaaaagcgacggcgtttctaccctcatcaggagagactgcctctatgaatctctcgtcgccaaactaagcagttttaatccagatacagagtggagacagatgaacgcatgcaggatgcttctccagagacggcgtgttctcgctgttgtcagccatccagacagggtgctcagagggcagccttggggcaccctgcagtgggcaggcagcatgaggcacacggatccttccttctcttttcagctgaagaaatgctaaagagaagtttgtaaaattcagagcctcatctcagagggaaagatgagttaatgatctgctgcagaaggacttggcaggtgcgtgctccagccggctgagaagacacccacgcagccctcccaccatgctgaaaaacatagggtcagccattggcactcccccttttcccattgatgaaacggaaattatcttttggaattgtgctgttaacaatactctgtattgccacaagtaggtttttgcaatatgttgaacaaacgtgttatcccttttcaggtcctaaagtaaagagggtctcaggagggtgtaagggcagcacgtgagagtgtggcctgtgaggaggatgttgagtgacttcagggaaatcagtgtcacctatgcagagtcacaagctggctttcctagtcttccagcacctggataaatccctttttgtgcaacaagcactgatggagtctacagaagcatgcattcccgtgggaagggcatggctttggtgctgagcctctagatggtacagacaggcatcagggaccctttggccactcatttaaaccctcagccagaaggaatgaaatcactggggctgtcatgagcaatgaaaatgacaatctgcactttatagacacttagcatagtgtctggcatacagtaggcacccaacataccttgagtctgttatgttttgtctatcagctgttacatttgtttctattgtcttttctccagttttctctgggattggttagagtgaaacgtcatgaaattgtttttattttattttaaagacaggatctcgctctttcacccagtctggagtgcagtggtgtgatctcggcccactgcagccctgacttctttgggcgcaggtgatccttctgcctcaggctccccaggctggtctcgaactcctgggctcaagctgtctgcccaccttggccttctacagtgctgggattgcaggtgtgagccaccgtgaggtcctgttttgattttagactcatcccttaaagcccaggctgtcacataccagccaccactttctacgactccgtaaggcacggtggttcagaacacaggctgtggcatctgcagacctggctttgtgttcaggctcaaccacttagcaactgtgtgacccaggccacatcaggcttcttacctgtaaaacaggaaccacaggccttttgcatttaggggcaagggtaggcagatgccacatttccagcaggacttatgggacatgaacttaataaaagtctgctccagtagcctgagcacctttagggcttaacttgggggcccgtcaatgcctccaccgcgctctcagccacagaggaattcctgaactgtccaccagtggggttccgttatttcctgtgatgggcaggtagggctgacactctgttctccagtgtagatttcatagtttggatttgggcggcccagaaatagcctgcgagatcttactgaaccaggtctgacgtcatcacactaaatggaaaaaagttaggaacgtgctggtattccagaattcttttcttaaaaaagtaacgttccaaagcaaccatattgctaattgaaatagaattttttttttaaattcaggaaatgttgggccctttagtttccctcctatttttcattaggtattttggagcatttcatttattgagcacctaccgtgtgctggctgctgtgttatatgcatcgtacatattttgttctcacaacaactctggaaaataagcataaccccttttctcctgtagtaaaggggaacttggaaggaaacagaagcctgccagggtcagagagctcatgggcagccaaggcaggacttagacttcacagtcagaggcctcaaagcctgcgcttctcccgtgacactgtcatttcagagggtgatggtccaccatggctgaagaccaaattcagccaacagctgctgcagccaagagtccatctgtctcctctgacactgtcatgtccaacctgtttgcctgaacatactttggccactttggagtattctgctcagaagtaaaaataatgtcgtcaaatttcataaatagatttctgaggtatatacttctccgcaggaacctggctcacttactgtctttagataatggaaatcgtggttgcaactgaggttctttcctaagttaacaaatggttgttcctcaccgcagaactacaggaatgacccttacaaatgagcagattctttgttttctcttgattgctggcagcagctgctgtgggtgctcagtagaggaatgtttagtgagagaaactgagctagtgttgcagcagaggaaaaacactaggaaattgacgacttatctttccatttgcaccttcagaaataggttaattgtttcagtgactgcctctgtcttgattaggaagcattaatagcaattaatgatataacttcaaaaaaggtataggaaaattaatagaattctccgttaatataaattatactcattatctactgtatccagaaccatcaggcctgccaagctcgttgattaaagtacaagtggagttttttcggtctgaattctctagatagttaaacctttatttatttatttattttgcagtataaaattccccacagtgagccaatagtattatttagtttaaaatccctcaattctacaacttagaaacctttcataagttaattttattaatgtacacacattttatctacacgtacaaatattatttgatggtaatgatgaaactttgttaataaaggatggtgaagaaaagttcaggtcaaaaaaatatgaaattgtaggactgattttatctagctttaattctactctgcagtagaaacagaaggcttttttggtaggcagacgccacatttccagcaggacttgtgggacttgaactcaataaaagtttttttttggggggggtgggtggaatgccaataatggtaagaataacaatagcaacaatgatagcaaaggcaataaccaacatcccctaatctgcccctaggaccaggttcagtacctcacatgcattctcactaatcttcacacttacaggaatcttcaaggtagagggtgttaccccgctttacagatgaggaaactaagtcccagaggtggtcaggaactggctcaaattcagacagcaaagtggcagagctgagagtcatgcccaggtggggaaaccccacgcgtgcattctgtcactcggctgaactgcagcacagccctgggcttattttaagaacataaaacctgtctcactagacccaactctctgccctgttccttattctttctcagtgtcaccagaggacacatcagacacagttagccttccccatgtcaactctagatggagaggaatgcccctcgaaggagtctaggctgcctcaggattttactatgggtgggaaaccaatgcatttgtccttgcccttggttaaacggttatctgaagttggcttatattcatcctcttaccatccttaacagcaagcttgccgccaaattccgtcactgattattttgacttgatgaagcgttgctcttgatctacagattcctcggtgtgttgtggactttgatcgcttggccagctgtaatctgccagcttgaacacgattgatcttcatgcaccaggcactcacacctgcccatttggcggggttgcttatgtctttctcacaccttctagcttgttctttcttttctggagatccaacaatcagaaaagcattccgtatttattccttaacttataaggaacctataaatagggctcctgtgtttcttttcttttccccaagactgtgtttgaaggttaatttcaggattttcttggcatccttaaagcggtgggactgttctaaactcctttgaacaaaatgttgattgaagtgttatcttttgtaatatactcctggagggttgtagggatttggaggaaaggtcagagtgatagggagtgttttggaggaggtgagatttgatccagcccttgaaggatggtggggtttgtggtgctagatggctgatgaggtcatttgtagataggtggagaggtgtattagctggttttgcgttgatagaaaggaatacctgaggctggtaatttataaggaagctggctcacagtcatgcaggctgttcatggtgccagcattgctcagcttctcttgaggcctcaggaagcttttacccatgatgggaggtgaggggagccggcgtgtcacgttcctgaaagcatggtgtttttattttttatttatttattttctttacctaattggtaaacaggtgaatgcagttctacttggagactcagcccacccagcacagaacttctcacactgaatgagaaggcgctgaggtgatgtatgtgtaacccaggcagctcgttaacatttaggtcctgattcgatgggtctggagtgacacccactgagacttcgcctttataaccagctcctaggagaggtctgtggtgctggttgttgctccactttcaggaacaaggagctgagtaactcaccacgtgctggaaaacatgcccttttcttcgaataactcagaactagactcccagagcatggccagagccctggcttcacctgggtgtggagtggaaatgcagggtcttgattccaccccagccctgccgaggcagaatctgcacttgaacaggatccccagctgaatcacgtacacacacaagtttgagaagcactgacatggaagaggcaggtctcaagaataccagtaaagccagacgtggcttccagtaatgaaagatacaggtctcaagaacagcagtaaagccagatgtggtttccagtgctcagagactgaaaatcctggcatcaaattaagctaattcgtaagtgggttgaaattaattaatcagaaaggacaaaatacaaaaaaattagccacgcatggtggcacacacctgtaatcccagctacttgggaggctgaggcaagagaatcacttaaaactgggaggcggaggttgcagtgagctgagatcgcaccacttcactccagcctgggtgacagagtgacactctgtctcaccgaaaagaaaagaaaagaaaaaagaaaagtctctctgagtaaaataagagttgtactaggtttggaacaagaaaagatatttataaatgcatttaagatttgtattttcagcatcagttagaacatcttatctatagccatttcttagaaaagtctagttgtaaaagaacagtgatttttgcacatcttgctgaattatttttatttatgtaaataatagcagatggacatgtataatcatttcttttctaaataagtgtgcataaaaatgaagacattggagagcacttctaatccgagagacgttataaggattcagccaaagacaggatccttggggcttcggttcctaaccagaggggcaccccatggacgagcagatcaacccattttaattttttcatgtcttaagtaaaaccagagcttctcaaatgagaaattcacaaccaaacacttaaaagtggtagtacccagaatggaagaaatattctatcagtctggggcattttctttcctcacatattcctaccctaagtgcaaatgttcatacaactatattgatgaacacttcctctgccatggttttagatgatcaatttcttatttgtgtcatctttgagaatgacagactctgaggttcaaaaccttatggggcttctatcctaaccaacatcaaggaactataagtattcaacgtcccaaaacaataaagagtaagtaaacaactgcgtagctaaccaagtccctcctttgttctggaagaataattttgcgggaaatccttgctttctattcaggcatgtggggtacaccctaagctccttaaactccccgccatcttcctcagtgatatttgctcagcatccctaggttgattggtctatgctgtggatttgagctatgctggttaccaaagtgcctagtttttttctctttccctctccgtgccgacttatggggcgttttacttcttatgtatgagtttttccataggttgaacagagaccaagtgaaatttttaaagaaacaaatgacgctctcctattagaagctttgggagaggtttggtagaagtgcctattgtaattgacttgccataattacttttggattttctataaatttgctatacagctgttattcatgctgggcatcaccctgctttaaaacggcatgagttgctgggtgcctgaaccactcttactgttcattggtttggattgatagtttgcacagtccagatttgctgagtaatcattgacctgccacgtttttaataggcccacactgaccagcttggttcttaatatatttgaacaatcacataaatggaattaggacttcattttttattcacctgccttccagtctatgtgaacagactacttatgtttctagcagcagtagctcccccctcactaatgcttgtgataatatgcccgtaagtgagtatcttaggagggatcttagctgtgcttttgtgcacttcactccacacatacagcctccgcctggtgctccctccctctctctgtcgtcaactttagatttattgtcagtgttgattttcaaccaaaatatagatgagattgtgttgacatttaggaaaaaaaccttgcttcgtagcagattgagtagagaaccagttggtttaaatagataaccttgggtcatatcagaaaatgccttgttctagcagagtactctattcttgcaccgtgggactgactttattcatttaaaggaagctggggcagacgggaaaagaaatattttcttctctgaagacttcctgatttgtttgtacctctgttgtgacacccaagggtaagtctgatatagcggtttctaacaaaatgaaaagagatgggaaaacagaagaggaaattcctctccagttgtgaattatcgttcttcactatcaaagcatccctgtgcctggctcgttctgtggccttgttttctctgctcctggtccaaaacaatgacccacccattcccagagatagacaggagagaacaatgtgtacacaaaagagagggacagagagacccccaaaagaagccaacacccacctctgtctcacctgtgtgttcagatagggtgtggccgattgtgctgagcctgattatttacgcttctcagaatcagggctctccactcaggacagtgaatccccaaagaggctgagcccagaacctgccctgggggcagctggtgccaccgtgctggtagacgacacagcccagccaaagccacctggagatgagggtagcacaaatcctctctccatcctccgcatcctccggcgggaaatgctcctggatctttttttttttttttttttttttttgagacaggctggagtacagtggcttgatcatagctcactacagccttgacctcctgggctcaagtgatcctcctgtctcagactcctgagtagctgggactacaggcttgcaccaccactcccagctaatttaaaaaaaatgtttctagatacagagttttaccatgttgccatggctggtctcaaacttctgggctcaagtaatcttcctgcctcagcctcccataatgctgggattacaggtgtgagccgctgcacccagctgatcctggtgttcggacacgggatgctgttccattcctggagctgttttggaatgaacgctatcaaaggatgtggttagcttcagttgtttactgctcctcatcattttggaacattgagtagtctgtcacttgatgttggttaggatagaacccctgcaagattttcttcctcagagttcatgctcctcaaacttgaaataaacaagacactgattatctaaaagcatggcagaggaagtgttcattgatatatttgtataaacctttgcatttaaggtgggaatacgtgagaaaaaaagtgccctatgactgataaaaatatttcttctgttccaggtactactgcctttcagcatttggttgtgaatttctaacttgagaaggtctggttttacttaagatatgaaaaaataaaaaggggggtgacctgttggtccatggagtgccctttgtggttagaaactgaagccctaagaaacctgtctctcaaaaggttggcgcttggttctgtgtgtttttcccatggctaggggaaggtgtggaagagaaagctttctgtttggtgttgttcctgttaagaaagtcttcaaaatgtaacaaacagtcctgggggcattcaccagccgcacggcatccaggcaggcctctttgtaactagacggtgaatttaccttctgcctgaatagcggtaatttctactctgtgagttgaacagtggtatctgtagcaagagaaaataacttcaatttagtcaggttttctaaagatcttccttgtattttaaggaggggccataattgtgaatttcaagatacactttctgaacagactgtgacccccttccctcttatttatctccttttttctttctctcctgtgttcaaaccatttgttaagacaattttctgttttctccagggactggggattgaatgtctttgttcttggtttatctattaaagacacttttctagttacagatactgtttgtgaatcacaggctatgcaaagaacatctgattatcagcggactggagcccagcaaacagtcacaaacatcccagagctttcctgcctttctgaaaatgtgcatgcaaaattcttgacatgaggaagttgtaggaacaggtgttgatgtctatttggaaagtgtaaagttacacttatgcaattttagcaaacatctattaggcacttactgtttgccagatgctctgaagcatgcagggatccacaagtatcacgtgccttccaggaatttgcaaggagtggggccgataagcacgtgtccaaatgcgcaaggctgaaagagatgggctcttgtcctactttccccagaagtagagcctgtgagctcaacaaagatgtacgtgcaatagtgcactgagcggtgaccccagaaagtgtgagtagaggagtgtgcaaaggacacagcatggaaaggcactggtgagctctcatcagtgagcattcatcagtgtggtgagcagcgaggttcagccccgaggcaaccccagggagactgtgcaaagccccttcggtgttgcttacccaaggaggggaggaagcctggatatttatgcatcaactcccctcttgtattggcaagaacaactttgagagcattcttttctgtctgtctgcctcacctttgtaagccggtcatatctctggccacagaatggcctttggtaggaactgatgggtacttgcaaaaagccctgggcctgttggtgaatggtgagtgccagggacgatgggcagggcacaggcagcacctgccacaaagccatattaacagagtgtagcaggtgcaccccacacctgacaccgtgtacaaagcttaatgcaaaatgggtcaaaaacctaaatgtgagacctagaactataaaactcctagaagaaaactttatgacattagatttaggaatgatattgataacactaaaagcacaggcaacaaaagaaaaaatcaaaattgaaaactcttctgtatcaaaggacactgtcaacagagtgaaaaggcaacctgtggaatgggaggaagtatttgcaaatcacatatataataagggattaaaatcgagactatacacagaattcctacaactcaacaacagaaaaaataagctgatttaaaaatgggcaaagaactggaataggcatttctccaaagaagagatacaaatgactggtaagcacatgaaaaaatactcaacatcactaatcatgagggaaatgcaaattaaaaccacaatgaaagaccaccccactccctttaggatggctgtaattcaaaacagaaaacacaacaaaaacagaaagtaacaagtgttggcaaggatgtggagaaactggaacgcttaggtactgctaggagaaatgtatgacgaagtagcctttggaaaacagcatggtagttcctccaaaaattaaacgtcaggttaccgtatggtctagcaattccacttctggatatatacccaaaagagctgaaagcagagagttgaacagatgtttgtatgcctgtttatagcagcactattcatgctaattagaaggtgagaacaatccaagtgttcatggacacatcagtggataaactcaatagagtccacccacacagtggaatacgattcattcttgaaaaggaaggacattctgacacatgctgtatcaatgaaccttggggatgttatggtaagtgaattaaggcagtcagcagaagacaaatactttgtgattccacttccatgagttatctagaatcaagttcacagagacagaaagtaggatggtgggtgccaggggctggggaggaggaagtggggagtgagtgtttaatggggtgcagagtttcagtttgggaaaataaaagtgttttgggccgggcacggtggctcacgcctgtaatcccagcactttgggaggccgaggcaggcggatcacaaggtcaggagatcgagaacatcctggctaacacggtgaaaccccatctgtactaaaaatagaaaaaaaaaattagccaggcatggtggcaggtgcctatagtcccagctactcgggaggctgaggcaggagaaacacgtgaacccgtgaggtggaggttgcaatgaccctagatcacgccacagcactccagcctgtgtgacagagcaagactccatctcaaaaaaaaaaaaaaattttggagatgtatagtggtgatggctacatcacagcttgagcgtccttaacgccaatgaactgttcacttagaaatggttaaggtggtattttatgttttgtgtatttaaccccaatggggggaaaaaaagaagtataccaaagtacaaagaggaaaggccactttaatcaagggtactgggaagcctgcctggaggaggcgctgtgtcctctgggccctgctggatgggtgggatttcaggaggcagcagtaggggtggggacgagttaggaatggagagagctgttacaggtggggacactcaggtccgaggagggcagaggggaatgtttcagagaatgccacacggtcaggtgtagccgaagctcaggaatgttggaactcggagaggctgtgaaagagaagccctggctgcctggccatgatcatcatgtgcctggtcttgactggcatgtcaagaatactgtccgtgcagtggcgtgtgccccaggagcacggcagttctcaacaagactgcaccgagatctggagatgaaacttctcagctctcttacatttggccatgcggaggtctacccaggaaggacagccttgtcccaaggacctcactctgttcactcaacaggtatttatgaggcccctatgacatgtcaggcattgttctaggccctgggaatgtgggcagaacagggcagatgaaaatgcctgtgctcatggtcatgcgttccagtgggggagagacagacatgaacaaaaccagcacaagtcattcttcagatggagctgagaaccacggggaagaccaaaggccatgcggcagaaccacccagcctgcagaggcgggatcatcagggcagtgtcctcaccgctcttcttaaacactgggcttaacaggaggcttttgtggacattaaaaacaaaatcgcaggtccgtttggatccctccattccaaggtttaaacacaatggtgttcgctggacggatctaagaatcttagccactctgcctagcagcctctcaatgttttgtgtctctcgtttcaactttgaaaagagctttgtgccagggagctcctgcagtttgggtcgaggaggaccaaggcttcaaaggcccctgcccgcgcgtcctgcaggttcccattgtccgtgttaatagcctcagatgggcatcagttgccctgatgggcttgggctccacgcccgggcttgcatgtttggcaaaattactcaagagcatttcttttttttttctttgagacagagtctcactctgtcgcccagactggagtgcagtgacgtaatctcggctcactgcaacctccgcctcccatgttcaagcagttctcctgtctcagccttctgagtaactgggattacaggcacctaccaccacgcccggctaattttgtatatttagtagaaacgggatttcaccatgttgcccacactggtcttgaactcctgacctcaggcgatccacctgccttgacctcccaaagtgctgggattacaggcataagctaccgcacctggcttccaggccatttcttatcacagctaaaagtgatctgttacgtggctggttacattctcagcaactttagaattctattcagaagtggacctaatcttgagacaaataccctcttaccccttggtccactgaaaagacttatgatcccagtctttctattggtgatggttcttctattcagtgggagattatgcatttatgtgtttggatagaaattagatcctcagcctggcacggtggctcatgcctgtaatcccagcactttgggaggccgaggcgggaggatcacaaggtcaggagatcgtgactaacctggcgaacacggtgaaaccctgtctctactaaaaatacaaaaacaaaattagccgggcgtggtggcaggcaccagtagtcccagctacttgggaggctgaggcaggagaatggcgtgaacctgggaggcggagcttgcagtgagccaagatcgcgacactgcactccagcctgggcgacagagtgagactccgtctcaaaaaaaaaaaaaaagagatcctcagctgttgtttcttgaatcagatatttggatcactctagcatccaatcatgcagctcctaaatatgctcctaaatcatgcaggtccaatcacgcacctgttttacggtttatcaatttgtgctcatcctgaactaaataaacaaatccatgagccaactgcagcactgtcttttatcaccttcgtttttctctgcccagtaaaaagctgaagaagatacattctttgttaccttccattcatttccaaatgtgtaacttttcaaatatgttataaatgagaagaaaagaaactgctggattgtcaaactgtcattttatttatcgtctctcgtcagtagaaaagtccagaagcagtgcgttgagatgaaaatgaaggtgcgtgaaagagagaattggaaatgggatatacgaccgtatttcctctctttccctttccctccctcctgctgggcaggaaacgagaagaacctagtcagcggggaatacctgtctccagggaattttttgggattagatcttttggggttgggtttgtgagggggcctgccctgtccccacacatgtgattcctctcactgcacaatcctgatgcctttggcattcgtgattgccttctggatgatgaactataaaggaggcagctcttaaaagaatagaaaatgtcttccagacacaacaaaatatacactcagaaatgtataaaccagcttcccacgtccaggggctgggccagtacagattaagaaggtgaacgtgtggaaggtaaagggtgggaggaattttctatttcgtgaacttgtttttttcttgttagaaaggaaatcacagtgtatttcagtttccacaataaagtgcatctcagaattgcccaggttctgccacaagagacttacctcttggtgggctggggatgacctggatctccctgctgcctgcacgtctttcactttggacattttaagaaaaaaataataatgtatctgggttcttggagatatatacatatatatgtgtatgtatatctgagtctctttaaaaataggtatcccgggagcagagccacagcctgagctatccagatgcctgctccccttggtggaaagagatccgacacacctgttgctctgagatgcttttgcagacaggaaagctcttaattcctttgctaggccattttaacaatgcagagaaaggtgacagtcttcacgtagtcccaaaggcaattaataagcaaaaaacttacctgattttaagtgaagtgtcacggagctgtcttcacccagcccatgaaaaaccaccagtgcaccttgagacgcgtaggcaatgttcaaggccaggaaagactcaccagttcctgtgcttcccattgtcagaaagcaggtggaggatggccggagccaccctggctgcagaaactgacctacagaacttctcattgtcagaaagcaggtggaggatggccggagccaccctggctgcagaaactgacctacagaacttctcattgtcagaaagcaggtggaggatggccggagccaccctggctgcagaaactgacctacagaactgaacagaatagtgattcaagttggatatttagaatatctaaacgtgctttgcgggacagtgaaaccctgcttggtggaggtcaggacttctgcttctgtatagctctgcattccttagccaccgtcctgcaaggcaaacgcgaaaacgcatcttaaaactcgagcagaagtagccttggttgtatgcctgaaaatgcctgttcgtttggaaaaagacaatagcttcccgttttatggcatcttcttcttccttcccagccctggccatcgttctcactgtcctcagcggactccctgggcctcctctttaaaggtcagtgctgaccgggtgtggtggctcacgcctgtaatcccagcactttgggaggctgaggcactttgggagaccagcctgggcaacacgatgaaaccccgtctactaaaaatacaaaaaatagccgggtgtcgtggcaggcgcctgtaatcccagctactccggaggctgaggcagaagaatcacttgaacctgggaggtggaggttgcagtgagccgagatcatgccgctgcactccagcctgggtgacaaaaataataataataatagtaaattaattaaaaaaataaaggtcagtgctccctggcttctctgcaggccatctcctgtgctcactcctcacactctcatggagtggcctcttgatctcctactttcaatcaccgcccatgtaccccctgaacctgcgcacctgggtaccccgcaggcacgtcttaggaagcttgggcagcttctgcagaacgccttcccttctccctcctgacccaccagcactgccactcccagacccccgtctgtctcctgagctttctcccttataagctgcccagccacccaccaagcagctcaagcgagaaacctggagagaagcaaggggtcttaggtgcctctgtccctctctcctctccctttgtccccttctgtcatactcacccccgtctttcttcctcctcttagcaacacccttgacccattggactttgcagccttttcccaaaccgtgtggtaggctttggttgtggctccctgaccgtgctcccacccgctctagacagtgtgcaagcctggccatggctttcctccttgacgcccttggctgcctctccattccctgatggatcaagtccacactcctgagtgtggcgctcctgcctcctccgtggccagctgtggccacgcccatgcccccccactgcccctcaaccaccaagaactgcttcctttttcccaaatgggccaaacgggttccctccttttctcctattcctgaaatgcctttccttccattgtctgactgggggatgcctatccatcttccctgctcaaacctttcccaatttctcctggaagaactgacctcaacgccacacccacactccacggcctgccatctcccttctctttggctttcgtagctccgccacaatgtgcttgctctgttcatgtggctgccatcctccaccaaactcgaacctctttgacgaagtggacgttaggcagttcaactttgtatccccagcacctgccaccatgctcctgaaataagaggcagttgttacagttgcagtcatcctgtagcaatcgtgatctgctggtgataaccagccgtggtatatttggacaagacttcattctttttttttttttttttttgagacacagtcttgctctgtcgcccaagctggagtgcagtggcgtgatcttggctcacctcaagctccgcctcccaggttcatgccattctcctgcctcagcctcccgtagctgggactacaggcgcccgccaccatgcccagctaattttttgtatttttagtggagacggggtttcaccgtgttagctaggatggtctcgatctcctgacctcatgatccgcccacccaagcctcccaaagtgctgggattacaggcgtgagccactgcacccggccaagacttcagtcttctctcagcaagtgcttatagtcagactgttgtcatttaggcactttgctgggtacagagataaataagacatgcgtccctccttatttcacatggaccagcccaccagcaggtaatgactctgcagagacggggcagtgtcagaggagcaggggtccccaaggcagcagcttgagagggatcccttcatcttctctccagataaccagttggcaaaattctaaagcatttttctaactgttatcttatctggacaacacgatcaaaaaatactatgataggatgttggaaaaagatttaaaagaagccaaagaacatattgctcaacattgagcttttaaaatagggtctttttccgtgtgtgtgtgtgttttaaaaaaatgttttctcttgtttctacaagttttagaccaattatttttggagcaggaagatactgagttttcagatggtcctgtagacccccttacctgctggttttttggtggaatcctgtttctacaaaaagaaaaccccatagatgtagacacactaaaaaggaaaaccctggagattgtttttaatcttagaatttgtggcacttgtactacggtttttctcgtaacaaagccgcttctcgttggaaatgtctatttatgtggttcatgttgcccatgtccacttggaggttatgcctgagtctcatggctcagggagaatatgactcagcatcttttggttgagggcagctttgacctcattgttttctggtgtggcacagggagcagcctggccacgtgcggggaacggcccatggcctgtccctgttcgagctggctgctgcgaaagtttcaagaggcgtattcgccaggagcactcggctgtgaatccagacacggaagacagtggttttaatagagtaaaccaaaatgtaggatttgctctctccgatattctggaaaatcccactgctttagggcatagacttttcctgaaaatagaaggctgtgttttttaatgaggtgctgagatctttgtaacaaaagtgggggagcaactgtgctcagagccctgagggcaggatgttccctctgagctgtggccggacttcccgccttcccaccaggctcaaggttcagcagccaccttggcctctgcctccccgtcccctcccttctttccccttctccccccacttcctcctcctccgtcctccccatttgtgcttcagggtcttgcatattctggtctccctgcctggaaagctgtgtgcccagctgcctacagggctgcttcctttcctctcctccttcagagcggagtccatttcccccaccccacccctgcctcctggttgtgttcctagcgcggaggctccctgaccagctcttgctcattcgaccgctccccaacccggcgcacggtgcggggctgccgtggaaggggcgttttccattcatccgactttatttgcagtgactccacagcttagcagttcgggttaactttgaactttattttttttctgtttcagagacttgatattctttaaatgtactttttaattaaatgcgacctagacagcttctccctcctcagcctcttctatgagtaaagaggttcatgtgggggaaattgactaggattaggcttcatttccctctgctgcgtgttctttattcctgtaactacaaagaggcgtcatctgaagtgtttgcctttctgcctctgaagctacctggcgcccgttggttgctgacttctgcagaaatcctcctttgactcagtgtcttcacctccagccacctaaaaccagcctgggaaacgttcagttgagaacactactgtaaagtctcaattaaggaagtgcttgagggaaggagtgttctagttaatttttgcttaacagagcacaaccagtgtttttgttaggaggaggcagcattatgtaaaagaaagattatcaactttggatgaagacattccatgatttaaagcttttctctatcacttgaaaccatgtgacttagggcctcaattttctcatctgtaaaagagggataacaatcgttatcttactgggttgtcactatattaaatgggcaacatgtgtaaatcatttaccaagatgttttgtggctgcatggcagcttggcaaaatagaattcctttctctacttttgttttcgttcttggaactgaggccttattcgttggtatatggcattttaaaaatgttttgttaatgtaggacgttgaagtagaaggtaatagtagcggtggctcttaattttagaatctttatgataaattaatcattgagtatttgatgagtgtttattatatctcagatatgcaaataatagaaataaagaggttgtttcattcttttaaaaatgcttagatattctttgcatcttctaaaaattgaacttggaaaaccttttggtagaaaagccatcatggcaggtaaaaaatgtcgaagtccatctgttgacctcttcttgcttacaaaaggagcaaaaaacccactcaaaagcagtaaaagaggaagagacgtaggtccacaatgacaaaaagaaagggagaggagccagtaccgatgaaggatgagaacaaacacccagaaagcaaatctcagagggaggcatcacaaccacctggggagagggcctgagcctgaggacacttggggcagacttggtcatggaggggctggttatgacagagagctattagctactagcatggagggggagccattgctagtttgtataaagaacagtctatgttgtaatcccagctactcaggaggctgaggcaggagaatcacttgagcttcggaggcagagtttgcagtgagctgagattgtgccactgcactccagcctgggtgacaaagtgagactctgtctcaaaaacaaacaacaaaaacagtctacttgtaacccctcaaactgtaagcagaatacttaagctagattaaaaaggtagatgaacagacaaacagaaagttatagataatgaacagccccagagaaaagacatccacactctgggatttagcgtcccttcggaataatagtgagtgtttcactttattaaagtgaagtcgtcagttgacatctcctggttcattcatatgtataaaaggacacagggatcatttgaagaaagcccttcctgtaaaaggtatatcaaattaacaaagagggagaaaaaagatcccagaggaacacaaaacagaacttcagaaagtatttatactctccgagacatttagaaatgtatttcacccatgaaacaagaacaggatgcaatgaaaaatgaacagaggacaaaaagttagtcttgggagtcacaatatggttactgaaaataaacatccaaaagaccagttagaagataaagttgagggccgggcttggtggctcacgcctgtaatcccagcacttcgggaggccaaggcaggcggatcacaaacgaggtcaggagatcgagaccatcctggctaacatggtgaaaccctgtctctactaaaaatacaaaaaataagccaggcgtgatggcaggagcccgtaatcccagctacccaggaggctgaggcaggagaatggtgtgaacctggggagcggagcttgcagtgacctgagatcgtgccactgcactccagcctgggcaacagagcaagactctgtctgtaaaaaaaaaaaaaaaaaaaaaaaaaaaaaaaaaagataaagtttgaggtgctctttccaaaattaaaaaaaggaaaatattggaaaaaagtaagaagcatgttgaatcaatccagagtcctaaaatccaaccaataagagccctagaaagaaaaacacagaaaacagaggggagaaaattatgaaggaactaacgctatcaggtatgcatgtctagagtgaaaggacctttcagttacctagcacaatgtataaacccccctacacttagacacgttttattttatttatttttttgagacagggtcttgctctgttgcccaggctggagtgcagtggtgtgatcatagctcactgcagcctcaacctcctgggctcaagtgatcctcctgcctcagcctcccaagtagatgggaccacaggcacagaccactaaacctggctaataaaaaaattatttttgtagacatggggtttcactatgttgcccaggctggtctcaaactcctgaattgaagtgatcctcccacctcagcgtcctgagtagctgggactacatgtgtgtgccaccacacctgctaattttttttttttcttggatagagacagggttttgccatattgcctaggctcatctcaaactcttgggctcaagagagccactcaccttggcctcccaaagttctgggattacagatgtaagccactaagcctggccaaaaatcattttttacctcattcaagaactttgaagacttactttttttaagttatttaaggatactctagctaagtgaggacatatgccaagaataaggagacagtgaggtccagggaacggcaggtgttacccaagaatgcagcggaggagagtctcagagtgacgagtccacaccaaacaggaaagggaatgtctctgtgtttaaagggagctgggtagattgccttcatgtgggtaaaagagaacagtacaaaaggctataaacagaatgcagccatttttgccactcacaccagaggcgtgcttttctctatttagccctttgtgctaatatttaactccgtgtcttaacaatatgtgtctattgctagttcttgatttgccaattttagacgttacctattgaccttctgctgtgatggatgagctttttacctcatgcctcttcacacatccttctcaaaatatagtccaaacagtatgtgtaggccttttgttatttaccattgtaactctaagatatatacatgagcatgcatgcatgcacacacacacacacgcttctttatttcttgtaaactggaaacagtagcttttcactccctgttgtgtaatgagaagccaccctcacccccaattctcttctgctcttccacctcactccgtcttctgcagtttcatatcgtccaggttaaaaacatttaaattctgtttcctaggcacaattacatctggcattttagactatggattaattctaaagttgaaataaatatacactgtttatatttactatgtaaagattatctactgcacagctagacagtatagagagattatatttctttcttctacagatttttttcaccgggatttctaattgcctttccttttaaaaagaagtatttgcttgtgtgtgtgtgtgtgtgtgtgtgtgtgtgtgtgtgtgtatttttttgtaaacatggggtttcactatgtatatcttttaaaaatacatatatatctatatgtgtatctatatctgttgcttaaaaatatctgtatctatatatctttttaaaatatacacatatatatttatatatatttaaattacacaggtaaataacagaagaagtaaaaatcctgtttgaaagtatcatgaagtggtgtgagctaaaagctcatctgttgtagcagaaagtcaatagataatgtctaaaattggctaaaaacaagacatagcaatagatgcctataatttaaagacatggagctcaaaactaagataaaacactaacagatttaggggagattgccttagggagagggggtatggttttgtttcattttaagcctctctgtaatgttctttttaatttatgtgcacatatgaatttgattgaaatttaaaacaattttttaaaggaagaaaatataccaggatcatgtactacaatgagcactatccttgctattgaaatatctggattcaggtcacgtaatattctactgaaatgtttttgtgcagtctcaacagaaaatgcatagctttgccatcagaagacctatataaccttgaccttgttgtggtggtttccataagtcagattcaccttgcaggtgaccttgtgtgtgtatcaccattgcttttttttttttttttttttttttgagacggagtctcgctctgtcacccaggctggactgcagtgatgccatctcggctcactgcaacctccacctctcgggttccagcgattctcctgcctcagtctcccgagtagctgggactacaagcatgtgccaccacacccagctaatttgtttttttgtatttttagtagagatggggtttcaccgtgttagccaggatggtctcgatctcctgacctcgtgatccacccgtctcggcctcccaaagtgctgggatgacaggcgtgagccaccgcgcccggccaccactgttcttttaaggctgtaggtgaatcaacacgaaggagggcttcctcctcctgtggtggagctgaaccccgtgatggatggatgtgtgcggtgcctgcggcacttggccctgcggggctgcgaactcagccttggggctcatctgtccacagcacagccccttggagtctgccaggagctgagcccccaccagtctggggaggagggactcagtggcccaaggaccattctcctcaggcgtcctccccagtcctgaactcaggcttcctcatctgccaccgtggctgagcagtgattaatgccaaattagcaccctgttcaatgacctttcagcattagccactgcctcccttcacttcacataactatttgcaaatattagcttctccggccgtttctcctcatcagccactttcacagatgacaggcaggccgttagtctgattggcattccattcctgtcctttgccccatcgtgagtgcatccggactctgccatcttctcagaaatctgataaccagcccaggaatgttggcaattttacaaagcgaaggcgtcagcaggaaggtttccggagaagcttcgagggtccgctgcagagttggagagtctagagatggggaaggctgcctcagccccccagggacccagggctgggtgagagtcaccctcacattattcaatcaacatatagattttaaaacattcattacttggctctgtctgcatcaggcttctgtttttcttttagaattcacatgcacgtttaatacaaaaatctcatactgcttaggcagtgcaaggcagagcacagagctgtgggaaatcagagctgatgagaagcccgtcgtctctttcccgttgttctctctccgcggccctcaccccaccgccagccgggcaggctagaacctttcagttgccagaatcctccgctgccgctcacgatggtggcgagtcccttcagcgtgaagcccagatgaagcgttttgcgtttgcagtcatttccatttatttttatttccagcctcttacatctccgccctttattgaaatccctgttctagaaatgttggattggtcttcattttctctaaataaacagtagtaaagtgtactgtgggtagtttaattttgatgttaaatgtattttagagaaaagcggcaaaaaatatgtcctatttttttctcccttgtcaccagaagtacgagataaattatttatagtttgatactcaaaaaacatagattcaggatatttacttttcagaaaggaaaaaaggattgaaactgcagtaacagaactgaaccctttgttaattgaatatattggctccagggaagcatatttggacaggagtaagaatgcccactgctttccagtgacacccatgcctaacgtagtggctgatacatgaaatatttgtggaattgaacagatttggaaatagcaggtagactaggtaactcagtaagcaaactcttaaatcaataaaagaaaaataaagccagcaagcattttggaaaatgccaaacagtttaaataaagcccctcagccacacaacacacagagcagtagcgtaaggcccggtaaccatgcccggtaggacaggctgtggattgtgcctgaggacactggctgtgcttggaccccatctcatgtggtctgagaaaggccagggacagtgaccctgccccagggcttctcatgggagttcaggtaggggccatgaaatttgggtttcctattagcgtgactctgacaatagtcttcatttgtcatgctccgatcatcccatcttctatctgccctttcactttctgtggtttccattaccctccgtcaaccatggtccgaaaataggagagtacagcacagtaagatattttgagagatagagagggaccacattcgcataactttcattacattatgttatcattgttctgtttcattattagttgtagtcagtctcttagtgtgcctgatttacacatttatgacaggtgtgtatgcagagggagaaagtttgaacagatgcccttccactcacaatggggttatgttccaataaacccaccggaagttgaaaatatcggaagtcaaaacgcgcttttgtagccccgttgtaagttgaggactggactgaatgtgtatggcttttgcaccatcataaagttgaaaagccctgcgtggagccatcatacatcagggacaatttgtgtctgtagggattggtactctctttggttttaggtatccccgggggtcttggaacgtgtcccctcagataacggcggggggtgctcctgtacttagagtttcatggacatttctcttttctctgccacaggagatgttggcacacctgaaaccatggccccaaccattgtggttcccccgggcaacagaagtgtggtggctggatccagtgagaccaccttggaatgtatagccagtgccaggtacgaggcgcgtctcctgtgagactcctagtaaatattccatgacctgtgacgagccgacgatagaaggatacactggagcatgaggttcagccttctagcgacagtggtcttgtttggccgggtgggccatgaatacgagatatgggtagataaggaaatggacacactgatgtcttccagagtcccccactgcaacagggcggtgctttcaatgcagctctgggtggtagtggggggctcctctgagatcctctctagggaagagagaggagttgaggcagaggaaaaagttcattgctcttctcctcttagtcagccaaggtgttctctgcctacttagcggtcgctccagaatcaagctcggatgatcccgccttccatgtcgttgtgtcccctcacagtatttattttaaacattcatttcctgagcaaatgggatcattagcacttatggtccattgctgcggcaattagatatccttgcttaatagcccttgagcagaatgcatcgtcaatgcgtgctgggagggagtagagttacatctagattgagttttcagtgtccgttgttcaacccaccatgcaccctggtagcattagcttcgtcaagcctgtgccgagtgcctgagatgatgaccgttgccacctccctgagtcacaatcgtcgtcatgaatgcctttcattcccacaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcataggtaatgcgggagcctctaagtggtgttgccagcatctcagatagcatccgacactgactcttctgcagaaacaaaatagcgtatttcagtggctttatttgtaactcggcaaatgaaggtgaggttgagtttaccttcgaaatccttcctagccttctttcccaagaatataagtccattaaatccaaagtgttgatgttctcaatccttccaagaaacgtccttctgaatactccagtcacaaagctcgggaaatagagcggtgaaacccctgtcatatagatccctctcctattctagctttaggctgctaagcttttctgtaactcttatttggctatcgtgatcggtgttcagaaactattctattattgctgtccaggcatggtggcttatgcctgtaatcccagcactttgggaggccaaggtgggcggatcacttgaggccaggagttcgagaccagcctggccaacatggtgaaatcccgcccgtctctactaaaaatacaaacatcagctgggcgcagtggcgggcgcctatgatcccagccactcgggaggcggaggcacgagaatcacttgaacccaggaggcagaggttgcagtgagccaagatcgcatcattgcaacccaatctgggccacaggagcaaaactccaactcaaaaaaaaaattattaatttagaaattattctattaattattaatttagctgttattttttgacctagcagaaaatgtaaaactatcggatgttaccttttgttaaacttaaaaaaaaaaagagaacagagatgcttcctcaaactgggcgacatattattcctgaaccaaggagaaagaacataaaattaagtacactggagttgcccagctctaaatgctggaaactattagtgtttagggagtgtgcattgtacagtggctaagaaaatacaaaacctattatcagtttatgaggaggttaagttgtgaggcaagtgactttatttctctcatttttccagctactgtcatgcatttattcttcataagtggccgtgatgactatgagagcagcctgtgttccgcagtggtagccgctgttgataagaggtagccttagaggccgcctctaggaaggagaatctcgacttcctctctcctctttgggaaaaaggggaattgagaacaggaaaattcaaataagaaaaccctcagagagccccttaaataaaaaaatttgcagtctgccactttgcaaaataaggaaaaaaaaaaaaaagcttgtgttttcctatgaaactagcaagaaaaggaatactgcacaaaaggtggtttaccttgatcacgtcccattcctttaatcattaggaaatgactccatgtcctgaccttgactcttctaaatacaatgcagtgcaaacctgtcggtccctctgaaagaagcgaaagtctgttaaaagcatccaaggaagccggctttgagtcaccaatcactgttgattctacatgagaggcctgagctggtattgctaccttccccatccatgcttccgctacagatgtaaatatcacatcccattctctgcaaagattttttcatcgaggttgatctgtagttctaggagcacagcacattatagattcagccaaaattaaaatttgcgacgtgtaaatctctagtagacaggactataccgtgttcaaacattttaaggtaatttaaacaagagaagaaatttatctccctttaaacgagaatgtttgtttcgatcatcattcctttttaaaatatttaaatctatcttaagagctttagttttacatttatatctgattagttttgtgttctctcgagttagcacctctccgtgttctgacttttaaaggtacacaaacacacttcacttctttatgatgttgagttaaatccccttttattcataagaatttgctgtagcaggtaggatttttgtggttggcgcacactgcaaaaaccctgaagagagtgtctgtgtcaattccgagggatttggatgagattataatcccacgccctgtggccgagcattattggtttcacagggctgtcaccatgtacctgtcaaaagggccacccgtaggagcacacaggccaaagacagagaaacaaatgggctcctattacttgtattttatactgatgacacaggacaggctagttgggctgtttgcccacctgcctgtctatgttgcttaatttctgtggcttgaatgagagcacagaggtcggcttccaggcaccaccccgccactggctgcccagtcctgtggagcagcccctctacgccctccaccctcccctcctgcctcccctctacaccctcctctcccgcatcacctctacactctacagcctcccctcctgcctcccctctacaccctcccctcccctcctgcctcccctctacaccctcccctcccctcctgcctcccctctacaccctcccctcctgcctcccctctacaccctccaccctcccctcctgcctcccctctacaccctcccctcccctcctgcctcccctctacgccctccaccctcccccctcccctcctgcttctcctctacaccctcctctcccctcccacctcccctttacaacctcccctcaacaccctcccttcccgcctcccctctatactctccgccctccgttcccacctcccctctacaccttcccctctggcctcccctctacaccctccgcttccgtcccacctcccttctacaccctctacactgcaccattcatgggcttgaatgagtgttggcctcagtttccacatccataaaatggagatggatgtagatggtaccagctcatattgtgaaggttaaatgcaaaaatgtctgtcacagaggctctgaaatagtggctttagttgctgttggcataactctattatcctatatgtcccattgcactcgctatttaccaataatcagttatgtgacacacatttttcatgtttagtgtctctggaatcaggatgtgcctcaccacctatgaaaccattttttttttccttggggtaagacaaggatgccccttacctctgactgcagcaccttagtgcctgtgagatgcatcttccctccgagccacgccttctccacggtctcctcatcacacacgaagccagctgctcccacatgtgccctgctcctgctgagcacgatggctcggaaactcggacggcgagttttcactgggatggactctttacctggtggggcatctgctgccagccccttcaagttgttcatggaattcagtgcttgtggcttgggggctggctcctggccaggggtcccctcaggttccagagtcccctgcatccctggctcatctccagagccagcagctgcggctgagttcttgtcacacatggaagctctctgctgtcccctgtgcctccagctgcagaaagtcctctccttttaggggctcacatgattaaattgggcccacccagcgaatccaagagagtctccctattttaaggtgggatacctaatcccacctgcagagtccctcttgccaagtgagacagcatattcatagattccagaggtgtgggtgtggacacctccgggagccgttctgtccacctcggtggactagcgtgcagtgcaggccagccgagggcatgcgtgggacatgctgctccctgagaggggcgacctggaaggaacagggaggcagcgcaggaaacatctttggatcttgcagtgatccctacacagaagaagctttgcaactcagaagccaaatcccagcagcattggggatgggagagcaggaaaaatgcatggtgttgttggggggtccttctccactgcggttgcctccattgggcctgagcctgcactttgtcacactggcattttggagagtgaggtcatttgacagaggcccttggtttgggggcagtctgggaggtctccccacctcctctcctgagactggggagctagaagcttgcgctgcccctggaggcagctgccatgggctctgggccatgtggaaggcggaaaatctgagctggccttttcctaacaccctgacttcacacagggcatgagaacctttccctgatgtcttcatattgtttcaaaagagggagaagtgtttgtttccatcccctgttttgttggctgcagtcaggatcaattttcagaagtccagggtggacccatgttggcagagtaccctttctagacacagttgccactgacaggctaagacatgccctcgccctcttgccctctgaagagtaagtggttgagagtctatgcacaggatgactcatttacaatgggttttccccagtgtttaactcacgggcttttcacggtccataggcttggcatttcctccggttctttgccttagagcagactgtgtgtaaaaccgtagctggaaatggggagaaactccatctgagcagccgctgggttagaatactaggaagggttggcagggagagaactcgtaccctcacacggtggggaagtactaagggaagctcagaggccacgcagggcatgggcagctctgcacctgctccccaggcacagcgacctggaaggctttccagaacaagctaagagcatccacaatgaacagccagatgttttccacccatgcctagcactgagctactaaaactgcccaggacattggcccctgcaggcggtggcaggctgccccccagaccttgcccatgccacagtactatggagagtgtggagtgggatgagttttctcaccaggtggcatgctgtgtgccaaacacagatggtccctggctagggtggagagaggtcaccacttggagaggagcagcatcgtctgggcctggaggtccccagagccatgcacttgctcagccaagccagcttcgggtcactgtgtggagtgcccgtctccctgaccccagcgaggtcccttcctggcactcgagggaagcctcgggggactgtaccaggcgacaacggtaatcagtacctcagggaaggcaccctgggcccgtaggtgccgaccattgttatctatggattttgtatcatcaaagcacaggtcatcttgggtgaatctcaagggaaccatgaagagtgaaaaaaatagttgcaaaagttacactcgatgacctcctttctgtaacgttcttgaaatgacaaacctacagaaacagagaacggattagtggttgtgaggggtgggggtttggggtgctcctggtcatggaaggcaacacccttgtgctgatggacacgtggacctacacacgtaataatgttgcatgggacgtgcatgtgccgtcttttcacgcacacttgagcgcaggaaacactggcaagagctggataaattaggttgattgtatcagtagcagtatcctgatcatgatgttatgctatcgttttttgcaagatgttaccattgcgggaagccgagtgaagggtccatgagctctttcagtgttacagtgttacttctcacaactgcacggactcgacagttttctaaaaagaaaacgctcaactaagaagaggaaaactataattaatcataagcaaatgttgttgtcgaatgtatgtttttttcctttttccttccatgcttttaatcagatcatgacggtagatattgacttagcttccctgatgaatacaggtcaggacctgcacacaagggccctgacagcaggcagctactgtatgtatagttggaatataaataatactgccttcatgattattgattgaggaaacgtgatcaaatgggggatgtatgagttgtgcaatgaagatgagcttgaaaaaggtagacattaaatgctggcaatatttcttcaggcttggtctgtacacatgaaaacttaagtagaggaatctgcttccttctaatgaatttgcagccatctcctcagccggagtggttgattcaggcagattctttctgcttgagtggtccaggtaatcgcagaagtgaaacatcactttgcctccttccagaaaccttcagccgcttcccccttaatcgtttctttgaaatgcttagttttcatttctctttttcatcttttaggtcccaccttgttttaaagatacagtcaatataggaggcatgccaagctatcttatccacattcaacacaattataatgaaagtaaaccagctctggaagacagttcccagaaattaattatcgcacagaaagtgaacacaacagccttttgttatcatgataatgaaatcaccaccaccttaatacttgacaaacttggccatgcctctgttgaatttctgctgaataaactggaaaaatgttgcaattggctctccaaggaaattcattgtttaatacaaccactgtttttttttctgcggaacgggcgagtggagtatcgagagattgcaagtgcctaggagtttcctttgctactaaagatagatgagtgctcccttatatgttttctcttagttattatttggtattccattgaagtattaaatctctattttggagaagaactgctaagaattttaaaaatatgttaataggctgttgcccaatacaggctgcacaccttcctcgggcacttgacaagcttcacgagctcgtgtttagtttagatactgaagcaaactagcccataaaatacggtgctgtaaatataaacctttacgaacctcttggggtagtccttctaaaatgtaaattaagatattccatgattcaagcccataaactgaaaagtagccatcaccctgagtagtaagttgctttctgaaaccccagactgtaaattgcctttggcctgtgctcactgagttctgagtttgtatgcacgatgctaactaatgatgaaattttcaagaatggtttttaagaggagcccacactatcttaggttatatggtctctgacatatccttctttggcttaggggcttttttttattttcttgtttgaagagccaccatattttactgctgagcccgagagtcggatttcagctgaagtagaagaaactgtggacatcggatgtcaagccatgggtgagtgcagagtggctgctggacaaggagccatgactgggaggaagggaaacaacctttttccatagcagaattgccatcattctagggagacattgagtgtgatggcgaagagcagacttcagagagtagatcggtcttggggcagtgactgtgggtaaggcatttgactttgccaagcttttgcttcctcccctgcgaaacagagatgatactatttacccagcagagcaaaaaggaagcccacatctaccccagacagagaggggactccatcatatcctgtggactccccttccaaggccctgacttcacaagtgtgtgaccccccgagattcggggcagaaaattctttctcatccatggggtgactaggactggtgagcacagccactctagaaagggagatgggtgtacatgtatttgtagtaggtacgtgaggtacaaggcaattttgttccactgatgtattgcacagtggtgaagccaaagctgggagtgcgtccgtcactggagtgatgtaccctgtacccgttaagtaatttctcatcgcccaccccacacccttgtgagtccccattgtctgtccttccacactctgcatccatgtgcacatgtgacttagcacccacttattagtgagaacaggcagtctttgtctttctgtgtctgagttctctcacataactcagtggcctccggtgccatccaggttgctgcaaaagacacccttttattcttttttgtggccgaatagtatttgaataggaaatgttacctttttttttttgccttttcagctctgggtccccttttcctttgccattcaggtcatcccagccctcatccccatgcttcaattacaagctgcccactgtcaccgtctcatgtcgggcagcacaggtgattacacaaaaccttctagcagagacaggcttgtcaaggcagtttcgttaagaaaagctgtgtttgtattctggcaactatcaggaaacgaaaaggatcttttctcttttgtttatacccatccgtcctaaggatagtattttctcctactccctaagagctcggagggtaagaatgactaccagttttgcaaatcttcaaaacagctcctaaaagagagatgattttcactgtaccacaggaaaaccaagccctggaaagcatggttaagtacagtgccaaaggcactgggccactcaatgaaatgggatccttctctggtgaagtcattgcccagtgtgtggcctgtggaagttactcattaaatactgggtacctaacttacctaggtccacatggtaatggaggcaggacccaaacgcaaatctgtcagccaccaaagcagccacctggctcttgccagaacactagcttcccccaggacctgaagccctggacttagaacaaatgccatttgtccatacctgcaactgtgtggatgccatttcttattcctgaaaatggtgtgtcacccttccagtgctgtgccacccttccggtgcagcggcgtgtcacccttccagtcctggtggtagagggaaagatcagcctctgcccacagaccccctcccgacccaccgtgctttgtaaccactgctcctggcccgggacttggttcagtaggagttctggtcctcagctcctgaccagctcacagcggctgctgtccacggctctgttctgtttctgttcttctctgttccagctctactgattcggcataggggagggggaaaaagtgtgagagaagagtaagacgaattttacgtggaattatctttcttacagtggttgcattgttctttcttgtgtaggtgccagcttcttaaggccaacaactctgtgaatgtgaagctataaaatatttagcgagcttatatttcagaaataagagtatacaatactgcgggggataagatttctgttatgacattaaattgccccaaaatagaaatactcccagttccctatgtactaacaattatttttcaacaaatgacaatcttaaactccctttgacaagagaaagctctgtttttttgcacgacttctgcagggtaaactgcttgttaagtgtagacttacaaatatagagacaacagatcttccgacattgcactgctgtcatataatttactgctttcttttcattttgacagtgaaactatagcagcatgcgaagtggttattccttatgaaagtgacatcatgtaactgctattatgagatattacatgaattggttatgcttttaccttgaaatggattttttaatatttcctgacttaatgaaaagtgacaggaaacataattaaggcaaagaagagaatctaggaagacattatcttgagttattccatggcattaactttatttattaaagtcgacatctcacacctacccacacgccatcttaaatcaagggattttggtgtgctttgcactgaagcatgtcaagatatgttttttatttaaatccactttctctttagggaaactgaggtacagaaccatctgagatctagagctaagtgtagatatgcctcatggagcgaggcagcttttcctgtatccacaatggaatacctcttgtgcctcctcctcgacccttaacaaggttacttaacctaacaaattgctcctctgagacagtagaactccatgaaggcccatgatatccaacccctttgatagggggtgttaaaagatggcactcattttcattgttagctgttgggatgaatagtgatactgccattgagcactcaccaggtgccgggcatgagttttataaatacatatgtaaatgtacacacatgcacatatatgcaccacctcacacagacacacatagaaacacatgtacacatatatgcaggtgcacatatacatacacagatgtacacacacatatacacacacgcacatgtatacgcatacacacataaacacatgcacatatatgcacaaacacacacacatacacacatgtaaacacgtagacacatgcacatatatacacacatgtacacgtgcacacactcgcatgaacacatgcacatacatatacacacacatgcacagacacacaaacacatccaatcttcaaccttctgaagtcacaattatcactaacctgcatgtgaggaaacagacaaagaaagggacaggtaatgtattctgcccaaggtgacactgtccgcgaggcatggacctgggatgtggcctgtgtcctgtcctctgcccctatgaccctgtgcccaagccctcccgcggtggctgagtagggcactgcagagcagagagggcttcatctccatctgaaccttaacctgactctcagctggaatctcctttccaaacaagagcatgagcctgtgtgggttcggagtggagcctggaaggcaccgcagccagggcggccacagttcatgccagctgttcctctcaacacccctccgtgtcgatggcttcatctacaacgagaaaaatagctccttatagggtggttgaaagcacgaatacacaagaaaatgcctattaaaatattggcattctagcctttgaaacagatgtgcttcagttctcacgtcaggaattatttttaaaatcctatttattcccattcctacgcaggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccagtgagtacacccaggcccacagctacctgacctggacgtatccagtgagtacactcagccccatggctacctggatgtaaccagtgggtacacccaggctcacagctacctgacctggacgtatccagtgagtacactcagctccatggctacctggatgtaaccactgggtacacccaggctcacagctacctgacctggacgtatccagtgagtacactcagccccatggctacctggatgtaaccagtgggtacacccaggctcacagctacctgatctggacgtatccagtgagtacattcagccccatggctacctggatgtaatcagtgggtacacccaggctcacagctacctgacctggacgtatccagtgagtacattcagccccatggctacctggatgtaaccagtgggtacacccaggctcacagctacctgacctggacgtatccagtgagtacattcagccccatggctatctggatgtaaccagtgggtacacccaggctcacagctacctgacctggacgtatccagtgagtacactcagccccatggctacctggatgtaaccactgggtacacccaggcttacagctacctgacctggacgtatccagtgagtacactcagccccatggctacctggatgtaaccagtgggtacacccaggctcacagctacctgatctggacgtatccagtgagtacattcagccccatggctacctggatgtaatcagtgggtacacccaggctcacagctacctgacctggacgtatccagtgagtacattcagccccatggctacctggatgtaaccagtgggtacacccaggctcacagctacctgacctggacgtatccagtgagtacattcagccccatggctatctggatgtaaccagtgggtacacccaggctcacagctacctgacctggacgtatccagtgagcacacccaggccgacggctacccagatgtatccagtgggtacacctaagctcacggctacccggacatatccagtgggtacacccaggctcacagctacctgacctggacgtatccagtgagcacacccaggccgacggctacccagatgtatccagtgggtacacccacgcccacggctacccggatgtatccagtgggtacaccttggcccacagctacctggatgtatccagtgggtacacctatcagcaaagccagacctgctagactgggccttcaaggtagaacttcccaaaatttgctccatgtactacacacagaaaatggtagtatctgttcagccccctgaggtaaacagaaggggtaatgtggccagaagtgggcagaccaggagagccagctctcaagcacacctgaagcctttgtgggtcctgtggggaaactgctgaggcccacaagcagcacagacggctgtcactccccggccctagtaccctcctcttctcagggtagcgttgcctcttcccgcactaagccctcctctttcttgaggagaagtagaaaaaactcccttattttctgggcagaattggaaagactattgagtgaatagatcactcctaatctttttcttttgatctttttttcctattttttacattcattctctattttacttttattgaacaattgtagttcttttgtgagtttcttttattatcccattaacagaaataccttggctctctgtctttgaaaaataaactcaaggtaaaggttttcattgtttctgtgggttttctttttaatcttccatggttgtataatactgttcttctaaaatgaagtagaatctagtgattatggaattataccttttgtgtttgccctttcgggagcaaaatgctgatatcctcaggggtgagagctgttggagagagcaaatcagtgtcactgtgtgcacagccaagggctcttcccacccacagcctgcaaggagactgaccaggtgtgtagcaagctgtgcatgtgtttcggtgaactaggggtcccttccttgaatcttgccctcgggtcaaatttgtctttcattttggagcttaggaaaccaatattgcttcaagcagtagaaataatatggaatgctcaagtcagaacatgagtcttgattgattagaattatttgaagcctatcttgcaatcgtgagctgggacgttcttgagcagggattgacaagctttttctgcgaagggcctaatggtagatatttttggctttgaaggatgtggcctactcagcattgctgtagtaacctaagagcagccacagttctcagcacatgcgagtggctgtgttccaataaaactttatttacaaacacagggtgcaggctgaatttggcccccaggttgtagtttgccaatctccattccagtgagagacttaggaatgagaataaaaaagaacccagagaacatctctgggtttctctcagcctcagttttctcatccattaaaatggagctaaccaaacccagattataggattctcatgagggtcagattggaaatgtaagtgaaagtgccacctgcactgttaccacggcagtgagtgagtgaacaaacaaatcaatgattgtgattatgttatctgttttgtagtaggaggttttttgcaaaatgagttttttaattaaaatacccttaatgaaaggaaaatgtgctttaaaaaatcgatattgatttgctcatttagcaagcggctgctgagcatctgtgtcgggcactctggatgaggctctggggacacggctgtgaggaagacaggtgaggttcctgtgcttccaggacagagggtctgcagggaggagaaaggcagtgaaggacgagatgactccagccagccaggggtgctgcagaaaaggggagcaggtgcggtggcatattgagccggggcctcccccagacagtgtggctgccgggtggggcttctctaggagagatttagaaggagcaggagtgtgaactcttggggacatgcgcattgcatgggctggaggggacatcaggtgccttggaggagcaagctcggcatgtgtgcaggtgaagggaggcggataggttggggctcagtgacaagcagggtggccatgacgggctggagggtggagggataggcaggggcagaggccgagaacaggaggagcctcgggagctgcgagcaagcagagaagggacatgaaagcctttgtagctttcaaagggcagcccaaggctggctgcctcagggaccctgacacaggcacagaagtgttgagacctgttagggggcctgcggcatctggcaagacctggactcgggtggttgcctgcgaggtggagagacaaggtcagcttcaggaagggccttggcagtgaagtttctgggacttgccatggtccatgggattctcagcaggtgcaggcagaggcggcggctgtgccctgggtcccgtgaggtctactcacttctttccttgaggggtatcagcccagggaccctcacagaagacttgagagacacagatcactgttgtacggggggttccggttaatcgttattgggtagcacagagttaggcgagccctcgctgaagccatcaggagctcctcctgtctttcctcggtctgactcagggctgctcggggccgtgaccatcccccatgaacaagaagaaacccagcacttggggatcatgacacctcccagaaatgtatctttatggaggtctttgaaacctggttattttaactctcagaacagatcctagaaagcatcctagaaagtgtcatcttgtggatgacattttgtattcaataattagcttttttttttgtttttgtttttgagataaggtctcactctgtcacccaggctgtagtacagtggcacgatcatcactcactgcagcctcagcctcctgggctcaagcgatcctcctgcctccacctcccaagtacgtgggactataggcctgcaccaccatgcctggctaatttttcatttttggtagagacagggatctcactgtgttgcccaggctggtctcaaactcctgaactcaagcagtcctcttgcctcagcctcctgaagtgctgggaatataggcatgggctacctttcatttaaagaacaaaagcagtcttttggctgatctaaataaatgcctctcctctctttaatattcatcaaaaactgttcttcctgggcccctgcacgtttccacttgtgtatctattacatcgtgacgctgtattttctctccaggttgtaaacaaagatcggtaactcctgggagaggaacagtggagggctgccgtccctcctgaacagtattccttttgtattgctacagttacctctgtgattggctctctaaagcccgtgcaggatactctgccaggctgatgtgagcctctcaggaacaaggccctgatcatttcatttactcctcttctcagatatcgctccagtgttcacccagcggccagtggacaccacagttactgacgggatgacagccattctaaggtgtgaggtgtccggggctcccaaacccgccatcacctggaaaagaggtgggtagcatccactgcccacaacagcatggcccatgtagaacataacctatcgggccagtgcttgcttcttattcactctcttgtttattcacttatgcattcactcaatgaagattaaataactcttattgcagcagtccccaacctttttggcaccagggacctgtttcttggaagagaatttctccatggtctccagtgggggctgatggtctaaggatgaaactgttccatctcagatcattagattcttctagggagtgtgcagcctagatccttggcatgcatagttcactggagggtgtgcgttcctatgagaatctaatgctgctgccgagctgacaggagggggagctcaggcagtcatgcacggtggccaccgctcacctcctgctacgcagcccagttccaaacaggtctgcagcccagggcttggggacccctgatttacagaatgcctaccaggtgcaagataccatgggcacaaggataaataggacagacaagatccctgccttctagaaagggaaacacacattagaaaaagagaaggattgtgcaaatgtcactcttctctatccacgcccttcagagagtgcctcaggcctcctcgggccttaccgtgtcaaggactggatgtgaagtcactctgctagcactcacttttcccactgttaagtggagctcttccttgtgacattcagaattaaggatcacggcctttgttttgttgaagaaagatgcttccagggccacatcgttccgtgccttctgcagtcaacctgggacgcttcagcccactgtgggttcagttcctgggaaggctgcctttgcagttcccatagcccgttccatgagggccactgaaggaacagcacacagagtccatcctgaacaagtctgtgcttagccttgttgattcacatggatgagctcctcatacttgctgggctgtatcgggctgacatgccaaaagccttatctttctcttccttctggaaaaccacctggcagcttctcgactctcagaggtacaacccctgcactcagacacagctcctaaagatctgggacactacagatcaataacagggctgggcttttattctctcttgttttcctgcctaattttgaacataatagctttatataaaaatgtttcaaatacatgcagatataaagaaaactaaaaaccgatcacccaaacatagcaatcacgttcatggatcataatttgtttaaccaaatctctaaatattgagcaagtaggatgttcttggtttttgttattctaaacagtgctagcaggtactgcttcagttatttcttttcctacaattttcactttattctgattatttccttaagttatttctttgttgtattagtccactctcacactgatataaacacatacctgagactgggcaatttacaaagaaaagaggttgaattgactcacagttctgcatagctggggaggcctcaggaaatcatggtggaaggtgaagaggaagcaggcgcatctcacaaggctgcaagagagagaaagagcaaagggggaagtgccaaacagttttaaaccatcagatctcatgagaactccctcactatcaggagaacatcacgggggaaccaccctcaggatccagtcacctcccaccagattcctcccccgacgtggggattgcaattcgagacgagacttgggtggggacacggagccgaaccatattacttgcttatggctctaaccactatcttcatttccttcaagcgttacgactgtaacatgcctcttttctccactgttctttagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggagtaaggagcagccctcgcacgtcggccttctgttagccacggtttaatcatcacgtcatcgtgtgctttggggatgtcagcatgcccttgggcttgctaatttaatcaaaagagaatgattatttttacaactaatttatagaaatctgttgagaaattaaattttcaatgtctaaaagaatacctagaaaatgtattcagagatttaataggggcattgcaggagagacgaaagattgactttgtaaagtcagtggagatattacacaaaactagctcaaatcacaaaattgataggttggttaattttataagcattttataagaaaattaagaattaaaatcctaaagaagtaatattttgctaaacatttgttagggacaactaaaacacttctaatacactaaccatcaatgtttcttgtatgttaggagtgaactgaaagaaaatcttccgcttttgctaaacaattgttaggaacaactaagacacttctaatatactaactatcaatgtttcttgtatattaggagtgaactgaaagaaaatcttcagcttttgcactttttaaaatcaagacacattttggaaatgcagagtagttttctggagcttaaggattggaccaaatggtcccccattgccactttttaacttcaattgccaatacactttctcctctctgtctcatctcaatctgtactactaaaaactcatattcaaaaagcaaaagaatgctcactcagatttttacaaatctatctacatgaggagagaaagttttaacttgcttgagggagtaatttgttgaaacgttattcttccagaaaaagtaaatcattgtgcttcatttcatatttgtctagcattttctatcatatggttggtgtccactttgataaacgactcttcctaatttgtaaaatgatcatgcgtttaaaggaaattaatccaagttcccactattctgtcaagtactaaaaagcagcttttgttccatttggtggatgactctgtcagccacttcgttcattctgtatccctaaatagtaaccatacatttaacccatttatgcctgaggttgcagttttttgaacttttgtaatcagaacttggcgatgaccttgagcagtaggatattaaaaagcttatgaaaaagtggtatctgaatctctgtagatcattcgccagaaaattttgtggatctgctgagattcaacattatagcgacactagcctgactgggataacgctttggtggctttacagaacattttcacacactctgcccactttaacctgtacaactattagtgacgtaagcattccctgccatagccaggaaaactaagatgcagaattgtttttctggactcaccattagcagaggtcaggcttgccctcgaacttagccttgtgactccgaagttctgggctctgttcctggaagcagagcaggtcccccttagaggtatgggtgctacagtgacccatcgcacaggcaagctgggggtccccatcccgtactggcttgggggaggtgggcaagtcactgcatctctgagcgtccatcttccttcctgaaaactgagaatagtaatatttagccctcacaagagtgtcttgaggaataaacacaactcaaacaaaaacacttgacagactcaaaaagtaccatgcagacgctagaaatgactagaatgatggtcatctagggagagaatctaggttttattttagagcctagaacctcatccacacctgcatggggtggtcggcattcagttacttccatggtgtttgaggttaaagctgatttaggaggggtgggtgggttgacagactgctgcaatggtttacttatttgcttgtttttaactcccctagcatttctgagagtgatccatttacactcattctgccaagatgagagaaaactcggaggttgtgatgtcagatgaccagggcattatcccccctgagggcagaaactgtcaaacttgtcatttcgtctgactcgtgacttgtgtttttttcagatcggacgtccatcgtccaccctcctgaggaccacgtggtgattaaggggaccacggccacgctgcactgtggtgccacacatgacccccgggtttcactccggtcagcacaatcagttacaatgctttggggcttgttgatattctgtgagtttctgaagtgaagttgagatgaggaggaagaattgggggaacttttgatttcagcagcaggtccctgattacggtatcttctggttgtgggcaccgtcattaatcatgcaaatcccattttccactccagccttatgtgttatttacagtgagctatgttccacttcatgacgttaatgctgcttttcatgatttttcctgccaaggttaatacactatctgtaaaacgtacttgtcagaggctgatactcaatgagagaaaaatccagggggatcgactaggattcagcattgtttacacgggggctgtgccactcccgggagagttctttactctcgggatagtttcatcgtgaaatggagggggagggagtcctgtgcatgggacaaagtcacccacagcccccagtgcactaataggaaggtgcatgccaagagggaggccagatgtgagggttctcttttttttttttttttttgagacagagccttgctctgtcacctgagctggagtacagtggcattatctcagctcactgcaagctccacctcccgggttcacaccattgtcctgcctcagcctcccgagtagctgggactacaagtgcctgccaccactcccggctatttttttgtatttttagtagagacggcgtttcaccatgttagccaggatggtctcgatgtcttgacctcgtgatccacctgtctcggcctcccaaagtgctgggattccaggagtgagctgccgtgcccggccaagggttctctaaaggaatgccgacatcctgtctttgtttaaattcgggccaggaaagtaactgcaaaatatgagactccaggtgaagttgtggtggcagacaggtgggcatcagtggggagctgttccctgaagagcagccaccttcaggataattttaaatttttggaatcagccttgaaaataaaaaaggaaatatccagtcatcagagtatttccactctggccttagcccagaaggggcacagtgcatgagtcgaatgggcagactactcaagatgccctgctgctttctggggcctctcaccccgagcagaggggacagctgtgggtgcacagtcagcagcgggacgcggagactcggctgttctctcgcgcttcttgagcgggtgtttggccaattgtaaatttccatgtcgccacccgactccctggggtttcccagggctcagaatccaaatttggtttaggtacgtgggtgccgaatgcaaaacaaaacaagcaaaacaaaaaccagcaagtgaaagacgacctaggacccccctgggggccaccctggagacggtcgtcaggcctcggaaagagctccttcctaaatgatttggagtatgacttcaaggaagtctgcttttctgctactctgacagctcagaaagaaccccctcggatccctgtggtttcgtagtagcttgttatatgtgattaaattggaggccccttcctcagatggaactgggttactcgctctcggggtgcccctcgtcccagggttgctctgccctgaggagcgccaggctgtaagtgaccagccagccagatgcgatgccccggcgtgagcagtctatccatctccctcttgtggaatcagccctgttctatctcagggtaattgctgagaaggtagtttgtaaatgtctgtgcttatgactatgaagtctttaaagaactgggcacatttgcaaaacccgatcaaattattgtggaaaagaaaaacagcactttcattccatatagcaatgagtgctggccctgcccgtggtcatctaaagactgggcaggctctcaattgattgtgtatttgaaaagaaaaatgtgctcaaattgctacagatagattaaatgagaaataaatgcaattttaaggaccatctgccagaatggtcacattttaagaaagtgtgtttttgaagggtgattttttttttcatgagttgggcaattccactctgtagattttttttaaacagtcgttgcctcctgtccagacaacactcttgtcctccaggagcatttaccggggcaggaatgttgggtgcagttttcataggtgacaggtatgcccgtggttctacagacttctcatctctaaaacacaaggtcagacaggcagggccagtcattttcattgccctgtttgtaacctcagcatgtgtttttgtattatgaccaagatttctggttgcttttcttttttttattattttttggtttaattcatatgccataaaattcactcttttaggccaagtgcggtgactcaggcctgtaatcccagcagtttgggaggccgagacgggcagatcacttgaggctaggagtttgagactagcctgggccacatggcaaaacctcatctctattaaaaatacaaaaaaattagccaagcatggtggcatacatctgtggtcccagctactcaggaggctgaggcacaagaattgcttgaacccaggaggtggaggctgcagtgggccaagatcatgccactgcactccagcctgggccacacagcaagactctgtctcaaaaaaaaaaaaaaaaagaaagaaagaaaaagaaaagaaaaatcactcttttaaagagcacagttcagtggtttttaaagtccattcacaagattgttagttgcttgctttttaagagacagggaaggagcagtgattctgtcactgtggggtttgtaactcaagaccctttgcttggcccacagctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgatgtgagtactgagacgtttggtgttagccagtccgcggttttctccgttactgtgcccctgttagtgactgccacttcacaagtgtcacgcccggcttgtgtcccaagtcagcggtcagaggccagcgcatcatgctgcataactacatatatggacaaggtttttttgtggtttctttcaacttcggaattgagaagtttcgtttttggtgtagatggtgtgatcattggtttttatttcagttgatcctttttgtcatatttttcccgtggacaccttatcctgataggccctgtttaccactctgcgcttaagtagcaagttcatttttccacataatacccttgagagcctccagtccatgagagatgctggagtgggactgctgaggcgaggtcgttcccgtgaaagccacctagacttggggtttcagtgagtcccagctgcccctccgtgggtaaatagatactttaagttaagtcttgtgaaatcttgaaaacagaaagcaactgcccgttacttccaatctggaccttcctgggggttccaaagagcccaggcgggaaaccgtcaatctcccccgtctctgctctctttctccctccactcccctctctattcatggagcaggaaaccaaaatacctgctgacacattttatttttctgacatgtatttatttgctttttaaaagttgtgccatctcaatattccgtgagtgcatgagtacaaaaataaaacctgaaaataaagaatcccaaccgagcactcatcaaggcagtggccagctccagggacacacccagcgcatccgtccctggtcatcgtttgacatgctgggcctttcgacaaaggcaatcttgagagatttttcctcactggaccctgccccctttgatccaggaaagattctgtattcaaaatcattccccacaaatagaatttgaacactccgagtataggagccgtgactcattgatccctgaatcccaagactccagctgaggggattaaaaatgaaaagaatgcttgctaagtgctaagcatgtggcttctgtgtctgccacacgcatgtggaaatgagtgaactcacaaacagctttcctgtagtccctatttgtggatataaaaggttcacgatgtgtagcagtcagtccggaaggccctgtggtgtcatcagtacctgaaaaacatcccatcccaactcctgttctgtctccttccaggatgaccccttgttctctttagatagcagaggtaattgtggttagttaggaagcggcaggagtccccatggctctacagaatcagccggcggcagtggtgcgggggtcctggtgctgcagctgcaaagctgccacgtagagggtcctccagagaatcactgagggtcccggggctgaggctgccacgcagagggtcctccagagaatcactgagggtcccggggctgaggctgccacgcagaggatcctccagagaatcactgggggtcccggggctgaggctgccacgtagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgtagagggtcctccagagaatcactgagggtcccggggctgaggctgccacgcagaggatcctccagagaatcactgggggtcccggggctgaggctgccacgcagagggtcctccagagaatcactgagggtcccggggctgaggctgccacgtagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgggggtcccggggctgaggctgcgaggctgccacgcagagggtcctccagagaatcactgagggtcccggggctgaggctgcgaggctgccacacagacggtcctccagagaatcactgggggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggccctccagagaatcactgagggtcccggggctgaggctgcgaggctgccacacagacggtcctccagagaatcactgggggtcccggggctgaggctgccacgcagagggtcctccagagaatcactgagggtcccggggctgaggctgccacgcagagggtcctccagagaatcactgggggtcccggggctgaggctgcgaggctgccacgcagagggtcctccagagaatcactgagggtcccggggctgaggctgcgaggctgccacacagacggtcctccagagaatcactgagggtcccggggctgaggctgccacgcagagggtcctccagagaatcactgagggtcccggggctgaggctgccacacagacggtcctccagagaatcactgggggtcccggggctgaggctgccacacagagggtcctccagcttttgtgtacgcatggggcagccaggtttcccccagcccctgccttcaggcattggagcctacgaccctgggttctttctgcccttcatgagccccagccatccactgtctctgcggttgggtgctgtcatccgtgggcttccccggaggtctcctgatcatgcaccccttagcattcaacgacagtagcacttcctgcggttcagttaccaggatgctgcctgcagttcttccctgcgcgcagctgatcctcctggtagcactgatcacgctgcagaggacgaccatatcttcatggctccctctcctcctggaacagaagcaccttggtggcactgttttgaattttgagtgcctgatgtagtatttgttgtataaccgttgttcaataaatatatgttggttggttgctgcctgcgtgcatgcatgaaggaatgaatgaatgtgtgtctgccttggtggcccattggcgggcctccttctgttccctactcgtaccttgatgctcacatgccctggtttccccaccatgggtatacaagtaagctcaggtcgttctaccaaaacccaaacagtgagtacccaaagccctcatccagccctgctcctgcctctttcctccttcctttcgggtctcagacagaggattttttttttttcattttgataatataggaggatatggccagtgagttcctaggagctgttgtattatgcacatttttaaagctacctttgagaaccttagatcatccatcgttggtatcaaataaataagcgttagcagttcataaagactctgtcagcagaagccaaattgcatacttccaatatagcccattctttttattctgcacagttttatggtctactgatttacatgtcttccctactatttgcttatttgatttcctctaagtaaaatacatttttcagcaaatgttgctgtatgtataaaataataggctttctctaacggtaaaacatctcatctctaaatatagaaatctctgcaaatttgtgattcaaactaatttaagtacaaactggttacagaactgatttggaagacagttgttcctcgtgaattgttagtgtcacgaaggctcctctatcccaaacctggatgaattgggaaaggtgttccttcatggggtgtctttagatccaacagagcttgactctacaacaataatggcaatagaatgataataataataacccgtgattgcagggcattctgtccttcttgggtaactttcaaactgagctctgtagtgtttccatcatttactcagataaccaaaaaaaaagcaagagaaaaatctcatattgccaaagggaagggactgagaggtgcttatgactaaacaatgtccttcagaggagcctgaaagcctgttttctccttgcctctccacttcagttaaaagctgcttcattaaatatagaaattacgagcatctgaagtgagcttttcaaaaatagaccagccgttggcctcttctcacgtctgtttgccccgagttttacacttagcactaagcttcacctcattgaggctgagtggaggggcggcccccacacccacatcacacccacagcagtcctgatggggctgctggacagcagtggggccaataggagcaaagggctgcacaggaggccctgctcacctttcactacttgtgtgactttggacaaatcccctcacttctcagcttctgcctctcaccttgtagactgggcatggtatcattcatctcaaaggacggctgtgagggcggcacccacccgggtttgtaagatcctgttgtggaagccagttggggagggatgctctaagtcctagctcttcgtgctttcttaccatcttatactagaatgctgttcccccctttcctaacagcaccctgcctcctggggctgggaactttctagccctttaccctgcattattctgactacattctatgaccttctgacactagactcgagatgtgtctgtttgctgttgagccctcaatgcctggaccagtgccaggtatacagtaggaacctaataaatgtctgggtaagcctcactccacctactgagctgaaatgagacggtgtcttttgccctactgaggaggaccaatttaggagggctctgccttcatccccccactgagagaagaggcttctaaactccagatggttccatgaggcagcctgtaaattaacaagacaagtcatcattaaatgctggtcaccccttgttttagtagcgtctttgctctagttttctagtgccatggggacaggagccagtttccaggatgacttcatattccccaaagcatcttcctgtattgagcacaccagagggaccaggctcctaaggccttatggattgattaattgttaaatcatttaaagacccaattagcatttcatctctcctcctgaaatcagagtctaattctcatgggcctggagtacagagaaaacccaatttacagagctgacttggagaccctgaggcattgggagaggtttctttctataaaaccagttctgacagagccctcgtaaggagtgaagaatttaatactgtttcccccagagttatcaagccctgtcatcttcatcctcagagtgaagtcaaagaagatgggtttgaccaagtcatcatttgtgcattaaagggccaatgctttttatgtagaaaaaaagtacttatctgatcctcttctgccagagcaattccccctacagccacaatttcaccaattgctttctttcgagtctttttcaaaactgtttttctcacacacaccttgcttcatctctctcccgtactgttgggtttccgttactgttgttgttaatttctgatattcctgaggtgtcctgtgcctgacggtggttttccccctattctctttcaattacaaagtgactcagcactgggcttcgcttccattgttctctgggacctcttccatttatcagcctctgtgcttatcactgtctgtgagtcactctactgatcatttatctcctttcaaagctggcagagtaatgcttcgacgcaatctatccccattagataagattttctgaaatggattcagaatatattaaagcctcatttatctgttattgatgggttagtcaaggatctcacaaagcttcattttccaaataaccaaaacttatcatttaaagaaatagtggctggccgcagaggctcacgcctgtaatcgcagcactttgggaggccgaggcaggtagatcacgaggtcaagatttcaagaccagcctggccaagatggcgaaaccctgtctctactaaaaatacaaaaattagccgggcgtggtgttgggcacctgtaatcccagctactcaggaggctgagacagagaattgctcgaactcaggaggcggaggttgcagtgagccgaattgcaccactgcactccagcctgagctacagagcgagactccatctcaaaaaaaaaaaagaaagaaaaaaagaaatagtttatatttccagaataaggcacgccatcttctattgcatgcctcaggtattgcacgtttgtttttgttatttacaaactggaggtttgcagcaaccctgtgttaagtaagtctattgatgcaatttttccaacggcacctgctcacttagtgtctctggtcacattttgggaattctcacaatgtttcaaactttgtcactatgattgtatctgtgatggcactccctgatcactgatcttgaatgttactattgtaattgttttgggacaccatgagccacgccgatgttaagatggcaaacttaagctataaatgccttgtgtgttctgactgctccaccaacaggccattccctgtctccctccgtctccttgggcccctgtattccttgagccccacagtgtgaaatttggccagttaataaccctgcaaaggcctctgagtgtccatgtgaaagagagggttgtacgtctctcactagaaagcagactggaaatgatgaagcttagtaaggaaggcatatcgaaagccaagacaagacaaaagccaggcctcttgccccagttagccaagctgtgaatgcaaagggaaagttattgaaggacatttaaagtgctccagggaacacacaaatgataagaaagtgaaacagtcttattgctgatgtggagaaagtttgagtggtctggagagaaaaatcaaaccagcctcaacattcccttaggccaaagcctaacccagaacaaggccatagctctcttcagttttgtgaagacagagaggtgaggaagctgcagaagaaaaattggaagctagcaggggttggtttgtgagatttaaggaaagatgccgtccccataacataaaagtacaagataaagcagcaggtgctgatggagaaacttggtaagttattcagaagacctagctaggaacagtgacgagggtggctacagtaacaagaaatttgcagtgtagacgaaacagccttttatgggaagaagataccatctaggactttcctagttacggaggagaaatcaatgtctggtttcaaagcttcaaagggcaggctgactctcttgttaggggctaatggagctggtgactttaagttgaagccaacactcatttactgtgctgaaaatcttagggctcttaagaacgatgctaaatctactttgcctgtgctctgtaaatggaacagcaaagcctggatgacagctcttctgtttacagcatgttttactgaatatttcaagcctacttttgagacctgcagctcagaaaagaaaaattcctttgaaaatattactgcttatggacagtgcaccttgtcatgctagagctttgatgggaatgtacaaggagatgaatgtgggtttcatgcctgctagcacaacatccgttctgcagactgtggatgaaggtggacttttgaccatcaagtcccattatttaaggaatatatttcataagactatagttgccatggatgataattcctctgatggatctgggcaaagtaaatggaaaaccttctggaaaggattcaccattctagataccattaagaatgtttgtgggctgggcgcggtggctcacgcctgtaatcccaacactttgggaggctgaggtgggtggatcacaaggtcaggagatcgagaccatcctggctaacatggtgcaaccccatctccactaaaaatacaaaaaattagccgggcttggtggcgggtgcctgtagtcccagctactcggggggctgagtcaggagaagggcatgaacccaggaggcggagcttgcagtgagctgagatcgtgccactgcactccagcgtgggcgacagagcgagacaacatctcaaaaaaaaaaaaaagaatgtttgtgattcatgggaggagatcacaatatcaatattaacaggagttgggaagaagttgattccagccctcatggatgaggctggaggggttcaaggcatccacggaggaagttgctgctgatgtggtggaaacagcaagagaactagaattagaggtggatcctgaagatgtagctgaactgctgcaatctcatgatcaaacttgtccagatgaggatttgcttcttatagatgagcaaagcaagtggtgtgggacagcatctacttttggcaaagataccgtgaacattgttgaaatggcaacaaggccttagaatattgcatgaacttagctggtaaagctgtggcagggtttgggaggattgactccaattttgaaagaagttctactgtgggtaaaatgttatcaaacagcatcacatgctacagaaaagtctttcatgagaggaagagtccgttgatgcgccaggcttcactgctgtctcgtttgaagaaattgccacagtccccccagcctatagccccaccactccgatcagtccacagccatcaacatccaagcaggaccctccaccagcaaaaagactgtgactcactgaaggctcagatgatcaccttttttagcatgaagtatctttaaggtgtgtacatgttttttagacataatgctattgcacacttaatagactgcagtagagtataaacagaacttttatatgcactgggaaaccaaaacgtgtgtgacttgcaaattgcaatattcacttcattgtggtggtcgggaactgaacgtgcagtatctctgagacatgcctctctatcacaaggcccttcacattatgaaacaggtgatattgaacacaagagatattatcaaggggattttcacagaggggagagactgaaactgggaaaaatcaatatttccttccaatgcttgagtcctgtgatttaccaaaatatcacactttgccctgggccatcacactgagtgtgactttgagccaatggagtgacttcgggggacagtcgcagagaaggacgtgtgcgtctctgcacatcacgggcactcaggtcctcgggcactgccaggcgggtagctcttgccgcctacactaaacgcctcaagactagtttgctttctaagtttttaagtatttgtttttaatcttttaaaaaatctttttacatccctcaatctcaggctgttgcgaccgtttttgctgttgggtgtgcctgcttcgggtagatacttctcatctgttgcttgtggtctgctggcagggggaaaatctgaaaccactctgactagaatcacatcctagctgagagggggcagagggatggagggacatgtgtgagcatattccagggactgtgagagctgacccctggaggacagaagctgccccgtgagtagcctccatttaagtgagtgtctgcaaagcactgcagcctcaagagaaaggcagtccacccacctggcagatgggttgtttctgtgtgcactctcaccttgggctaagagaagcgtgatttgaaatcaagtgcaagaggccgcattttcacctctgtgagaaagacagacttttagaatttagaattcgatcaaacataacccccttgaggtcatcagagaaagtgtgcagagacacagcagcttgtcaggggccacaggtcacccatttctgttgtctcccaggagcctgttcacatcttatagcatatggtcacctggcccgagaatgtctgttttgcaaggtttgtcctgagctggctgtacaaccctctcctgccctggcttctctccaactcctactgtgtgtgtctgcagagctgcctggctcctcgagcctctaacccacctttagtttcacggcctatctcccatcctgactattacagatggtcatctgacattgtgtccagtctgtgagaacggcttccaatgagctgcccttggggtcccagaaccaatgtcaaaaagacatcccagaaattgtgaacataagctcattgctggtctctctgtgcaggccagtgcattttccctcaaccctgtctggcctctctgccacccagggcaaatcctgcattcctaccactctcaccgaccccaagcctcccagagttgaatcactggctgcatggttgaacctagtccccagccccctccactccccagaggtcagaaggctgagccgtcaccactggctcaaagccccaaccctcttatccccatgactggccttcccagcatggccagacccatcctggaaggatcttggggcccaccatgagtccacccaagaagcataagctcagctgtggtctgagaggttcaccatggtggcgaaaaccgtcccagtcactcaggaaactaaaacagtctggaagttccatctcagatcagatacattctttatgataaaccatcttatttggctatatctgtcagatttattcatattttcttttcaggtgggactttttcaacaactttggtttggtttcagaccacaccgattcagattgcagcagggggaataggaaatggggcttgggaggagtagaattgataactggcatttccgcctctaatggagattcggttattggagaactcaaatagaaatgacagctctgcccaggtgcagtggctcatgcttataatcccagcacttcgagaggccgaggttggggaggatcgcccaaggccaggagtttgagaccagcctggacagtatagtgaggccctgtctatacaaaaaataaataaaagaaacaaactattccttttctgattcaaaacttaattcacaattaaagagaaaacaagacgacatcctgggctcgcatttattctttatcgcactaatgtacaatgtagttgcagtctacattagaaatattagtatgcttataaatggtgcgtatgggttagagctgtttcttggggaactgaaagctcaaaacagcttaataaatttcaaaatgtaatgagtacatttttaaaattaaaaatatcaagtataattatggctttgtgttctgacctgtgtgggtcagcagtacctgatgtctgagagaccaaaagctggttagcggtgacccgggtcacactcagcatcccctcttcccggcactgcctggcagcgtttatggaggggcagccatccaggacagccccggaacagggtcctgctccggattcaggagacgtgaaggttcagtacagggcccgggcagctcatggttttaaggttgtagactcagccttggtagaaaccatgtagtagggttttgcagctttgtcactggttaagtcccagtaaaaactttttttttttttaactagtaacttatttaaagaatttattcgctttaattgcatttccatttcatagccttgctgatgtgttctttaccatttccatgggattttagtgagtggtttcaccacacttcctccaaatccccataactccagcagaagacataatgacaatgtaacctcatgctgtcaataaatgcggcaactgtgtggtctaagaatacatgcaggcattttcgctcataactctaaatggctagtgttggaaacattcccgttacatgtatcgggacttttcctgcatatgtggcatttccatgaccagcttctagttgtaaaaaacaaattgttgaccacgttttctcaattaaataatgtatgtgtaggccgggcatggtggctcacgcctgtaatcccagcactttgggaggccaaggcgggtgaatcacaaggtcaggagttcaagaccaacctggccaagatggtgtgaaaccccatctctactaaaaatacaaaaattagctgggcatggtggcaggcgcctataatcccacctactagggagactgaggcagagaattgcttgaacccaggaggcggaggttgcagtgagccgagcttgcatcacagcactccaggctgggcgacagagcgagacttggtcttataaaaaacagaaaataataatgtatgtgtaaacgtctgcgtcccctccccctatttatgtgacagcgtcagtacttgttttggtagctagcataagggttccatgaaattatgaccagaaaacaaagtaacactgtgaataatgaagctgggttttgtgtgtccttttctggggggaagagagttaatatttgtgtttgggcatattttatgttattcatttcccaaacatgacacagcaggacggtctgctgtaagagctcaggctcaccatggattctgacatgtgttttcctctttttccttttcatcccattcaattcaagtgaactgcctcattcacctcagaacctcctggtcagccctaattcttcccacagccacgccgtggtgctctcttgggtccggccctttgatggaaacagtcctattctttattacatcgtggagctctctgaaaacagtaagtagcaaaatgaaactgtcaccatggacgataatcagatttttgtgtgtgctcttaatgtccttaacctttacttctgggtcagacccaaaacaactactaaaatgctgtaatgctttacagggtttcaaacacagcctgccctttaggaaagaaaaaaccatgcaggacctgagagagggaagggaagaagtccttagttagaggggctcttggtggagagtggatttggggccccatgggagggctgtgcacacagggctgccccgcacagtgtcactcccagggcgagctggaaatgggttaacaatgcctgccacctgggtgacttgagagttcaccgtcgccgccactgctcatgtctgtgggaggttttctccggtgtagacgtggtgtcaagtgttcagcaccctcttcctgactcaccttccaggacccctctgcccatttaccgccatccttggaactcttctacatgaaacatgctccttccgtgggccactcacagccttggctctcctccagccgccaagccctccttcccttctcttcccagctggctgggtgacgtgtgccccgccgtgtgcacccactcacgcctctccgctctccctggaatctcttcctgggaaatcgcatgcactcctgtgattttaagtggcatattttccttgatgactcgaacatttgtatccttcacccaggattccaggatcacttatggggcccagcaacttgacatctgtatcgggttgtctcacggcctctccagcttaacttcttcccactgcatccatctttttaatgtttttttttttttttttttttttttacctcactcctgcagccacccaaatctctgctcccagcaccccgcatttctatattcctctgccagaaccctaggaatggtccccaattcctttccctggaccccagcccccacctccacaccccctgcatcagcagtcctatcagtctgttaactaggattctgatccctttcctctctgcctcagaccactggtacctctcgccaggaccactgcagcagccttccagccggccctgtttcctcatccaaaccattcacctgccagcagcaacactgatcttcctgagatatacccagaccaggccactcccctgtccacgtcctgcaggggttcctgctgcgtgcaatatagaagccaaatgcctcgctccctgtgcagcctcgggtcaccctgggctactgtgctctttctccacaccggtcagccacacgggacacatgaaactcaacacggattttatgttgactccctgaatgggccaaatatctcatctcatggcatgttccttcccctggaaacccatagagctagattgtcacccttcatgatagataatccattacctccacaaagaagctctccagcacgccagcccgatttcaccttttgttttttgtttgtttattttgagatggagtcttgctctgtcgcccaggctggagtgcagtggcatgatctcggctcactacaacctctgcctcctgggttcaagcgattcttctgcctcagcctcccgagtagctgggactacaggcacctgccaccacgcccagctaatttttgtatttttagtagatattggccaggctggtctcaaactcctggccttgtgatctgcccaccttggcctcccaaagtgctgggattacaggcatgagccaccgcgcctggcgtccagtttaaccttttaatacgtaagctgccggcctccctctgttatcctatctgtattagtcggttttcacactgccaataaagacacacccaagactgggcaatttacagaggaaagaggtttaatggagaactcacagttccacgtggctaggaaagcctcacaatcatggtggaaggtgaaagtcatgtctcacatggcggcagacaagagaagacagcttgtgcaggaaaactccccttgtactaaccctcagacctcgtgagacttgctgtcaggggaacagcacaggagagacctgcccccatgatccagttacctcccaccgggtccctcccacaactcatgggagttcaagatgagatttgggtggggacacaggtgacccacatcacccatcatttattccagatgagggtctccttccctgagcctcccccaggcagagccagatgcaggtatcctggctgttaacacgatccactttattcggcctgtggttgtctctggatgatactggtgttctaaacgggtccctgttttcaggacacctaggagtggtgcactctcgggtaccctcccctgaaacccagctccccgtgggtccctggtgctgctcacttttctgggcagattcagcctgagttctgccgtggctcttcccagctgatgtcagcctgtacacgcccccagcaattattgagataactcactttatttctcctaattacctttctacaccctcgcccttccctgggggttcccttctgataatactgcatgttcacaccacagccacacagtttaatccccatttcatagctacgggaatggatgtgcagaggctgtaagtcactgtcaactgcccagggtcacatggcgatgggaggggaagatgggatccctgtgctgtctgactccagagccggtgctcatgacgagtgtcaggcatccgcagaggagccttcggaagcagagtgtgctgtcctgcactacagcggggcttcagggagaggccacacttgggcgttggtctgtgtggacgtggaggaagccactctgtgaatctgaagaaccattatttgagttctgcaccacgcaaaccagttcaccgagggaaggcccagaggcagtatgttattccgggtcttaggcttctaaggttacaccttccagtcctgggcaccacctcggagtgaggccagagtccaggcccttctcccccttgcaggggcatctctgaggccggagtccaggcccttcttcccctgcggggggcctctgcaactcccactcgggcctctttcctcccagagatggggcaggatagaaaccagcgtgtgtgcagacggccatcttagcttccattcaacggctctgaccgaacggggaaggccagggtgttactgattcagataacttctgagagtacagaagagtttcctgaggatggcgtggccatgctgcctgtacgtaaaacaggacttgacagtgatctggacggagagaatgggacaggggagagctcgtgtcatctgaattctggttcgcatccaccctaaggacagcccccatcaggcgctgtcgcctcgggcttcaggactgtgtctcctttgtcttcgtgctcctcattccctgcacttagtacgtactcagcaaatgaggtgaaattcatctctccagtggagtcctcttgtgatgcactgaaaattacagtcatggaccgtcttccaaaacagaggcattctaccttcccccgtttccatgaaagaaggcatggctttgagatgcctggccagcgctcttctcagctgatggcatgactggctcctccagccagttagcttgcctccatgagaagcaggtttcgtgtgtaactatccagccagccacctacctgttacagcggtgaagccagctgggcatctgctctgcactctgctgggtgctgggtgcagagctgacgtgatcagtgtccactgcgaacagcaaggagacagtcagaggcatcgatgcagcctccacgtcgcacgttcccggctaggtacgtacatagtgatgtgactgtatagaaggcaagtcagagaaagtcttcaaagaagatgtgacatgagacctgggccagacgggcgacgagggacagcatcagcaaggacccctcagtgccaggcccccaggctcagtgggaaacaactgcccgtgagatggggctggggcgttgctggcggcgtgtattggtgttacctgggaaagttcttcctccttcttggtggcttggatcaaatatcacttctgcaagtcccattacgcccaggcagaaatggcttttccctcctcagggctcccttgctgttctacatgcttccctttgcgcacctgcgacgtaactcctggcttgtgtccatctcctggcaagactgggaaccccttcagggcaggtggggtccctgtgttggtcctctgtgctgtgacaccagcacagtgcctggcacacacaagatggctctgtaggtgtccagctgcttaatttcactcagaaggggacagagaacgtcagtcacccatattagcctctggctctcctgaagctggccgacgttcccagctgtctttccttcagagcctggagtgtgggtattgtggcatgcagaatctagagtgggtaccatggttgcctcctgcctgttctgatttccactgtgtgaaggaagcccgtgaccttggctgaagcagcctgtgctgctaccagctggttggtccgtgtcttcctgctgtggcaaataggaagagtaccaccatcatctgggccagtggtctggtttttatttttattagcaacaaatgcccttaagaagcagctgaacatgctggctaattagagccagaaagaacagcttagcagcaagtgcactaaaatggaaattgcacttggcctccactcagcgtgtgcaagtggtcagcactaaatagcgccatctactaggtctgtccctccggctacttgggagacactccacagccagctcctcctggcaggctgactgggatgccattctcctggaagccggggatcctgcaggggccaaacccacatggtttagtggccgaggcaggcacttgatagcctctgccctgacgacattcctgccactgcagaagggcctcttccgagctctgtggagcagagcctggggcttgaactgagcctgcacccatgtacgggactcaaggtgcatctctggatgggagatacacgtggccctctgcaggcatgccagggtttgcctctctgagaagtttgatggttctcctgtcccaggtgcctgtttagtaagcctgggactcagagaggggcagtagtgtcctaggcctgggtcaaggcacccacctggtggattgaggagggcagagggtcaggccaggtggcggatgagggaagcctgggggatccctgcattgagagagtgcagggattcttgatggcttgacagtggggaccctgtgaccaggctgagaattctgttgaataatgaaagcatttggcccactctctaaaatgcttatcgattatgatcaaaaatgatctttctttgagattattatgatcctgtggagggagactgtcaggtaagaattgtgaaagactttgcagtgtgccataaaaaggattactgagtgtctcatctagcgcccttcagggttatctgattcgatagggacccgcgctttccatcgtctttgggctacttatctctgtaaattgtagaaatcttatagtagtgcactttgagtaatgcaaatttcttttccaaagaaatgcaaataaatgcaaattttatcctgtagaatataaatatggctattgctctgcagatactgacccgttttgcatctatttataaattcatttttgcactatcaatatgttgtgggctgttcactttctcttttgatacagttgaaacgtcttactggttccctcataaattaatgacaactaaaatctttgatacatgttgattctatcgttgcattagagccgttattttaccttcttaaaaatttattctttcacatgagtgagtcggcattgcacagtgttagaaatggagattttcgtttaatgcaacagttgccaccagtttccacggcaaccttgatatttgggagaggccatcctagttctcaaactgagcctctgcgtgttttccttgggctggacaaaggcgtcccatggctgaaacagaagaatggtggccttctaccagttatcaagaaaaattaagtctttttcttatgatttttttttcaaccttaacacctgctgttgtatgtcttgtggtaaatgcttgcaggtaacaaacatattaaacattcagaatccttcattctactcagtcctacggttagttttttaataggatgagtgttcgtaattgtgattccctattataccttgtaatatttaaatttaattaaaatgtaaaatacatttgtactttttattattctagttatgcatgctgattaataaaaatttagaaatcccttaaagcacaaagaataaaaacgatcactacagtcccacatatgttgaaagccagccctgcacccaagcccttggtccctcctccagcccttcctccaggacttggctccctctttatttcctctctgtgttctgtcttcaaagctctccctctctcctggcttcttctgcctcaaaggactgagctctgctaattacctgcacctcctcacttctcacgcattctatctactcttctctcctgaggccatattgtcgttgttgtaaaggacagagccagtgagctccactgagtccacatcccctcagcttctctgcaagcaatgctcttgatcactctccccacacagacctccttgttcccaggacttggcttaagtctttctcttcattcttccttcttattttctcctctctatccattttctctgactcattgaaggctctatttcccctcctgcccctaaaatgttggcattccctgctttgtctcactcacacactggtcttcttatcacacatgcttttctagggatctcatgttagtccatggttcacctttgacccacacaccataagtccctcatgtgtatttctaacctagacctctctgctaagcctcagattcttgtaaccaaatgtcttccacacatctacacctccatgtcccagggcttatcagactccaactctaaaatagaactcatcatctgaccccaaagttgttcctcttccaagttagagataatgtccaggctgggcgcagtggctcacacctgtgttctcagtactttgggaggccgagtcaggaggatcacttgaggccaggagtttgagaccagcctgggcaacatagcaagaccccatatctacaaaaaattaaaaaattagccaggtgtggtggctcatgcctataatcccagctactcaggaggctaaggtgggaggatcacttgaacccaggagttcaaggctgcagtgagccgcgatcgcaccaaggcactccagcctgggagacagaatgagacttcatctcaaaaaaaaaaaaaaaaagagaaaaacataatgtaattcttgactccttcaccattaattctctccaacaaatcaatcaataaattttatagggtttacctcatgcatttttatcaaatccactgccctgcccttctttgttcctgccaccactgaccctaactggctgttgcccatcactgtgatccatggatctgggatcctcaaatccatcctcccttgagccaccagagcgagctcagtagtacaggaacctcactgagtggtttcccctgcctgaagccttccagaggatctgcagagaacccaccgctggggctgggcaggaaggcttcaggaagcctggtactgtagacatggcccatgtcctccctaggttgccagccctacttcttccgtatagaggttctcgttccctgaagaggggattctaggcttcttagcatggtagcagcactgtttactatctgaccaccccctgcctctccgatttatctccagccactcaccattctgctttccttacttcagcaacaaggcattcctccggattccctgggcacaccagatattcagtgccactgcacctttgctcaccgaatctgggaattctcgccctgatcctgtccccctctgcctttgcctgatcagctcttactcagcatctccttttaggcattgcctctggtctcaaggtgctaccccatctcctcccctaggggtgccacacccaccccctcccctgggagcgctgtccccatcccctcccttgggggcgctgtccttatctcttcctctacttgcgttgtccccatcccctcccctgggggcgctgaccccaacacctccctcctgagttgcctcagcagtgctgaatcaaccaatgggcaaacagcctttagggcaccagcaaaggcaagacagcaacactaatgcaactatctagaaggcaatcatttgaataatctttctactccaactacacgaagataccctcctgtgtcttcattcaggaggttgagggttctgagtttcgggtcttctgagggttgttttagtttgtgtttcgactgctagtattcttgaacccattctgccaagtcggttggctttgagcactttctctgctatgatctgttcattttctttgccccatttatctatccaaggccttagggattttttttttttctgtcatttgtaacaaggattttttcagtttgcttttaccattaatgtttgtatattactttctgacatacagaagtgtttgacttttacgtagttaaatctattgatgttttcctttgtcacttcattacttttgtgtttggatatttcaacactctcaagcctaaaatgagtattcttataggtttttgccttgtttataaaggtttaatttttaatatatttaactctctaatttttctggaatttaggtgtgttatatactctggcacactacttttcctttctttcaaatgatccattttcccaacatgatttattaaataatctatttatttatggtgtctccctctttttatattcagaggacctgtttatacaaaagtctgcttgtggattatttagttccattgattcattatctctttttctgccagttttatagtattttaattgctttacttccaaaaggtgttttaataactgataaaacaactctcttcaacttttcagaattttgttattacttgtcatcatttattcttccagaaaaaactgaaattattttgtttcaaaagtagtctcattgcatttttaatcatgttaaacctataaattgttttatgagaagtgacttcttagtaattctggttttccgtccagaaaataatatgcatccctatttattcagctgtttagtgaggtttgcaagtttatacccataggctgtatacttttttgtcaaggttgtcctgagattttgactcattgctactgtaaatagcaatttttccccatttcgtcttctaattagttattgtaggaacataggaaaaccactgatgtttagatatttattttccattcagccatattccatattcttttattattctaacgacttttccattgctcttctttgctttcaaggtagacgatcatatcttttccaaataatacaaatgtattgttttctttttgtttttcctatcttgctgtgttggttggaataattttaaataattggcatagtaatgtctcttgtgtttttcctgatctcagtggaatgtctactaggattttactgttatgtgtaatatagattgttttttattgagatataatttgtatgtaacaaaatgcagggagcttaagggagttttgacaaatatatacagccatatagcccacacctcaaacaaaatacaagtcatttacaatactccagaaagttcttcctggccctttctagtcagtctaaccccttcttctgacttctgtcaccatagattaggttttcttgtttttgaacttattggaaattgttacgggatctttggagtgtcgcttttccagccagaaacctctgtggctggtggcggttttgtccgagttctcgtcttgtatccaggaagaataaggttcacagacaaatggagggtgaggaagatgaagaggagctttattgagtgtccggacagcccagaggagccccgcagtgggtggctgctctctgtaggcaagtcgtcccatcgtctctgcagctctcagcagagaggaggcctggagtggaatttaggtgtgttatatacacctctgctggcagctcatcccgacaagtgttcagctgtcagcagagagaaggccctggagaggatagtagcttctctctgcggctggtcgtcccagcatctgcagctctcagcagagagaaggccttggagaggttgttcaatgtctgcagctctcagcagagggtagctcctctttacagctggtcctcctgtcatctgctcagctctggctgagcccagggtttttatggccttcagaggggaggaagtgcatgcggattggtcaatgggtgaccatgagtgggcctggaaaaggcaccacaagttcccactccagccagggggactggcagccctgcccccagcctccaggccctcactggcctgaaggtggggcctcaccggagacccaccttcttctgcccaggagtctgtctgcctcctgctgccattcatggcactcatgctcgccctgactttgcccccagatcagagtgggtgccaacagcagggagcagccaagcagtgagagcaggcacttccaagcctgcgagggcagggggtcttcctgggtccccaagagtgcaagaatgcctgagtctgcagccgcgggttttggcagctgcagctgtgcccaagagggcagggatcctgcctgctcccagcccgccaagagcacaaggaggctaggatctgcagccacgacttgggcagggctcctgcctgctccatggaatgggaggcccaggtctgcagccacggtttgggcatctgcagcggcaccccgggagctcccgccccaactcgtaaggggcagagcttccacttgtccccggctcctatgggctccttggagcaagcggccccggcagcacctccctgcaacagctggcatgatggcagcggcaggctgtctagagcagctggctgctgtcatcaaaaggaacatgatactgacttgaatgagcagttttgtttatcatgtaatacattccttccattcccacttcttaggattttttaaaattatgtaggaaaatgttttatttctaagcaaattattcttaaaataacaaaatattacatttagaaatacccctacgtttatgtgagagaattcagaagatcaatacgcttcagcttttgggaattcatgcattcccaaggccctgccccctggacaggtttcagagctgatgctctgagggacgtggtcttcatctatgactctaggttccccagcctcaaacctgaaataatgtacttttccttaactcagaaagaagccctgttttctatgaattaggagttaatcccatatcttcatgttttctaacaatgtgcgggaggaacaacacctccgtatcttccgcatcgctcgctgtcttccacgtggagttccgtgcagtcggcgtctccactgcctagggagtgctggcttctctgggtgaatgtgggagcttccttttgcaagtgtgccatccatgtgtccctttatgccttggctaccaggaagcccaaagctaacctgagtgtctaactgaagtacctcagtcattccaactgcttagaacatctccatctctttgcattcttctcctttatgagtttgattttgtttttgtttgtatgtatgtcattgtatcacccaattttatgcagattttcactttagaatatccttaagctctctttaaaaataggagatatctctccccaaacacacacacacacacgcacacacacatgtatcatgtcaccatactttaagggcaggctcatgtgaaatgagccatcgaccttctttctctcctttagtttctttctccccattcccttgggtacagagcacagtcagttcacgcaagtctgcaaattgcgcatccactccctcctgagagcattagacaccaggagataccaggaagagcgtgaggtccattttcgaggcaaagaacactcacaaaattaaatcacaaatccaagaatatacgagggggcgtcgggtagtatgtgatcgcttgccaggaaagtggatctgaggatcaagaccgtcagggaaggggggttccctgtgggcaggtgtgggcatggaggcccttggaggtggaccctgagcagaatgttcaaacggtcagtattcggatgccctggtgcctcggggcgggggaggctggtggccaaggactccgaggcttggatgcagggcagcaaaatgggagttcaggaaatttcccagtgagtgaattcgtaagagcagaaggatctttgagcaggagaagctggaggctggaggctgaaatggactgctttataaaaaaccattttctaactaataatgtatttttaagtacaaagtaatacatgctcattgaagctggagaaatagtagatgatgtataaagggagagttcttatctccccccaccatgagggagcactgctagcagcctcgggtgcatcattcctggctgaaaagggatgcctgcgagggacagagagggaccaaatgatgccagacccgagtcttgtacaacaaagagctgcacaaagctgggagctaggcaaggtggtgtgaaagcaagtttttagcaagattaacctggcagtggcctacagggagctgtctgtgaggctcagagagtgaaggaaagcaggaggctgagggcctggagcaggaaggtggtcattcccgaattgctgatggggtttccctgggaaggagggggcccaagatggcctagagccccaggcctggacgtggaagtaggaggcctgctgaggaaaccggtctgggaagagcatctgtgagcttgactagagcatgctgaggctgagatgatgttctggggttcaggttgcaatatcctccaggcagcttgtccttcctccagcatggaacgttctggtgcccccagcggcctgatgcttttttgtgcctctccgcctctgctttctgaagcacggcttggttttgtcagctgctgggccaagactagcttttggagcacgttctctgagtcccagtgcctctcctgagcccctccccagcatctttgcaggagaggttcttcctccacaaagagaatctctgagctgcacggctgggttggttcttcccctgccacaggtgccttttcatgtagggaacccgtcagccgtctccacgccgctctccatgaaagctgctcctggctgtcaccgcacaatctgttcaacatctccatcccctgttgctattatggacttaaaagctgatgggcgttgtgctgttttgcttgccaaaatggcgaagagactttgttcttcatgcttcaaatattttaatactgtctttgaaacacacctcacacaggcgttttctaatggcctcggacttttcggggagcatttcatattttagctcgtctttctttgggcttttgctttttaagcctcccatgcatagcatttgtccgcattttaataaatgcacatctagggagacagtacctgtcagaggtgtttatgaaggggggaccatggctgtgttgggggcccagagggggctgaggtctgcttctgcgttcacttcctgttagcttcctgccctcaccaagacgagatgggggtcagagagcccagggtggctcccacatccttggttggtcctcaccttctggaatcctctggcccaggctgtcccacaggatggtgtaacttcctgcgtgggagtgcctgtggtgaccgcacggtgcggaatacagcgtggctcccatagcttgagctccaggaggtcaggccagcttccatctggagaggggcccctgctccacccactgcctgccagctatctccagcctgttgcaggggtttgccaccattaggattggtctcccacccaagatcgagttccccaagcttctggatatatccagtcaccatttccaacctcctgccccttctctggagggaatggcttctccagcacataggcccacatctcccggtgagcatgtgtctccccttgggtccaggtcaaagtctggcctcggtgggccacctttggtgtcttgacctgaggctctggaggccacagtgccctggatgtaagcagtctacggcctcaaagcctgttgtgggatcatttgggctgcatccattagctgggggtttcatgtatttctaaatgtctcagctctttagttcttaactttttaagacaaaaacttggtgcattttaatcctgagcttgtagacctttatggtttctctaaagacatatacaacagagaaagtcttcccaaagggaaggatatcaaaatgtatttatactgtccactctgtggtgttttgttttaggtagaaagtatccatctacttcgtactctttcttccccctgttctatgaagtctttgtctggcctaagcctctttctttctcaggcgtcctcagtggtttatccctgtcactcctgtggcctctgtcttctcttccagggttgccaccacgaacaggtctctctcacaatgttcttttcaaattgtgtttgtcttagatgtgtttcatgcctgaatagagtcacattcatctgggggccctcgcagtcccctgcaggagtacagtctgttctacaaatgtatttaccagcttaagcttggaattctacagtgccactaaaaattatgttccttttgtcactgtcagagtttttaactagaatcctgcagaaaacactttatataacctttgcataacgagttattatctatgcttctctcttagtgcccagatgagctctgactagaccaagagaagctttttcgtagccctggctgtgcccgtctctgagtctgggctccagccggaggggtgagtggctcagagcaggagtgggttccgaagcctcaccccaagcagtttaactgcatggaggctgaaattctttgttgtctgggctttcaaaactgtgttatttctgttcatgtgacgacagtaatttaagggcgctttaatatagaggaggaaatgtcattccttccaccaaactaatctcagtaactcactgagctgaacactaagatacaggtcggagtctccaaaaacgtgaaagtaattacccaaagcattgaacaacaatgagaatggtttaaaaaacaagaactgcagtatggacctatgcctgtttcatttcagttccttcccatactctttattttccaaaaattttaagtgaacttctatcattttttatggtataaataatgtacatacacaaacatatatatacacaaatacatatacacacaaaatatacataaaatttaccattttttacccctttaaggtggaaaaaaatctggttgggagatggatatctggttctcaggggtggatccaggttttgttgtgtaatttcggagctcttgttaagaaaaataatacaaaattgaaagagcctctgctgggacccggggagggcccgatgtgatgggagccaagagctccaggtcgctctgttcatctttcttctggggttggcatgagcttccttcccagagggcactgggcagtgctgtttgcagctcatggagccctagccctttgctactgctccaccccatgggcatcaggccccccaacactgaggagttcagcatgagccatgtctgggacagctcattctccaggctctagcctcaaggaggaatcccagtggctttaaccccagctctctgacagccctcactcttgtgtgcctgggcacacgcatgtggacacatacacacagatctgctcttctcatgcaaaacacatgaccttccactgcaggttccacgcagggcctcctaacctgcccctcccctgcctgctccagaccaaccactcatggtaggtctttcttttttcttactaaacttggtgttttagagcagtttggagcttacagaactgtttcaaagatggacccgccacccagcttcccctgtgacactagtatggtgcctttgtccattcattgagcccacagtgacaccttattgttcactgcagtcactgcccccttccgagctccgcagtctctccctgatgacgtctttcccgctctgttgcaggatcccgtccaggatctgttttgtagaacgtcactcaatcgggatttgtctgatgttcttctcttagctagaccaggattatggggctttgggaagaagaccagggaggtaaagcgccattctcatcacatcacatcacatcaagggtgaaccctgtcaacgtgactcatcactgctgatgcttgctagaccttccagacacggggaatttaacctgatctgtgcctagggctagactctcagcagcacctgtcttgagtgtgcagtgccaccctaaggaatgcagcctgcttatactcagtgtctagagagacagtctgttgtggtggaggggagcctctgattagcgtgaagcctccccacttagctccatgttgggggccctcgcgggcattgctccaagacaagctcatcttctccttcatctctgtgaccaagcccttaactttgcagctttaaatcctaggcaacaatgagatgtggagtttgcacaaggagcattaatggagagtggagagaccctgagccttcactccatccatttctcatgtggaaatgaagatcattttatccccctcaaggttactgtgaaagttgaacgtggacacatacagccatcagcagtagctccaagagtgggtgcttttgttccacaaacacttattgagctcctactgtgtgtcaggcactcttctagttgctgaggaccaaacagggaataaaatagatcccaagggagctcagccagtggataactcttttcatggatcaccatgattattgtgagctaatacttatatttcaggagattcaacatgcagactgttgtagcaaaaacagtagtagaattcaaattagaaaaataataaatttgcacctaatttttccacttaactgtaacctgggggaactatccttattttaatgaaagcatgctcattctcattcatataaaaatgcaaagtaaagcatcaaccaaattacatttttcacccaccaatagacaattacaacagttataaaatgctccatgctggcaatgctatgacaaaaatagacactttctaagaactttttattattagaagtactaaatacacacaaaaatatagctccaacaaccagtaacattttaaccatatttatttcatctgttcctcactttccttttgctagagtgttttaaaggaaattccagaaattatgtcaattcatccctaagtgatcagtaagcagttcaaaaagttgattacacctaacaaaattaatagtagtcattaatatcacctgctattcagtctatatttaattttccctaagtgtctaaaaagaaaggtctttttacacttgcatcaggatccaaacatggtccatccatcgtactggttgttttgtgtctcactgtgtcttcatccacaaaacccccttctacctccccgcttcctgcttgggcagagtccatgacagttgtcctatagaaggccccaagtcctagattaggattctggtaattctggtgtttaattggttcctgcacctttttttttttttttttttttttttgagacggagtcttgctgtgtcaccaggctgtagtgcagtggcttcatcttggctcactgcaacctccatctcctgggttcaagcgattctcctgcctcagcctcccaagtagctgggaatacaggtgcatgacaccacgcctggctaattttttgtatttttagtagagacagggttttaccatgttggccaggatggtcttgatctcttgacgtcgtgatccacctgcctcggcctcccaaagtgctgggattactgcaccttctttattgcctggagactggatttgagctgccttccgtttccgggtagtttcttttcttatgtgagtgtgtgtgtgtgtgtgtgtgtgtgtgtgtgtgtgtgtgtgtgttaatacttcttgggtattgcaggtacttcctgctgcatcacccaaggaggcacatgacaccagctgccccgcttctggtgatgttgagatggagccactctaggtagccgccacctgtgaaattcagcagaagttatttaaacttccctgagtcttggtttcctggagtgaaaaagaggcgcagtaagacctcctccccaagcgggtttctgtggctacagacccgaaagcacttccaggcggcaaactgccacagaaatattatgtattaataatatgatgatgcttttggcaattaaggaaaatctccctgctgggcttggtggttcactcctgtaatctcaacactttgggaggccaaggcagacagattgcttgagtccaggtgttcaagacaagcctgagccacgtggcgaaatcccgtctctacaaaaaatacaaaaattagccgggcacggtggcacacacctgtggtcccagcctgggggatggaatgtattgtgggaggtaggggtggaaaagaacatgactaaggcaggaggatcgcttgaacccaggagcggaggttgcagtgagccgagattgcgccactgcactccagcctggatgacaaagcgggaccctgtctcaaaaaagaaaagaaaaaaataccttctttcaaaaaacatgttcctccttcagacacctttaattgagaaactgataatgctcttttttattggaaaaagcttccagtacattttcaaagattggaaaccaccagctttttcaaccaacagctaaagcggggttgtgattcattcctcgtgattctcggccttaccactaagaaaacgaaagtgtagtgatgccctctgtagaacggagcctggctggggaagtgtaaaatccctcagtcttctagatctgagagtccctgaaggggaggaaaaaaggtattaaacgtttatgggatggtttcctttatcaaaagattcttctacctcccagcctccaagacaagcatcctgtggccctcttctgtgaggaccggctgggggcggacccttttaaagggatgttgcttattgattgtcaggaacagacttgctatttaaattttaacagttctcagcaagcttgcaattccagagcttgagaatgagcaaatccttcccaaaacaatttttttttgtatgaatcagggtgcccagagatggatcagttcatttgtattagttttcactttaatctctcttccagccagaccttttattttctagtgaaagaggaaaaagaataaagaaagaattcctatagctgcagcaggactgggcaggccccgagatgcagaggtaattaataggccctgttgtcaaatcaaaccaggcagcagactctgaaccctgaggctggggttctggactttcaggagctgtttacactcggagtgaacaaacagccaggatcaggcagggccaggctggcgggatggggccgagggcgggaaagcggcgtctccaggcttgctctgcctctcccgcagtctgattaatcgcctcagtcacctggtttcaacagttgtcctcttgactgtctctttctgaaacgatgtttgttcactgtgcctgacggagcaggtgaatggctgactgctagacactgtgatgtctgaaggaagaaagggatggacgaagagctttactgagtccagtatcagtcaagcttcctgagggaaaagatggcgttcctgaatgagagcaatcaaggaggaagttttagaaggggaatgtttgcagaggtgcgggtggaggggaaccactgttaccgggggctggtagcctcagagcgggtttcactctaaggttcaagagcccgaggcagttgcagaaccccagaaggagagattatgtagggtggctgcttggaaaagagggggacccaggtagccccaggcagcctcccagtgaggaagaaagagccttacatttgctcccctcatctacaggaagcctcggggcaggagtcccgaggacagagctggatagggagggcggagcttggatctagggagagcaagctgtccagcaccctgggccaagcttacagctagatgctttcaatgtatgtgatttcatactcggggagtcttgggggttatatattatcaccccatcttttcattatttcctttaatttgttttttgagacagagtcttgctctgtcgcccaggctggagtccagtggcgcggtctcgactccctacaacctccgcctcccgggtttcagcaattctctgtctcagcctcctgagtagctgcgattacaggcacctgccaccacgcccggctaatttttttgtatttttagtagaggcggggtttcaccgtcttggccaggctggtcttgaactcctgacctcgtgatccacctgcctcagcctccaaaagtgcagggattacaggcattgttttaatctttaatggtagtgaaacacacataaaaaatccatcatgttcaccatttgtaagtgcacggctcagtggcattaaacacattcacactgttctgccaccgtcaccaccatccttctctagagctcttttcatgttgcaaaacttctgcaccactaaacagtcgctccccgttgccctttcccctgctcctcctactttctgtctctgtgaatttgttctagatgtctcatgcaagtggaatcatacagtatttgtctttttgtgacttatttcatgtagtatactgtcctcaaggttcatccatgttccgccatgtgtcctaatttccttcctttaagaagctgaatagtagacattgtatggacagatcgtatttgtttacccattcatccatcggtgggcagttgggtttgttaggaataacgctcaaaatcctaaggaaagtgaacacacgaacaaaagattcttagcaaagcaattttacttctgcgcagaggggtgcctccttggccagtcgccatgacagcacacctgaacaaaggggcacgagagcctttattcctgacgcaagtcctgcccctgtaccctttccccattggccggggtcgggtcatacaatctaaactaatcccggttggctgaacctttgattttttttagataaggtgggcacgtaaaagaaagcgaagaggaaaggggaaggggtgttctgtaatgaactagaaagttagtcctctttccaaataaaggaaggaatgtgagctgctactgataatgcctggtactgtggcatgcctgggcatctaacaaaggcaaaaaggaaaaaaagggaaagggcagcagggggaagggtactataaattaaagaataaaagattgattgggttctttgaagagaaacctcatcatatccctcaggttgcttctaccttttggctactgtgaataaagctgctttgaacccaggtatgcacatatctcttcgaacccctcctttctgttcctttgagtgtatactgagaagcagaattgctggattctatggtaattctgtcttaattttttgaagagccaccatactgttgtctgtagcggctataccattttatattcagaacaaccgcgaaatggggcggaatttcttcacatccttcccaacacctgttattttctgtttgtgtgtatgtgttttcttttcataatagccaccctagtgggtattagatgcaatatcattgtggttctgttttgtccactgttttcacggaagttcaaacaaaactgaacacccttaagtgggagagctcgtagtcagctgtggtctccatgcttctttcttctacataccagttctcttcagaatgagaacggtatttccatggaagctggacttggcacgaaggggccctgccttctaccaaccgagtctggttgccctgatactgggaatggcctttcgtcttctgcattgacaaatggctgttttctgtaagggagactgcttagcaaaccagatcaccatgagctgcatgatacaagtggaagggttttaggctcccagagtaaaaagggaagttgctgtgagttcttctgtaggtaactgggaatgcgcacattttgtttttaaaggagacacacagagagggggatcctcatcagctgcccattatccatgtcactggaaatcaaaagccaagaacgctgaaatgcccagctggtggcgaagactgcgttcccagaaagccatttttggaagcagcttgatttgaaataattaaaaagatcccatcttcatcgccaactggcttcatgcttcagagcagcttaactttgtgttaaggaatccagtgagcagattctgaattagtgatagacacctctgtgtgaggcaacagaagtttcctttgagagtctcattttcattttggagcaatttatggccactgcttggtgattggtaaggagctggagtgcatttccaatgagctcgcaggcgcagacttacgaatccccgcggttggggctgcaggtttttggagaagcggctgggattttatgtgtggatgctgacacgcagctggtactgtctgcaggctctgcctagcccaacactatggtggaaagcatgtgccacctctttctgaccatctctaatgtgggtgaaagggaccttagcgccacttcaggtcagcgagacagctcgatttccagaagaatttcccccacccaggttttacttcgctagtaacttgaaaattcagttcaggcatcatcacaattcagaatgggaaccgacagcggatgctggaagtcactgccaagactttgttcattccagggcatcagtctacaaaatgactgggctgaaaagcctgtttaaactctgcaaaaaatccacgcaagggtgtaggatctccagcagaaccttcggaagccttgccggcaagagtgcatttggctggcagagtccctcttgcacacctgctggaaagctgggtgggaagatattctaagctcgctgtgaatttcattacgcctctctccagccaaagccactcaagggtgtggtggtgtaatgggcctgccacgcagatgggctgcgaaatacacagcccatctgtctttatcatgctcatttcctcttttattaaaatgttaatgaatatagtttttatttatcattcagtgacatgtgcagcatccttttctgggagacaaatctgcaatctgcctaaccatgtgagccgacggagaactttctccccttacatactgaacacaggaattagggacgttttggttccttttaaaccgccgtatgcaggttgcacaaaaaaatccttttgctcattgatggcggcaccggggaagttgcctttctggcttgtaagttactagccacatggccagagcctcagtttccacacctgctaaatgggataagctttccttctcctagagctgtcctgctaagcaaatgagatgttccctgagaaagcctttgcattcacctcttattattcagacatgataagcctgtgggcttgaattcgttttcttcattctttcagactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggtgcgtgaatcccgccccaggtgggggtgtggaacagccgggggcctgaatgccaaagagaagcatcacattatgtggtggaattgatcacagcaacccgctggcttccctcagggagacgggacaaaccgtgagcagaaaagcctgtcgcaaagagggaaagacaggcccacgcagacttagctgggccttccttcattgctttgaggcaggttccttggatttttcctgtggcgatctggctgtgcctacataaatcgctcctgacagcacagccctctgtgtacaggaaattcagagctcacatgttttccgtgttctttgtccaccccactgccgggtggacgctgatgccacagtcttagcaagtcaacacctagcatgctgttaagggaagctgtctctgcagaggcgtcgcattcctgagcggtcttcacgctctcccatccctgcgagggccacctctgaaaaatctcattcggaggtgacatgggaaaatggcttcatcacatttcagcacaccttccccaaccaacctgagctttcagtgggcttgacttgtagaacagctgagctgtaaatgcctttctttttttttcttcaaaatgtgggagtttgatatgagaaatattgaaagagccggagaaaacagtttgggaggagtctgagacggcaggccgacgagcggacgcattcaggcttgcagtctttctaaagggctgaggtgctggggttattcacacagaacaaagtcacctccacctttcctcgttgcttggttaactgattttctattatgttgatttgtggtaactgtttctcacgtcctttcagtttcattggctgtgtgttttgcttttcctgaaacccgatttttgtgaatagtcaggctcaagattcagcaagatagatgaaatgcaaatgggcccccgctgtttctggtactcatctctcttgttcctacccgtcttttatttataggttgatgctacctgaagaaccacccagtgctcccccgaaaaatatagtggccagtgggcggactaatcagtccattatggtccagtggcagccacccccagaaacagagcacaacggggtgttgcgtggatacatcctcaggcaagtgccctgtgattggccatctttaggccgccattagagttgagcgtcgatttcacagagggttgcaaactctaatgtctgtaagagccaaacaggaaccaaaggagtcaggccaggtgtgagatgttagggagtggtggagactgtggcaaactggagtgcacaggccaacgtgggcagccgtgcagagacattctgtgcatatctgaccataaatgacacacacaaaactggtgtcagggtagcattttggcaggagaatggagggggtattaggggttggaagcaaggtatattgttcaatgtgaagctttttttttttttttttttttttttttttttttttttttttttgatggagtttctctcttgttgcccaggctggagtgcagtggcacaatcttggctcaatgcaacttccgctgcctgggttcaagcaattctcctgcctcagcctcccgagtagctgggattacaggcatgtgccaccacacctggctaatttttgcatttttggtagagacagggtttcaccatggtgaccaagctggtctcaaactcctgacctcaggtgacctgtcctcctcagcctcccaatcctcagctgggattacaggcgtgaggcactgcacctggcctcattgtaggtcttttgattccatttaagttttcaaccaagggcatgtgttgttcaatacagtaattttaaattaagaataattaatttcatgtaattattagccagttgtcaccatgctggtatgttgcttgctatttccagaaatccaaagatctagctttgtacctgaaacctcccaacttttagatgttggaaatgaaatcaatatatttggaaacaaagggcagggctaacacacacttctgcaggccagatgtggctgaagggtagccagtgtgctgtctttgctttataaaggacagttaggcttctagaattattgggaacactgtatctgaacttgtctgtgtttgagagaagaaacctcctttgccaaaactgctaattttaaaattgcactgaacgcgatcattgcagtagcctgttgacacaagtaaaagcaaaagtaaagcagaattgcataataattattaaatctcttctaatagattgcaccactgtggacatatttgttcattttaccagtgatattgggacaagaacagtgggtatccgcttattcccttcctgggctcgttccaagtgtgtgatcagtaaacagtggctaacaaaggtcttcagcagacagatgtaatttcttagataaatgtgagaaattgggaaatgttgcatcttcagcttcattatccttgtgtatgaagggcaacgccttccctgtatatatgtgtatagccatccattcatcatttaatatgtgtttttctatgtgcctggactatttgcctgtcaaaaccaatttgccgctgtttacaagtttttcctccagcgtcgggattctcttctaaatgtaagccagaccgtgacccacctgaagtggtttaaatgggccatccccaggggtacacaaatagctccaatcaatagcaaggccccttttgtctcgaggctccaactgtccttcctcatttcaaagaagggggaagaggagcttgcagttctgtcccctcggggtgggggccgcaggctctggttcctgttgatcccctgggacagttcctaattgcctgaccacctccgctccagaaaacagccccgtgtccccgccgcctgcggccgagggctcctgtggcactgctgctcttgcccctgccttagccattacctctcattctgcacccatccactaatgagaataattggctgccctctgtacccagcagcacaggcctgtcatccctctgcctctgcctttcttcagcatgtgcaggaagagtttccttaggctgaagccgtcaagtaaggactttaaaagtcatcccacagaaccaggcccggggcacagagtttaataataaaacctctctgatgttacgaggccacttcggggactgcacatttctctgttttgtgggattactactgttaaaaggattttctgtgatggggtcagtagagttgggtgctggagatgagggcatcttctgtatttgcaggagcttaaatccagaaagctccaagatgagggtgcagtaccctaggcctgtgaatatcaaagttttcagaaatgaaagagccatgccaaagtgaatttgcttaaaaacatttccgcataatcctctggtctgcacatcagctctctgtttgcgagtgtgtatcctccagggcacagtctctgtgtcagatccgaggcacaatgcaaggaaagcaaagagaaataaatcacttccgtggctccagccataagaagtagttaggacgcgtgtgcagtaataaaatatttataataatagggagggtgtttctttgagaggagcataggggttatgtcctttataaacgttctcctgtttatttttgtataaaaaatcatcttgttctggctgagatggtctcctgggcaacatatcctaccagcaagaggaggctgccctgcacttccgttattgactgtgaccttcttagacatcctgtgactatcacaaaagcacccggagccactggtcagaatgggccaacgtgactgttccggaggggagcgcaggctctttggaagatgtaaattctgcagtttgttattcacagtgctgttaagagtggccccagagaagttgggtggctcatgcaggtgtagttccttataactcatagttatctctaccatacttctcggtagaagagcagtgtttaaaaatgtatatatatttagggagtgctttacaccttcacatctcttttacattcagtgtctcctttgactcttgcaacaagaatggaaatgctactgtcgtacccaccttaaagaggtggaaaccaaggctcagagaagtttggaattttcccaacaccacccagcttctgagtggccgttgagcaaagtcttccgatgctggttcctcagctcttccctggaatgtgcattgtgtagcgttgggtccacatgaggaatccttcttaaacggcatcctcattctgtcatagtgattacagatggtgcttggtgccagcatgcccaggctactcaggtgcatggtgtgggcacagagccagtttctaccttttcccaaatggctgtctcagtcccatttattttaagcgttcatcttttgtagatggtgaatgtaagtggaaatacctgtcacacaggtgaatccatgccaagcctttctcccagtggcccaccgccttgaggaccatcatgctacgtcggtgatctgaacaccacctgagaattgcacgtgtacttgcttggtgcaggtcgttcagtaaaggagtcagtgatggacacactaggaagccaaaacatggtttgataacttgactttcatttttgcccatcacggaataacgctgtcccttccctgagtctcccaccaggcaagcccagaggccacttgctcctttcaggcaagagacagaaggaggcccggtaccttcttgctactcaagggccatctgcttatcatcatttgttttctatcaaacaggccccaccaagtgtacatggtcggcggcaagagggaacgggagaatgctctcggaaactcctgatttttgtgaagaaccttgtgtgaccatttctcgatttcctcacttcattttcaagccctccttctcttgggaaagttgttttacattttagggcctgaatttctgggtttcttctctgcttcggtgtcagcagccttactgatgttccggtccacgcgtgtctgtctcagctccttccccttcgtgctcaggtgccctgcccgcgtgggaccacacaggtaatggacatggaatctgcagaaccacagagctcagagatcagcgtcctggaggagcctgaagatttccacatgccgtgaaaagccagcggatttgctgccactcaagtgtgggactgtgaggcaggagccacttctgggatagaaattagaggcttttggaagctgcaggatgacagggcagtcactcctactgggcatgcccctggctttacccagaggggctgatccaggaaagctcaataaattacctgagtcagttcagtgcattaacttctatagactgaatcatggagaaacatatgctaatcaaaataatacaatgcaaatcttctcacagtacacacagcaatttcctaatttatacaccctaagtcctgagttgtgtacattatctttttcataaacactactttaaatttccacctttagtatgctaagaacatagtacccaagcactcacagaggtcttctacaaagcaatttgtcatagttagtactggactagtattttagaaatttcaacaccttttcaaagccgctgattcttgttctgggatacacttggacaaacctgcaattcctaaatggagctctgtccctggacaccacaaggccgtgtgctgcttgcttctggaagtctccccacgtttcagactcacaagaggaaagtgtttctcaaactgatttacagcaactccccgatggaaatcatgtctggaatttttcgtcctaagtcactgtagtccctagacgagttacatgtaaaaagctgtaattttttcttaaccgttatgtagttgaaatgtcagttccattttgccttgagcttataatcactgtgagattagagcacacttttcaaaatcatcgagttgggaaatagtattgtttagggctgacctctcagctctgctcttgattatttacttccatttccccctaaccctgcggaataactgcgggtaaacaccgttcctgggtccagttatttccttatcgtgatgggcttccttcgtggcgcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggaggtaagcttgtctccaaaaccacgaggtggcgggatctttgccggggaatgggatttgcaaggtttgactggagtacgttagaaagaaaaacagagaatccagtcccctagggagcgtttacaagaaaattcatcacgtatttaatgggatctctccagctattcctcaatgaaaacagaaccgtagacaggagacaaataatattccaactgctttttcagtgactaaggaagtttctgtacacgccttttgacgggtgcatctagtcttgaaaagtctgtggaactggatttttctaaatggaatgattgtaggttttcacaggaaagctggctgtggagttctgtgtgatactgtgagtgtttttcaaagagcacgatgattattcacagttttatttttaacgacgtaacgtgattactggtaatcgaatttgcaacgtggtactttttttggttgtgcttttcagttatacaagcaaacaatctactaggtcaataaaaactgcccccgacccctggaaaaattgaccagacataaacgtcatgaagccagtggttcttaaatatccgtggtgagatccgggtgcggcgtggcaggctttccacagcatctggttcctccgctgttttctgaaagattcagatctcagccccaggaggagccagcattgggagatctcctccacatctgcatttcactgttactgctcttagcaggaataaacagaccctctcccaacacagcctcatttgtcctacagcagcccaaatccttgcccagggaagtaatttttctactgagtctaaaatcctttttcactctgcgatttatgccctcgcctgattcacaggtgtgattttatttgcttaggcatttttattgctaccagaccttgacctttttcagatgacaaggtttctgactgcccaattctctccccaaatcatgcctgagacctaatgttccttgatattacatgcttttattatcatcccgtattgactggctgtctgttgtcatctgtaagtccataaatcctcctttataaattaagtgcagtcagttctgcctgcacagcgactagaagaaatatttaaaatgcaggacagccaggaaggacctgtccatatgcaagtaattcttgattactcatttgaaaaggaaaatggctgaaaacctggacagttaacatttgctttaactggtctatttaataaattaacaataaacttagaaacacttaaaaagactcatattgctattagtaatcccttattactattaactgtgactgtttcattttatttccggtgcatttgagttctgcatggggcagagggaagtggatctccacctaattgagaagggctttgaggctttggactctggcttttattcagttggcagtggggaaccatgaaaggcttaagatctgtgagtgacatgagcaaaatgctgcattaggggcggaatctgtgcgtgggtgtgcagggaatgtaggaggcggggagcagagaatggcagcagggactctagagacaaaaaaaatgaattgatgagtgtcctctagctccaaaggctggcaatgagaagagatagggatgtaagtttaggtgggacgccattgttttcaaaacagctctcatggattccagggttgtgccttccagcaaccctgaaaacgaatgcagtttcggccccacaagcacctcccagtgccttctgtacaacagggctgggtataaaaacaggaacaggcccagtgcctcctgtacagtgggactgggtataaaaacaggaacagagcccagacccttcctcaaagtgcagacagtttataggatacagcagggcaagtttcattttcagacacctgttcataggaagctgaacattagctaactggaatttagttggtcagaaatcacacaggccacaaaggcagaaccagcactgacatccaggcttccaagacaagactgctgttctctgagtgacatcagctgcctctgacgtcagtaggacttgagatttcagaggagatttggcgagggactgtgcttagctagtgggctggggtgcagggttcccctaagatagtggcacagtgggtggggtcccgcctccatgtccaagtagtcttctggatggggaaattactaaattatgcattgctctgggaatgaactttttcccatatgtgatgagaacctgacttcgattggtccaaatctggttcatcatctatacttaaaaaaaaaaaaatgctcttcatgagtgaacgttagtggataatgctgcacgtgcagtttcccatctgcagctcggcttctgtagcagcaccatccttccctcacttgggtgtttgacattgggggttggtatacagagcccctcatgggtctcggagggcccagcagacacagtcgtaattcctgtcttcgtgtcttcttcatgtcttctgcctcggcactcctgggagcacccttatacagatgtggatggccctcccttgttcccttttaagcctggtgtggaaacacaggtggccccgtcctccctttgagggactcagccctccctctctggatgtctcggactcccgtgtgctcagtgggatggtaaatgcctctggggaatctccctggagcttgctgggattgggaaggtcatgtcatgcttttcttccagaccctgactccaaccctaaacctattcctgggccacgaggatgaacatctcaggcttgtgacagtctcggagacgccgggcaccacccacctgacccttctttgttcgagggacatgcttgagtcccaggataaattgggggctgataacagttactggccagagtgttaggacactatcccttggacgtggctggggtcaggcacgtggcaggcagcaggaagggtggtccatggcctgggggacatggctggcttggctggctgcacagccttgatgcctcagtgtagtcaaatgcacttatccctctgtgctattcaaggacctcccagccagccacgctgccgctgaacagaatgaagcgagcgtatgaattctgtcctgaatccacgttcccctctgtgacagtacattgctaggagatgacatcagaccaccagtctagaaagagctggggaggtgaagggaagacgggggcaatgcttgcctggctctggaggggaagatgcaatgaatgggacagaaagggatctgcctagaaggtggcacatgaggaagcagagtgacaagagggactgtgaatgcatcagggggacagtggtgggggcgcagtgagcgtgacgtttcacacacacgtgtatattcacacatctttctggatatgtgacccccagaaagagcccttcctgggagtccatccaggcctcactccatatttactactaatgtgccttcaagaagcacctgtgcccgttctgagcctgcagttttcatttgtgaaactgtggcatttacacctgtcctgactcaaagggcactgtgaagaggagatgagatactacgtgtgaaaaggctttcaaaacaaggagacatcacacacatgccagcactgtggctttgtctgtattcgtttttccactgtgatgaagagtgtctactagggtatttgaatgcttccataggggccattacactggaagagatctgggggtcatctccctactgacagtaacatcaaacagagacactcaagaattgatgtgagcacctgcagtttgtgcagagttgtgggaagggccctgaccccgagggtagggaagatatctggtgtgtcatcatccttggggacctgcagtctggccctggaggtgagactgtcattcatgaaataagagcaggaagtagaaaagaaatcagcctcactcatgcacggtcacccctcatctatccacagatcggggtactgggcgtgctttgaagagtcctcagtcagcacccagaggaacgggctatggacacgagggttgtgatccacgtggcggggacacctcagagtttgtggctatctgtgttgcttaggaatagtgtctggctgctagaaacagacccacagtgacaggagcttaaacaagatagagctgtgtttttacttttctcacatcagggggttgggcagtaggtggggcagtcatagcagcagctccgaggtcatcagagattcagggttctttgtctttttggctgccactttagcacgtgcctcaggtcacaagcctgctgctgcagtgccagccattgcgtccccactctagaaggcaacaaggagaaagcctcagggttgtgccttgggaacgagtatgcccacctttaaggaactttcttagaagttccatttgctgctgactctgcttacaattcctggaattctctccttgtggcagaggctggcaacgtggccttccagctgggcacatatctgtcccttgttaaggaaggaaggggaagctcacagcttctgcctcactttctaagtgagatgaaatctgacaatgggctcctggcttgcctcacacagaatgaaaactgcaaaagcacaggtccttcaggccatgacttcccacccatcccctgagggctcctcagcctcaggcccccagctccatggggctgtttgggcattaagtgctaaatgcttatttgctgctgggagccccacttaggggcttgaagtacccccagctattagcactgattgtcaaggcagcctaggggcttgagcaggtccttgaagctgaaaagggagtaattaaaacgcctgtaaactgaaagggaaagcataactcataaaattaattatttgtcggcataatttgggaaattattggaatgtctacaaagagaattcgacagcatgtcagagagcatgcagaaggcaggaaatgcccagccaggagaagaaggaagccctaggccagccagcctcatttctcctcctcccttcagtgagtggcagcttgaggtatccggggaaatgagatgtaattcatcttgactttaataaggcccttggattgagctcctcctgagaaagtatccgaatgcccgggaaagatggtgcagcgtgcgctaccattaggcgggtgtggaacttgctaggctgccgtctcaaagagaactcagcagtgacacagcatatgcctgggctgagggagggaagggcatgcaggctgccctggttggcacaagcagcaggcagggagcaatggagaagctgtctgctgcagggggaggtagcagctcattcttctagagcatacatttttggtctcaaatgtgtttccttccaggcaactccttaaggaagatcagcagtatgtagtgagcacagtgcgatgttgaccccaccactcactggccacactcctcgtttttcttttctttctttctttctttttttttttttttgagacagagtcttgctctgtctcccaggctggagtgcagtggcgcgatctcggctcactgcaagctccacctcctgggttcacgccgttctcctgcctcagcctcccaagtagctgggaccacaggcgcccgccaacatgccccgctaattttttttgtattttattagagacggggtttcgccgtgttacccaggatggtctcgatctcctgacctcgtgatccgcctgcctcggcctcccaaagtgctgggattacaggtgtgagccaacacgcccggcccttgtttttcttttcaatcccatttatggctcagatatatttacaatgcatggtttgtccactccagttcttcgcaagctctcggcatgggctagcaccttggacacatggggattacttaatataaactttctaactttcctgacttttcttatcccccttcatccaccatcccccattatcttgtcggccaatcccatttaatagattttattaacggtgactccatgaccttttcagctcaaggcattttaaaatgggacatattaacttacaaattgagcagcaaagctctaatacagtttcagccaagtgaactttctgaggggtgagaggaaaggttggtgctctcacagaagctgtggcctgaaactccaacagactcagttccgcatatcaaatttccatgatgattacccacgatgaaatggaaaataactgaaatttactcgagaattttaaatttaaataaccgaaatggactcagaaatcaatacgcttttggtgtcgagtggaaaaaattccgcggagtgtaagttgtgtataaccgagtgcccagtataattagaaacatttttcttactgccagtgtttacttcagcaactttctaatagtgtagcttgggagggagagtactatagtcatttgaagcaatcagtagttcatatcgatgctgactcgctgtttggctcacaaattcagtttttgttagaaattgttcaaataatgatgaaagacacaggaagaaagaatgtggctgtgaagttttcaggtgaacctgagtgtggaacactggacactgccaggatataaaatgtaatcgattacagttttgtcctaaaacaagcctgtatggattagcaaactccttctatacattttttgaattcatccattaagacgcagatgttggtttttctagaaggggtccagagacaaattatgctataaatcatcattctgagcacaccaagattttcctttttttctggttttatttctttatcatttttcttcttgtaacaggtatatttgtgctgtaatgatttattctggtttcagaacattaccttataatgaaagagaaatatttcatattttaaaagaaatggaaaaaacatttggttatccacatttctaaaacattagtaaaagctcctaaatgttcacttgggctttgaaaggttttctaaagtaaggattataaatgagcactctgtttgcaagccccattcttatctcctcttgggaaattctcaatgtggcattaaatgacattgcacaaaagatttgtttctcaagccctacaagactttctagacctcaggctgtacctgcagaataggataatgttccagattctcccagcgttgcctaaaacactaagtaaaaactgaacaaaatagatatggaatattccattaggggtgggcttcctttggtcttttagaacctacaggaagacaaaggacaggaagctcatgctttaggggaagccactgtgtaccagccttcaccatgctgtgccacgtccttacattcactgtcttactccattcatccctgggggtcacataagataagcatcatatccctattggacagaggcaaagatggaatctcagtgaggtaactcactttcccaaggtgatatagctggacaatgctgagaaatgccggagccgaaacttaagtctgctgggctcccaagcccaggctatcatctgccattactacagtttatgttttttgtttttgtttttgtttttcattctgtgtatatcagccctggtgaaaaatgacttccagattcccacagccgcattatgtggaatagaaaagacatgggcgtgcttctcactctgccgccgtagagggtgggtttgcagtggtttctgagcactttggactgcggtgcacaatgagaactctattttgcattcacacacacacacacacacacacacacacacacaaacagagcatccatggaacaatagtgactctcccagtgtatgtgtactttggtattttctgttctattccattctgtttcattctttaaaacaatgctgctgtgaccacggaattgatttccctatccacgagtgtatttgtgacctacagtttgaaaaatcctgaattccagcaatacagcaacactgtttggtttgactgattcttgcctccctttcggaaaaagcttccgccgaacagaggattcatcagggtctcggctatgaagcctgtcttatcctttcaactgtaaagacagacgggtctgagtgagggcgtgagcagggccgccagccgaggcacatagcggaggactggggtggagcagggcaggtagggtttagcatctgtatcggtgcagatcacctctgtgcacacagagaaggggttcctgggacttacccttcacctgccgctagaggacatgtggaaaaataaaccaatctaagttactgtgagcatcaccttattttgtgattcgcaggcctgtctttcctgctagcctaggaaccctgtgagggcaggggctgtgtctgatttgtctttttcatatctgtatccccatatccaagcacaatgcctgacctataagtaaacaaagcataaaatagatgtctgattgaaaacacagggcttattgttcctgtttcaacacccagtgctgcaccactttaatctccatcttcagcaccatagcctgccttctgccctgactcttgctgtctcgaagtctcggaagaaagcagtcctgagccctgtcacatgtgagttaggccttcctgtctttctgccttgtgatgtccaacagcaacccttcctgggtgccgcccacactgagcctggctttgctcaggagcctaaatgcagaatctttcctcctccccctcccctgctggaaatgctgaatccgggactgcagcccagaaggcgcatggggaaattaggtccacgaacgcgtccccagcgttggggaggtatgccactcagcaccctggacacgccaggccgcagcgctggtcttccacagtccccatgctgtatggaaaaggccccttgccccacggctggagaggggagctggtcgtgggaagagtggaagagaaaccacaaacatgcaattttcagatgcggagaatgcagagacagggcatgggaagtgggggtcgggagaggaagaggaagagacaccaagtcggcaggagcccaagcgagtggccagagcttccaccctcggtggccttgggcccatgttttagaagctcagcgtttggcatgggcgaagatatattttaggaatgaaactggtattttgtgaatagaaataacatcttgttcctaactgacttcagagtcagacgactggcttcacgagggcccggtgtgcagacagcctgccagggcctgcgggctctccccacgtgctgtgcccccaccccagcccaaacactggccccaaatgcttctcttcaatgcctggcaagtaaagatttggaaaaaaaaataagttcagaaaggaacacacaaaactttttaagtgttaaagtattttcttctgaaggccatcagaaaagaaacttgagcttatttgtcaaaggtttgttaacctaataatgccgtagaaatgtttaatgcagtgagaaccttcaggtctatcaaaactgcaagcaccataacaacgcgagaactcagccgtggcccataacaatctggaattaacgataacacccggcacacaaacggcaatatgtacacccacccagcggtgtgcggccggtgactctaccaggtaacgaactcaccgctccctggtttcaaaggcgtatacatttaattctatgtggtaacctggagaaatggacacctgtgaatccctgctgtgttctggatagatgcatcagtcccttatagtttaaaccatgtacatttgggatcatgaaaaacggtgtgtgctgttgtgcaggacgtgaagatttgtgcttcttgcatcgtggggtagaagcagctcccccactggctgctcggctcccagcccctggcttgctagaggagatcggagccagcaagtggtccctgaatggtccagtgaaggctgccgagcacccaggagaactgatactgcacctgagggtcatggacgatgaaatttcactgtgtagagaaactgagatttcacggtttatgtgtaacagggaaggtggtgttgctttagtaaatagaactgggcatgttagaatatcggcaagtgcactctaatttcctcctgtgccaaatccagctgattttacagcattctcagtgggctccttagcatgtgtaggtggggtttgcacagtcccgtagggatactaagtaggatgtagaaattgctcattccttactgcagaggcctggatattcacatccacctggcccaggagggcctatgaattgctctcccagcacctcctaatatcagtttattaattttatttgacatgttgcaaatctccaaaacatcctagagctccatgcttagcatgagtttcctcggattaaccatcattttctactatttctccgtttatgtagatggaagagaagatgaatagtaataatcttttctcaggggtgttgcaaataagctttatattaatttcatcacattatatgacttaaatatcaaaaataaaaatgtgtgtctctctcttcagcagcagggaaaatacctgctggacgtagtcacagactctgtgggctttaactggcagcaaacggtcctggtagaggagaggagaagggggagaaggggcttgtgggaacgagagtaggggctttctatcaaccaattaattaggatctagatagaataaaagcaacaagcaggggaagaatggaggaggggagggagagagggaagaaagaaaggagcagagaggaaggtaggcaattaggtaagaaggggaggaggaaggaagggaggagaaaataagtagaaaagcaaattgacagtggtggttctcagagatggtctgtggacccacagaatcaacatctcctaggaacttgttagaaatacaaattctcgggccttactccagacccactgaatcagaaactcttaccatatgtgtttcgacatgccctccaggtgactctaacacccactctaatttaggaaccttctttaggcattgataggtagaagaatgtaataccaaggactaataaccatgagccccaccagctgtcatagcagagggcttgtacccacggaggatcagtccaggctcctggagagaaacaataagcaacagtccccgtgaaccacagcatgtgacatgtgacatcaccacgtgtgcaggcaaatctctcagaagaaacctcaactgtgtctcaggaaactctggtggttgggtgggaggctggagtctccttaaaataaaggtcatgactttgggaaaaaggtggatatgggtgatgacacattgtctacataagaggactgagctgttgggaccaaggtgaaccagtgaaaacacacgtttggaggaggctagaatttcataacactttatgtcccacatttccacctctagctctctggaggacaggctgggaaggtctcattggccacactgacttccagtcaagtatcccttttcttctggttttgatcggctccctgtcaagatgaatgagatttttgttaaacacgggattttgttgtgacttgggatggggttcatctcaaaaaggagaggaagagcccattcagcggaaaacccattggaagatgaggagtggagaggaaatacttggacggagctctgcaacacttgatggggacaggactccaggttcatgtaaaaggaagacgccaagagaagcacaaccctgtaattcctgtaattcccaggaagccatcaccaggggtcacgtcgggtgtgctcaaagtgcggcacattctaccaaccccgtttgcttttccgaggggggtgggggtcactgaattgatagaccttttccgaggtgggtgggggtcactgaattgatagaccttttccgaggggggtgggggtcactgaattgatagacctaaataccatattcatcctgtagcttgattttctttcttttattctttctttttttttttttttgtgaagaagtctcactctgtcatccaggctggagtgcagtggcacaatctcagctcactgcatcatccacttcttgggtaaagcaattcttgtgcctcagcctcctgagtagctgggattatgggcacgtgccaccacacctggctaatttttgtatttttagtggagacaggatttcaccatgttgggcaggctggtcttgaacttttgacctcaagtaatctgcccacctgggcctccgaaagtgctgagattacaggtgttagccactatgccctgccgattttctttcattcactcattcattcattcattcattcattcagtaagcactttgtagataagatgagaaatatggattgggtaataggtcattagatggactcccactcacatcacccaagcagggtggggattgagctatgcccaaagagtgtgatttacttgatcagccaccacttggagggtgacctcaacaaactctagcatgctgggcttctcctgggcagtaccgtctgtgacttggagcaaatggagatggcatccctgtcaaatatgcaggtgtcacagctaagggggtaattcatcgattctgccccagaatcagaaatcaaaaataaattgctttgttagattggtggttggaatcaacacactgaaatgtagaaaggataagccaacatgctgcactcggatacaacaaccactaacgtggcagcaggatggggagacgtgacttgtcaccagttataacacttggggtttacacccagagagagctgtgaccgtaacttaaactctctgtggatgacaggtttccagatcgaggtaaatggcagcaccatacaaccctgtactggctagatgcgcgtcaagcatcggctccgggtgcctggccaccaggggaagcaggaaaattcaggcccctctgaggagcagagccagaggggcagtgcttcatctgtctcatcgtgtgagccacacagagagaaccaaggcatgtgttcctcctatcatagtcaagtccagttagatatctttgtgacattcaaatagtgtgacagctatatatgtgtacgaaaacagcttacgcagaagacagaggggaaccaatgggcagaagttgctcaaagaaagatttcagttcagcataagggaaatcctccttatgatgtacaccctgcacgagttgacgtaaggagcaggaaggttgggtccaagaagttttgctggtggcagttgacaggtcgcaggcttgggtgaggtgacaggactcctgcccagcaagttggcacatgccgtgacctaggagggcccctggggcaccttctcctccagtctgcataactctatctggacatcatcaacgggcttttcatacgcgccttggtgctatgaagcttcacacaagaagcgttcggcaccaacattcaggtgattttaatttcatataacaaaaccatgatgctgaatggagcgtatgtattccagcttgcgtccatgccttggcatgttcccaggttgcactagccttcccgctgtgtttcatctggcaattatcacttatatttaaagctttggcccaggaactgtctcctccgtagggcctcctttaaagaattccatgctgacctgcactgtagcactattacacagaagtgtaaatgtctgcttcccctactacactatgagctccattaaggcagagacatcgaacttagatttgttacataaacacaaagaaaggaccaggtttcataacagtaggcccccatacatacacattcacatacatgcgcaaacagagacaagtatacatatacatgtatacatacacatctgcatctatatatacacatgcacacacatgcatgtggacacgtatatatacatggacacagataagtctatatacacatatttaagtatacatagatatgttcttgtacatgtatatatacacgtacatctgtacatcctcacacatacacatatgcatgcagttatcagataaaatcggcttctgtgtaattgaaaatctaaagccaaaataattatttcagcaaattataatatttataaattgaacttgtatattttgccatattattagtctgtaatcttttatcacagaatttttagggaggaaaggaaaagtttactagccaatggtaatgttactcataacagagaatcaatagattgtatccagagaaagagaggactaaggttctatgtaaacgtctgaattatgtgtgtataaacattagagcaaaagtacaaaaaccttcccgattactaaaacatatcaaaaaagagagaaaacagaccaaataaagacacacacacttacatatgtcaagaagtgtacatgtaattatatgtatgtagagaaatatatgtagatatagcaactatctacatataaatatatgtagatatagcaaatatatgtagctatatgacagaagtgaagtgaaatttattgattatatcaataaatatactggacttaattagctttataaaaataaataacatttccccagcactttgggaggccgaggtgggtggatcacctgaggtcaagagttctagaccagcctggccaacatggtgaaactctgtctctactgaaaatacaaaaattagccgggcatggtggtgcacgcctataatcccagctactcaggaggctgagtcaggagaatcgcttgaacctgagaggcagaggttgcagtgagttgagatagcgccactgcactccagcctgggtgacagagtgagactctgcctcaaaaaaaaaaaaaaaaaagtacatagatagatagatcgatcgatcgatcatgtcctaggccacagaaaacccaaacaggtccaaagaatgcagacaaatgcaccagataagaaagttgcggattagttttatcttaagagtgttgatgggaaaagctaaaatggtaaaaattatcaaaatccaacagtacatttaaaacagtagatcatattcaagtgggatttattccaagaatgcagttttgatatttgccaatattcaatgcccatctggagtacaagcatatgataaaatagaaatgtattgacatttatttgatacggtaaactgtgcatgtacctcaagctctcaaatctgcattccccatctacttgactgggaaaccctacaggcattcctgctgaaggcagaagcgtaaggtagtccacagtctcctctgctctttaatattgaaatcgacacatttgccacagctgtagacaagagaaagcaaggcgaggtataaatccccaaaaggaagtgattaaactatctttatttgcagataataatatatgatatctggaaactactatgagcaataaagaatttagcaaactagcaagctataaaatcagcatgaaaaaacaaaccgacttcatatgcacaagcaaaacatagcttgaagttgtaatcagagagaagatcccatttacaataacagaataacattagaaaagaaaagaaagctggggataaacttaagaaatagcaaacacatacgaagaaaagtacaaatgctgctggaagttactagagaaggtgtaaacaaacggaccgtgtttttgaacaggaagactcaacatcacagggaagttagtgctccttgtgtgaatttagaattgtcacatgatccccaataaaataataacagatttttttctggagctagaaaagttaatttaaaattcattcataaaaataaatgagcaaaaatagtcaggaaacttctgaaataaaagtaatgagggtggactagtctcctttaggtattaaaacatattgtaaagtgctgtaactaaaatggtgtgtctattggtggatgactagaagatgtccggaacagaacagaaagcccagaaatggaccccattcgatatggcaatttagtatataataaaaggacatcttgaataactgaataaaatagactttttgataagcattattgaaataagtggatacctatatggaaaaaatacaaaactgtatccattccctacccccatatacaaggatacattccaagtggatcggagatatcaatattaaaaatatgaaactgtacaagtactagaataaaacactagttttagtctctctaacctggaagtggggaaaacttgtctaacaatgactcaaaatctcgaagcaataatgaaaagattgatgaactgactatttagaagctttaaaaagctaaaatattccatatgcaaaaaaatacaatgagcaaaggaaaacaagacaaatagcaaattgggggaaatctttgcagtttatatcccagagaaatggttaatatctctatattaagagctctaaaacagagaagaagaagaaaattagaagaaaaatgggcaagctctatgaaacaagagttcacagaagtgcaaatggcccataaccacaggagaatacgctcaaccttatcaaggtaacacataaaaagtgatggtacacagacacacagagaacaatgtgataaaaatgcaaaagtctgacaatactctgatgaggctcgggggagggggaagaggcattgctgctaggaatgcaatgatacaacccctaattaattcaatccaaacacatcagtgggtgctagaactagtgggagaagtttgatgaggaacaggatagactcctcacaaagtatgtatacatcacaaaggaaaaaaaacggagtaactcgaccctggagaaacctggcagtgagtggttgcagttagcaccaccagtaatggggcacctcagaactgtgtaccactggataggatgcgatgaaaagaacacagcctcgcctctgtgctattcgtgcctacgatgcaagcctgaatcaagttaaaaagaaacatcagatggactcaaactaggaacatattgcacaagaaattggacggcagcctccaaaagtgacaaggtcatgaaagtcaagaactactccagattgaagaagacgaaagagacatgattcctaaatgcagcatacgatcaaaattggattctgtcaccacagaagacgttgtgggaaaacaggagaaaccgtagattagatggcagtcatgtgtcaatgccgacgtcccggttttgatgccaatattgtggttacctggtgagtgttcttggaagtacatactccagtatttgggggtgatgggcctcatgttagcagctcactctcaaacagtttttaatgtctttatacaatttgaaattctttgtaaatttgaaatatttcaaaatgaaaattatctttggcgtttaaaaatgtttctcattctttttcatttaaaacacaaactgatgcagcccctgaagcaggacaagttagcagtaactaattaacctgtttaccttctcactcacaaactcgacttttaggagtttattccaaaaatgaacttgcagacaaatgaaaagatacaggtacaagcctattcgctgcaacaccacttgttatagcaaaagactggaatctaccaaaatgcccatcattaagagaccgactgagtagaccatggtatatccacaagatggcatattatatatcataacagaaagaggacgaattcgagaactagagctatggggaaaaagaaggtaccaaaatagaaatcagcattctctgaatatatttgcttatagaattggctttgaaagcatgtaaatatattttatctattcatagcactaaattaattttttttggagacggagtcttgctctgttgcccaggctggagtgcagtggcacagtcttggctcaccgcaacttccacctcccgggttcaagcaattctcctgccttagcctcccgagtagctgggattacaagcacgtaccaccatgcccagctatttttttttttcttatctttagtagagatggggtttcaccatgttggtgaggctggtcttgaactcctgacctcaagcaatccatccaccttggcctctcaaagtgctgggattacaggtgtgtgccaccatgcccagccagcactaaattaatttttaagcctttggaaaagaaattctaagaaattgaaggcaaaattaagcaaagggacagaattgtatactgagttggtggcataacagtatggaaagtaactgtttcacataactttgaaagatggaaatttgtacatcctagtgggatgtactctaaggacaaagaaaaaaagattttcaactgttttcagccattggaatgttggtgggagtggcatggcagatttgtgtctttaagacagttgcatgagtattgtggggctaaagcaactaagtgattatgttgatgtctttgggaaatgagattttcagcccagtcttaactttaagtctgaattgggactataatgattttaccttttaaaacttaacctagtggcactgagcttcctagtaacagaaaaatagcaagtttcttggataaacacatgattgcaggtcagaagcagataatgtgtaagatgagcctggaacatctcatcattccaagaagcaaagacggtatgctatcaactatcaacatggccttgtcaaaaaaactcttaggccaacttgaagaggctcctgctagttaaagatgggaaaatttacaaatccataataataataataactgcaatggactgaaatgcttcaagtacatttcaatccgtaactattcaatgctgaatttgtatgaaacttccaagtcaaaaatctcttttaagatttttagtaagaaacttgagcttcatcggtgaacataacattttctacaccggattttattcttgtgatgacttcattcaagacttttaatgataacctcttcaaatatttgaaagccgcaattgacaagaaagcttctgccaaagtaggaggtcacaattgctgggaaattatttattgctttttccttagttgagagcaacttttttcttgacattaactagaattcagataattaagtctctttaaattatactataagggtacagtgtttctttaggtcgacagttcttctttttatttctttgacaaaagtaatgaatggttttgtgatcgtgtaaatggatttggaatctgatcaaatgtttttaatatcaggtatttcaaaataatgggcatttctgtagacctacatggatgccgctctaccagtcttcattatttttctttagggcataaacactgacttctttaggattacaaaactgattacatctcacagtttttaacaccgtaacatagttgaaattttgctttgaatccatacattttacacgtacacgttagtatatgccatggtctaaatattagtgtccctccaaaatgtgtgtgaaaattgtaacccccaggagatggtgttaggagatggtgcctttgaggggattagattgtgagggctggttgggattagcacccttatgaaagagacctctgagagctagctagtcccttctgtcatatgagattacagttagaaggcaccatctctaagaaaacaggccctcaccagacactgaatctgcctcagtcttggccatcccagcttgcagaactgtgagaaataaatgtttgttgtttatgtgctacacagtctatgatatttttgttatagcagcctgaactaagttggtatacttttcacaggttcttgcagctgtctattgcattcactcaggtgcccaaagacgtcatttaagaggccgtttttgataccaatatcctctgctttaaccaatcttcaaagtgagaccccttcaccaaaagtaataacaatgatgatgataacgatgcattgttcatagattcttgcaaaactctttggacagccaatgcttgtcaatttgaaattgcaataggaaatttaaacgtttctgcttttgaataatattgtttgaagatgcatggatgacaggtcagatgaccaaagacgaacttcatctagaagatcattaaatcgaacaagcttcgactgcacactgggagaactgatgttagtaacaacacttgatgtgtagcgtgagtctgaatctctcaaaagaaattcttgggctaggcatggtggctcattacctgtaatcccaatactttgggaggatgaggtggggggatcagtggaagccaggggcttgagaccagcttgggccgcatagtgagacccatctctacaaaaaatgcaaaaaattagctgattgtgatgactcatctgtaattgcagctactcgggaggctgagttgggaggatcgcctgagcctgggaggttgaggttgctgcagtgggccatgattgaaacattgcatcccagcttgggcgacagtgcaagaccacatctcaaaaataaaaataaaatagcttcttttgtcaaaaatgacattctgattccatatttttcacaaagcaaaaagcaagtgggaccatagcatcttggattttattagacgtgccattctgataacatcacttaatgaggaatacagctttataggccatcttttacctagagaccttctctgcgaatacaacaatggatttcttgattcccaggctcttcagattgaattttgctataaagtgtttatacctttttaccatcattggtatccaaaacttataatttttttctctattatgtattccaaagtgtttgtgtaagctttgaccatttcatccccagcagtttgtctggtatatggtagatactgtagtgctgccacccaggtcggttcttcagggtgacacagctgtccccagtgctggcacataggctgcccagctcacagctgtgaccttcactgagaactgcctgaccaaggtgacacccctcccatgggtcatcctgtggctaacggcgccacaggaaagcccagtcccctttgaatcagttgaggacaacttaagacccctctattccagagctccccagaggatcgactgaggcctcagctactgccatcctgtgggacagcttctccttctgccctgtcctggcctccccacttcctggcagatgtctctgttgagttccactgaaacttaaactccaaactcttcacgcccagagtctatgaccggggcaaacaattgaagacagggaatttttttttttgtaccttaaatagtgttcaaagcatttattttgagggattcaaactcatgccatacaccaagtgccgttactaacatcagcacttatcaatctgcagtggaagcttgtttgatgtaataatcctctagactgggtttctctgggtcatttgacctgtcatccatgcatcttctaatggtattattcgaaagcggtacttttcttatttcctgtgcttcactggtcccaaacatgttgctgacagtttctaatgcaccttggcaaagtgagtgattctgcaattgcaggaggaattttggctttggctgttaaatgcaggacattggaactagcatcttgtattcagtctgacacagttgtggtccactcatcaatactcccacttcttattgtgtaactgcagacaattttcccagttctgatctttttctgtatgagatcaatgctttagggaaaggtgctggcataatttgcctgatgtcattgcatcttctgattcctttttcattaaatacgacattgagacagaagaagacaggattattggaaaatgcaaatctgaatttgagatcattttcattataatttcctgagtagcaactttttttaccactctacttggtacacttgatgactttctttaattaaaaaacgtaaggacaaaaaaccaaacaccgcatgttctcactcataggtgggaattgaacaatgagaacacatggacacaggaaggggaacatcacacaccggggcctgttgtggggtggggggagcggggagggatagcattaggagatatacctaatgttaaatgacgagttaatgggttcagcacaccaacatggcacatgtatacatatgtaactaaccagcacgttgtgcacatgtaccggaaaacttaaagtataataaaaaaaaaagtttcttattatgatgggaaaatatctctctataaatatgcaacagtattaaaaatatcaacctaagtaattttactaaatatatacatatttaaatataaaagtatataaagtggcctgtaggccttaatggcttcaaaaattaacttttcaagatattttgattgcatacatcctcaagaatgtttcaaaataaatcaagttgaaaaattcaaaaagcaaagcttgcattaaccaaaatgagcaatattgacattcctttttatttgattggacaattaaagttctgaaaaactcatgaatataaatgtcagtgatgtcatctctgatccaaaatattttgaaaactcaattatttgaagatataaaaccctacagtcctctttactgagttgatttaattatggaacttattataacatctttaaaaatctgtaaaaacagtaatttattttgagattccatcagtaatcagatcttgctaaatttacatcatcactagccagaaacgaagggaagggggtgggggagaagaaaattttaaaaatcatttttgttttaataaggaacacctaataccagataataattataaacataatcatacgttttacttagtcacataggtaaaaatactagcaaattaattgaataagaagcgcccccacatgctgagcatgttactgaaccaaactgggtttgtctgtccctgcatgagaggaagacgctgaagcactgggtttttgcagcaaaaaagctttattgaatgtcaagtggtgaggagcaggaggaaagactcaaatctgtctcaccacactgggggctgtaccgggctttataagcatagggtaatgaggcgtgttctgattggatcttgcagtggggtaacgccagagctgaatctgattggatcctgcttcagctttgccatgtccatttcttaatccagtccctgctcctctgcctgagcacttaggttcccccaccgtggttgcatgcttggttcatctgagtgtgctcagagtctgtagtcttcaacccgggggtccgtggcaactgaaaaacaactcacaacctacttacacacaagtcgaaccacattgtgaagcggcatttttgtctagggtaatacccaaagtttgttgtctcacgctgacgaaatcaaggacccggacacacaaggagtgaggttaagagtggaggtttaataggcgaaagagagaagagctctctcctgcagaggggtccggagtgggtttttccagtccgccacaaaatgcaaaggattttacagatgagctggaggaggcaatgtctgatttacatagggcatgaaagattggtcagaccaggtgtgccatttgcataaggcacaaaaaaccaggactggatgcgccatttgcatagcctccaaaaatctggccacccacaccctaatcttttattatgcggatgggttatctcccccgctggtgccttgttgcctgcatttttactgtacacgtggtgacaaagaaaacggaagatggagcctccatgttgaatgtgtctggccctcaggtagcccttttctgttggcacagctgccggcattcacctgtgcaagtttctagcttgcttatctatgtctgcagctcagtttttcaggctgctctttgttagaaaagaaatgatttgggagctgttttctgttaaaagggaagccttgccaaagactctcttaccctcactatctgcctaaataatttctttctagctcctgtatcaattggtcctgtgcctggtacagacaaacaaattcacagatgagaaacaacctgcaagtgaaataaaacagcttgataagaggggtccatgggggtgtcagggaagtgccgtgtggctcagccaacctgtgcctttctgcagcagatcctctcaagagagttaccgggttcagaaagtttacaggaaccacatgcatagttttgttttacttttttttttttttggagtactttcagattcataggacagttgagtagaaagttaaaagagttttgatatactctctgcccaacatgtacaaagcctctcccactatcagcatcccccaccagagtggtacctttcttatgagcagtgaacctaccttgatacatcactacccaaaatccatagtttacgtgagggttcacgcttggcactgtgcattctgtgggctttgagaagcatatggtgacatgtatcccccgttatagcctacagaagagtttccttgccctcaaaacccccatgctcctcctgttcacccctcctgactgccgacccccagcagccactggtccttttgctgtctccatagtttgaccttttccaaaatgtcatatgtagttggaatcacacaacacatggcttttccagaatgacatctttcactgaggaatgtttaatgcatgcgtgtcgtgaaaacacagcatatatatagtgaaaacagcatgaaatgtaacttcaacagctgcaattttttttttcttttttgtgacggagtctcgctcccttgccaggctggagtgcagtggtgagatctcggctcactgcaacctccgcctcccaggttcgagcaatactcctgcctcatcctcctgagtagctgggactacaggcccgcgccaccacgcccagctaatttttgtgtttttagtagaggtggggtttcatcatgttggcccggatggtctctatctcttgacctcgtgatccacccaccttggcctcccaaagtgctgggattacaggcatgaaccaccgtgcccggccaacagttgcaaatgtttgaatggctgtaaacggtggtttatggctacaaaaactaacagatatccctgtctctgggtccctgtgtaacctatccgaggcacagtgagagaccactgcactgtcccacctccttcttccccatccactcccagaaatcctctcttcaggtaggagaaactgctactctctgatccaggtttcacatatttccgtgggatataaaacccctagtgcctgaaactgctcttctggtttctcctttcacctgtgattattccctgagtgtcgggggcttcaggacagaagactttgtcattggctgtgagcatcaagacagtgtccaatgggtttaggctgagagccagctcagccaggtgcctgcgtggggggaattatccagtgaaaagatatttgtctgctcagtgaaaaccagaaaggagcataacacctgtcacgttaccagcctgcctccaggcctgccattggaggcacagcaagggtctaatgctaatcatccggggaggaagtgtcccttgaggcttagtctgagcagcgggaggccacgctgcacacttgaaaccccttttgccttgacttttctgcagcatagttggactaagcccttgtcgttggcttaagaaggggcagggttatgtaaccctcaataattaagacctttccagccataaccactcttttattttcaacactgtcaagaaggatttgccggctgtaactctttctcgcttgagggcatttttaattccattgtccacaaatttctgagtcatttctgatggcggtaatcaggacaaagagaagccgaagacctgggaataaaagcaaggttggcgattttttgaattaaacctagggtattgagagaaaggaaactgaggctttagaacctcccttgtcctgtgactggggaaggagagtgtgtgcccacaggtcaggctccgaatctgacaccagggagcccaggtagagtgagtgtcacagccaggggctcaggtagagtgagtgtcacagccagagacccaggtagagtgagtatcatagccaggagctcaagtagagtgagtgtcacagccaggggcccaggtagagtgagtgtcacagccaggggctcaggtagagtgagtgtcacagccaggggcccaggtagagtgagtgtcacagccaggggcccaggtagagtgagtcacagccgggggcccaggtagagtgagtgtcacagccagggacccaggcagagtgagtgtcacagccagggactcaggcagagtgagtgtcacagccaggggctcaggtagagtgagtgtcacagccagggcctcaggtagaatgagtgtcacagccaggggctcaggtagagtgagtgtgagagctcgtgattttaggtagcccacataatgagaagggaggggaaaatgccttgttaaatgggtgaactcaggaatttgtttctctgtaaacatggtgtgccccagagaggcactgcctccaggatgcaggaccagaacttgacgtgaggattgtgctgcagccacgcaaaggtacagacgtcctcttgaatctgcaggaaatgactacttatttaaattatgcaaatttttttgttgcatatgatcctcatagccttactttagagaatttaacaacatttgatatttggtattctggcattcctgagtcagtaattgggcttcgtgaaaccccagagctaaacctaccgagaatgagatgccgtcctcaaccccagaggttgtgggttctaagagaaaacgtcacaacaaatgttggtcttttcccaatagctcctggcgtttattctttcttttcccttttcttcctttttctccttcctcctcttgtgttttcttttctttctttcagcagagattgttctggtcatctattgctgcctaactgactaccccaaaacttagagattaaaagcaacacctgtttatatgtcatgattttgcgggtcaggagttggagcagggcttggatatgtgaccgtctgtgcctctcattcagttgggaagatggcttcgtgcacacgttggcgccatggctaggaaagcggaaaggctggctccctgggctgtccactgggcagctgcccctggcctcgccagcctgcagcctcaggatccccacactcctaccgctgctcagggctcccggaaggcagcagaagctgctagtttattaggacctggatcatactctattggtcaagcagtctcagagcctacattgaagggtttcagacatagacaccacctcttcatgggaaaagtatcaaagaatatgcagcattttgctttgctttatttttttttagggacagggccttactctgttgcttggagtgcagtggcaggagcatagctcacggtaacctcaaactcctgggctcaaaccatcctcccacctcagcctcccaagtagctaggactacaggtgcatgccaccatgcctggctactttttttacttttgtagagacagattatctcaccctgttgcccaggctggtctcaaactcctgggctcaagcgatcctcccaccccagactcccaaagtgttgggattacaggcatcagtcaccatgccctgcctgcagcatgtttgaaaagtgagatttattgtggtttcataatttacatacagtaaaactcaccctttctagagtacagttatatatacattttcacaaacatctttagcccacattcaccagcgtgacggagatatgactatttctgtcacctcccccaaaagtctttgtgcttttatattcacccctttacccccaccccagcacttggcaagcactgctgttttttcttcttatatctttgcctatttcagaacatcatataaatggagcatgcagtgtgcagtcttcagaacctggcttccttcccttagtgtcatgcatttgagattcacctgtgcgttcatgcgtataagtattttgttcccttctactactgagcagcatcccattccatagacacactacagtttgtttcccatccattggtttaaaaacatttaggatgtttgcagtttggggtgattattaaagctgctatgaatatcacatatagattttatttatttatttatttagagacagggtctcactctgtgcccaggctggagtgcagtggtgtaatcacagctcactgcagcctcaacctcctgagctctagtgatccccccatctcagcctcccaagtagctgggactataggtgtgtgccatcatgcccagctacttttttgatttttttttgtagggacggggtctctctgtgttacccagactggtttcaacctcctgggctcaagcgatcctcccacctcggcctcccaaaatgctgggattacaagtgtgagccactatgccccgcttcatgtagatttttatgtgaacttttacatgtcttgtgcacagttacccgggggcaggattaccgggtcacgtggctcgcgcatgtttaacttcgtaagaaagcaccaaacggtcccaccaggtggccgtgccatgggcatccgcatctcaaactgcgagggccttgggcactccacatcttcacggacatgggttgttattgctgttggtttgtgatgtttgagtccttctaataggggtccagggcatcccatcatggtaaatgggatggtgaggttctcttcactcatggatttcctgtcgttctattggctttggtgaagtaactattctttttgcgtacatttttggttttcttacagttgaattttgaaaattcttttttctgcatagtaggtttttgttctttttttttgtttttttctttttaagagacaaagtcttacttggttgctcacggcagcctcacactcctggggtcaagggatcctcctgcctcagcctcccgagtagcagggactacaggcatgcactaccacacccagctgatttttttttttaattttgtaattctttgtagcggtggggtctcactatgttgcccaggctggcctcaaagtcctggcctcaagcgatcctcctacctcaacctcccaaagttctggcattccagccgtgagccatgagccacagcacccggcctggataaacgttctttattgggtatctgtcttgcacacgttgtctcccagtctgtggcctgtcttttcatgaagtcagctttattcattttttttcttttatggattatgtccttgatattctatctgagaaatttttccctaacccagtgtcataactgttttttcctagaagtattaataattataggtttacatttatgcctctgatccattttgagttaggttttataaatggtaagaaatatagatctagattttgtcttattttgtgaatgaatgtctaatatttccagcaccatttgtcgaaattactatcttttctttgtgcttttattgaaaaccagtgatatatgtgtgagtaatttcttgcctgtcttctctgatcagtgtgtccagcccttctccagtaacacccgttttaattactgttgatttccagttagtcttgaaatcatacagtaaaggttatccaaatttttttcagacttgctttggctattctagttaccttgcttttccatatagattttagaatcaccttttcaatgtctaggagatatctagctgtgattttttttttttcttttttgagagcgggtcttgctctgtaacccaggctggagtgcagtgtagctgggatttagattggggttttattcactatattgattggtttggggagaattgacctctttactgtgttttcttccaatgcacccatgtgatatgattctgtattgacttaggtgtttggtttccttcattcgtgttttgtagttttccgtgcacagctattgcacgtagtttgttaaacttgtatctattttatgtttttagagcttaaatgagatattagctgtaggcgttttataggtgccctttttaaaatttagaatgttcctttaaattcctactttgctgagagggttttttcttttttaaaaaatcacaattgattattaaattttgccgaatgcttttcctaaatctattaagatgttcatatgtttttctattttattctgttgatgtgatgaattactttgattgttattcacatcttgagccagccttccatgtataagatacacctcgcttgatcaggctagactatgactgttatatattgttgaattttattttctaatattttgttgaggatttttttgaatttgtgttcatgatggatattggtctatagttttccttcagaggctttttctgattttggtatcagggtaatgctttagaattggtttaatttattcctcaaatgcttggtggaattcatccatgaaatatgcgtagttcttacctttgttcctctggatgctgtgtgtctgcgctcccaaagcttctgtcctctcttgtagctcacattcagccttcggccattcattgaggattttgggtgaatttcagaatttccattgtctcctcctcccgcgctctgtgacgggtgagcaggacccatcctgactccttggacaggcccatctttccttgtgtttccgaccacctggctggtatgcaacctaagctgtcttatgggctcaggaaaagtgattgttttgtactttgttcaacttttcttgttcttaggtggatgtgatgttctttccaatgctcggcatcccaggcacagcaagccctgtgtccatttttaacccacacattttacaggatggcaagtagggcagtttcctggtgacttagagagggggccgaggggcatcacagccatgaccagcagtggatggggacagagggtcctcctgcatgcctgggaagagaagacttgaggggcttggccaagtttatgtttgtctcatctctgcctgagacgggcttttggggaagggagccgagaagagtgtagcgattttcaccaggaccacatgggatcccgtgtgttccggccgagaagacccttgtttttctttctctgcgtggatccacaggatcttaggcttctgtgcctcactttagaacaagcacctgaagaaccaggaccttccttccacccagtggaagccttgatggtgcagccggaggcttggctcctctctgcaggccactggggttcccatcctgaagaagctagccctgcccactgccctttccggaaggccttcagttccccattgccttatgtatgcgtcatcagccgtgctgctgggcacggtagacaatcccagcgagacccgcgcactgtcagcaccccgcttccccccacccctcgtccagccgtgctccgtgtgcacccatcctcgccaggctccttggcaacattttgccttttcccatggctctcccagctgagagtgcccttctcaagaacttacccctcacaggccacccttcctcccaaacacagtccagatgaggccctccagccctcccaggccagaggcagtcatctgcccttcacgagtttgctgctctgcagagcatctgcctcttacagttacacgagcatgtcccctagaaagggcatgccctgaaggcagtcatttggcaggtatataattgggttcaatagctgttctgtaaaagagagaaacaaactgtggaaaatccaaaaatgattgtccccgttgacagacaaagagaaatttaacctccaacagcatatatgggacaagggtgatgattttgtttgcttgttccccaccccccgcctcaatgtaatgaacaatttagcttgaaacatagtggtatatattgagggaggatttctagatgaaaccttgccttgatctcaaatatctgttcattgaaaaagagattagagaaagctttgcttgccgtccgtcttggaaccacaggaaaggcccatctgtggaatgagaggatggtctggtccacctttctgcctatgccttaaagaattctgcaagagaaaatgaaaaatagcccaattctctttcttggtaatgccactgtaagcttcccaaaacattcatcacacttcctcggtctcagtgcaataattgcctgtgagcatgatggcagctaagggtttcctttctgtctctccaccccatggtccctcctgccatttgttctgctgtcatcaatgactgccctgccacagtgcccaccgcgcccccgcagaacgtgcagacggaagccgtgaactccaccaccattcagttcctgtggaaccctccgcctcagcagtttatcaatggcatcaaccagggatacaaggtacgtggcctgggttcagggcctgtgggcagctgtcattgtctggagccacagcgcgacgcagctggaggcaccccctcttgtgtatcaagagctggttgcattaagatacagggcgtcttgaccttggtgagaccaccatttatccaaagtcttggcatcagctctgcaggttcagaaattcaaattcctagttatcaagaggatggttcatacatcagtgagcaatttcttatgagaaaggccattcatttttaaatggtgggtgggagacgtgtctcagtgattagaatgaatatttgcacaaactacttcttcccagaaggaggtcctctcaggagaacacaggccccgagcaaagggaatggtgtgagtgatatttccatggagaaaggatagttttctctcctccctttctacttcagggagagttctgtttaaagaactgagaccagttgattccagctacccgcccatactgaattagacacatagacaaatttccatcatccgacttcttgtgtctttagctaccagagtgtgttaacttcactgatgtaccaggatacaccatcacaaagcacagctgatcctccctttcagatcagcttctcctgattggatttgggagcgcaccttgattttagctacaataggtccactaatcgtctttaatagacgatggacaggggaagctctatacagtgaagggattccatctagtttcctcaatacctggtaatttcacattcagagggtgagtttcctcagacacaaggttcagttttcttttcccacaatttgcattcaacttactaaaacactgatttgtctgccagaaaggcagaagtagctggaaattttccctgcctttcgtttaccctcagaagtatccaaagccagaagcttttgtgaaagaaaatcatattgatcaagcaagatgcttttgccttcttccctctcctgtcgagtctcgttggcaaggctgcagtgttcgtttgatgacttcgctgtcagtttgatctgtgtaaatacgctttgcgtcctgcagcatgtcaactttcagacccaattagtcctagaaatgtttggtgccaaaggaattaaaagtcacacacctacgtaatgctgccaaaacatgaacacgctttccttaggttgtggatacagtctgtatttctttaaaattgtaagcagtctcctaaaatcctttttgcgaaactagtgtgatataaattataaataattaagattattgctgttgaatcatggatgtcttttttgagacagagtaggtgctttctagaaaaatatttgtatttgtttcattgtgctgtttcagctgaattaacagatggtttcatctttattctttactgttaaaatatatattatatactatatggtatatattatatataccatatagtatatattatatatagtatatataatgtattatatatacatacatactatacgtatatattatatatactatatatgttatatatatgctatatatgttatatatgttatatatagtatactatatgtgtatatgttatgtatgttatatatagtatactatacatatatatgttatgtatgttatatatagtatactatatgtgtatataatatatatgtataatatatacatattatatataatatatgtataatatatacatatagtatatatgtatatattatacattatatatgtgtatatattatatatgtatacataacatatactatatatgttatatagtatataggttgtatataatatatatataatatatactttttatgtatatatgttatatatggatatatgtaatatatattatatatatgttttttaaccttcttaagtgaagagagggtgaagatttgagggagtgtccattattctaatatgagttaagtagttatttacatatacaagtataaaatacatgtaaatatacatgcttgtatacaaaaacctataaaatatatttttatctcaacttttttcaagcgtgattataaaatgcaggatttatggactttcttaattatgactttacattttaaaagacaaaataaaattctgctgcagacatgagtgtggagaaatgccattgaaaacaggctgtctttttcaccctgttccatctcagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacagtgagtattcctttctgcgtgtctcttaagtcacttgtcaaagaggtgtataccgctgcaacttccagaatcaggcaagggcagaggtggatcacgaggaggccccggatttttggagtgcttgcagtcagctcacctagggagatcaggcatcagtactgataatgcctcgcagaggatggcacgtggacagtggagggtggccttggctcaaggaaggagctctggggacagggggtggagaatcaggttccagctgtgtggccacagctttggtcttgctgaacttgctcttcatgtagagttcaatttctgattccctcacctgcttccatgatccccccccccccgacgtcccccagcccattctttcctgaccctcgctcccagggtccttttccccacgcccttctaagctccctgagtttgcattacctccatctggtcagttcgaagccactccttctctgctcacaggccagctgacgcatctggaaaacgttagctaatgaagttaccccgagaaaatagtcacagatgcacacaaagatttatatatatacaaggcggctcgttacagttatttgtagctggaaaaaatgtgaaaagcattcagatgttccagatggggagaattgggaaaaagtatagaatgacaacataagaaatattttgtagttgttgaaaaaacgaaactctgaagatcaaaaattgtgcgcaaaaatggtcatgatataacattgtgaaataatagtatacaaaactatgagatccaaattttataaaaatatactgtatgaaatatgaacagagaaaagaccttggaagaaatacgtcacacaaatttaagacttgttatccctatgtggtatcattatgagtagttttggcatatttcgttgtatttttttgcattttctagtttctaccacgagtctgtactccctctgtaatgaaagttaaaactagaataattagggccatgcagtggttcatgcctgtaatcccagcactttgggaggctgaggcagttggatcacgaggtcaggagttcacgaccagcctggccaagatggtgaaaccccgtcattacgaaaaatacaaaaattagctgggtgtggtggcaggcgcctgtaatcccagctactcgggaggctgaggcaggagaatcacttgaacccaggaggcagaggttgcagtgagccgtgatcatgccactgcactccagcctgggtgacatagtgagactctgtctcaaaaaaaaaaaaaaaaaaaaaattaggaaaattattttttaagtcaccctgggctgctgcttgtctctcccccagtgctggatgggctcagccttctgaacttgtctctactagagtttggccgtcgccagctccaccccgtgctgctcccgtttttggactcccagcctcaccgcactcccagcaggtgacatttgcagaggccaaggccaccaagacggattccttgccttcccacttcaccctttatttccgtgtccttacgcttgcctctctcccctttcctctcaaacgatgcagtatggcctttctaagggtcctccgtcatcctgttcccttcttcccctctctgtcttcatggcgctattacttcttccaatctttttactattggatcctttccctcctcccacaaatatgttcaggtctccctcactcaaaatcggcagctccctgactgtgctgcccctggagctgccgggatggctccccactcccttttagtctaaccattgctttgaccttgaacgccttatgttctccttgacccttggcagcctagctttctccttgccactctcctggaacaatctcgccattgactcaaggtctatgtcaaatgagtgacaggggaggaatagaacatggatttcttgaccctctgagaccaacaatcaatccctcctcacaaaaaagatgaaatgaaaagtagccctgctgctgctgtgaattgatcccagaagttcttcccatactctgcctttgctctgctttctgcttttgtttaactgattttggctttttttgttttttgggttttttgttgttgttggtggtggtggtggttttttttgttgttgttgttgttttgagacagaatcttgctctgttgcccaggctggagtgcagtggtgcaatcttggctcactgcaacctctgcctccagggttcaagcaattctcctgccttggcctctcaagtagctggtattacaggcaccggccaccacgtctggccaatttttttgtatttttaatagagatggggtttcaccatgttggccaggctgctctcaaactcctgacctcaggtgatccgcacacctcagcctcccaaagtgctgggattacaggcataagccaccacactcaccaaggttaactgaaatttttattgagagcattacagattcatatgcaattatatgaaataatattgagaccgtgtacatttagcccagtttctgccaagctgacatttgcgaaactatagtattgcatcacgtccaggatattgacactgatgatacaattcacagatccgatttgggtttctccagttttgtttttttctcttttgtgcatatgtgtgtgtttagtcctgtacagtttgacacatgtgtaggtttgtgtatctaccacgataatcaagatcttgaatgtttctaaggccacaaaaatcatctgggttcctttatagccacacccaccttcctccagctcttcctttctaacctgtatgcctttcatttccttttcttgcatgatttgcagtgtctaggatttctagtactatgctgaataagagtgatgagaccagacatccttgcctgcttctcacctgagaggcaaaacattcagtcgttcactgttaaggatttttttttttaatcaagttgaagttattcctcactattgctaattggttctgagtttttgacatgaataaatcttactttttttcacgtgctcttactgcatcatttgacatgatcatctggtttttcttcttagcttgttggtctgttagattacattgactgatttgcaaatgtcaaaccagctttgtgtacttaaattcaacttggtcacagtgtataattcttttcatatgctgttggattgactttgctagcacttggcgaaggacttttgcatgtaagttcatgagagatattaatctgtagttgtctttttttgtgtgttatctttgtctggtgttggtatcagagtaatatggtcccatgaaatatgtttagaagtattcccacttctatgttctggaagagattgcgtaaaattggtgtcattttctctttaaatgtttggtagaattttccagtgaaactctcagggactgaagaattctttctaggaatatttttaatataaatgcaatttataaatggttttaggactatccaggttgtctgtttcatcttggctgagttttgggagttgttggttttcaaggagttgatcctctaagagttcagatttgtgagtatgaaaatgttagcagcaccaccttcttattggttgcaggatctgtagtgatgtcctgttttttattcctgatattgatgattggtttcttctggctttttaatgttgtcattcttcctggaggttcttcaattttattgcttgatttttttggtttgtttttgttgttgttgttgttgttgtttttgttttttgtttttttagaaccagcctcttgttccaggtctcctcttcttcatggtctccttcattttcaactttattgatttctgctctttataatttccttcctctgcttgctttgagtgtattttgctctcccttttctgctttcttgaggtagccatgttggttattggttgaagacctttccttgtttccagtgtgagcgtttagtgctgtacatttctgcttccatgatgctttagctgcatcccagatgttttgacactctatgctttcattttcatccagttctctgtatttttatttcctttgagatactctctgtgacccatgaattaattggaagtgtgctgttcattttccatgtgtttggagattctattgtctttctgctattgataatctgatttgattccattatgatcagagaacacacttcatataattttagttattttatatttgttgaagtttgtttaatggcctaggatatggtcaatcttggtgaatgttcaatgaatgattttttaaaaatgtctatttctccttttcaattgtaaattttatgtctcagagaaaactggaaataatctcaattttttttttttttttagaattttctaactgaatcattttttggtaggcagggagcctgtttatcctatttaggataataacacatctttgtaaatgtcaaatatcacattaaaagactgaaggtagggttgaagtcacctctggggggtgtagcttttaaaaggaaagtttggagcctgaatgagaggggcttcaggggccagctgaccacagtcacctggtactggcctccttcataaagaagaacaagaacagcaagtaggtaaccacacttcaaatagatccaagagagaagctggaattcaatagagaagtgacaggaagcacctatggcaaggaggaaagtgaagtgcagcagctcctccgggactgagatcggctgggaacccagacaggttccccactgtgggaaaagggaaagggagagacccccgtggtccacattcccaccacagactcctgcaatccgagccacaggaaagcccctcaaaactcacaggcccaagactcacgtagggagactctcacagggagaccgtgtgatgtcctgctccagagagggagcccacgctgcaccccacacgcccgagcccagagcagctactatgcagtgctgctcaaagagcccagccccaccagaacattccgccgtgggtcccaccagaccattccgccccgggtcccgacagaccattctgctccgggtcccgacagaccattccgccccggctcccgacagcctctgcatctccatattctgcagccccactgacatcccctgcccacaaccaccaccactgctggctgctgccaccagaggcaaagcacaaaccattggcagtgacccccagtggtggggctgctgggcattttcactcatcttgaggacagacttcgcttccaggcaccctgaggtcagactctcccacccacagttgccacctgggtctgaagcacacctccccagcagcagggccgcagtgcagccattgccagccctaccaagtgttctgccaggaacctgggggtcaccccaccccagctgaccacagctagcaactgcacacaccaccaggggtcctgaggacaggcctgcttggcttgctcagcctcccccagtatgagcaacactatccagggccctgggctcaccctgccctgtccaccactatgagcacctgagtacttctcctggggacctgaagtcgggcccacccaacctgctgcaccatcacagctggcacccattcctacacaccacccctgggcctggggactggcctgctcagcctgtcacagccaccagcaataccagtgcagactgctaaggagccaggggattgtcccaccactgctactgtcactgcctatagcatgcctgctgtccagggccttgagaacccacccacctgcttggccccctgcagccattgccagcacctgagcaacccacctagaatgccaagaatgagcctgtctggatcactctgggatgtaaggacaggcacactcagcccactgctgccaccactggggcccaaggattggcccacctggtgtccctgtccccagcaaaactttaccacagcctctactaacaaccacaccctaagccgctgaggaaatcacagacaccactgatgctgtttacagccaaataaattatatggagactacactactgcttcatccagaatcaaagccaaagtaccctatccaatcaacaccatagatacatcttcaggaaaaagccctcctttatgaaagcaaatccaaaaaattagaagaagcaactgttacaccagatgtgcagatatcaacataaggacacaagaaatatgaaaatgcaaggaagtataacacttccaaaggaacatggtaattctctagcaacagattccaatgaaaaagaaattatgaaatcccagaaaaaaaataaaaaataatgatattaaggaaagtcagataaaagagacacagataaataatacaaaataatccaaaaaacatttcaatacatgaatgagaaatttaccaaagagataaatattataaaaaagaaccaaacagatatccaggaactaattaattcattgactgaaatttaaaaatacaatagtaagcttcggcagtagactagatgagacagcagaaggaatttcagaatttaaagttgaataaagactatgtgatatatgagtcaccataaaggaatgagtatttgaatttttgatgtcccagaaggtgaaaagaaaaccaaagggatacaaacctgatttaacaaaataatggctgaaacccaagtctagcaagagatttagacatccagatatgggaggctcagagatccacaaataaatagatactattcagaaaggtcttctccatggcacattgtagtcaaattatcaaaagttgaagacagaattccaaaaacaccaaaagaaaagcatctactcacttataagagaacccccatcagactaacagtggatttatcagcagaaaccttacatgccaagagaaaaatgggatgatatattcaaagtactggggaaaaaaataacttgttagccaagagtactatatgcataaaagttacccttcacaaatgaaagagaaataaagtatttcctagataagtaaaagctgagggaattcatctccactggactggccctacaagaaatgcttaatgaattcccacacctgaagtgaaagaacaatatctaccatcatgaaaatgtacaaacgtataaaacccattggtagagcaaacacacaaataaggaagagaaaggacccaaatgttaccactacagaaaaccaccaaacctcaaaaataaacaatgagagagaaagaagggaacaaaggatatataaaccaaccagaaatcaattaataattactagaataagccctgacatatcaatagtaaccttgaatttaaatagattaaagtatccaaaaggatagactggctgaatggataaaaacaaaaacaaaaacaaaaacaaaccatgacccaactataggctgtgtacaagaaactcagctcacttgtaaagacacatgtagactgaaagtaaagagatggaaaaagagattttgtgcaaacagaaagcaaaagtgaacaggagtaggtacgcttagataaaatactttaagtaaaaaacagtaaaaagagacaaagaaggttattgtgtaatgataaagttatgaattcaacaagaggatataacaattctaaacatatatagaccaaacactggagcactcagatatataaagcaaatattattagatctacagggagagacagcaatacaataatacttggggactttaacatccccctctcagcattagacaggtcatcttgacagaaaaataacaaagaaacattggatttaaactgcgctttagactaaatggacctaacagacatttacagaacatttcatctaatagctacagaatgcacattcttttcatcagtacatgtaacattctccaagacagaccctatgttaggacacaaagcaaatctcaacaacttttaaaagactaaaattcgatcgatatcttcttagaccacaatggaataaaactggaaatcagtaatgaggaactttggaatctgtacaaatacatggaaattaaatagcatgctcctgaatgacctttgggtcaaggaagaaattaaggaggaaatttaaaaatttcttttttttttttttttgagacggagtcttgctctgtcgcccaggctggagtgcagtggcgcagtctcggctcactgcaagctccgcctcccaggttcacgccattgtcctgcttcagcctcctcagtagctgggattacaggcgcccaccaccacacctagctaacttttttgtattttttagtagagacggggtttcaccatgttagccaggatggtctcgatctcctgacctcgtgatccgcccgcctcggccttccaaagtgctgggattacaggcgtgagccaccacgcccggccagaaatttcttgaaacaaatgaaaattgaaatacgacatacagaaacctacaggatacagcaaaagcgatgctaagagcctacaataaatgcctacatcagaaaaaagtagaaagatttcaaacaatctagtgatacacctcaaggacaaaccaaacccaaaattagtagaaggaaagatataataaagatcagagcagacctaatgaaacaaagacttaaaaacaatacatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattgtgtaggttgcctgttcactctgatggtagtttcttttgctgtgcagaagctctttagtttaattagatcccatttgtcaattttggcttttgttgccattgcttttggtgttttagacatgaagtccttgcccatgcctatgtccggaatggtaatgcctaggttttcttctagggtttttatggttttaggtctaacgtttaggtctttaatccatcttgaattgatttttgtataaggtgtaaggaggggatccagtttcagctttctacatatggctagccagttttcccagcaccatttattaaatagggaatcctttacccattgcttgtttttctcaggtttgtcaaagatcagatagttgtagatatgtggtgttatttcagagggctctgttctgttccgttgatctatatctctgttttggtaccagtaccatgctgttttggatactggagccttgtagtatagtttgaagtcaggtagcgtgatgcttccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacgtcccttgaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcgattcctcagggatctaggactagaaataccatttgacccagccatcccattactgggtatatacccaaatgactataaatcatgctgctataaagacatatgcacacgtatgtttattgctgcactattcacaatagcaaagactttgaaccaatccaaatgtccaacaatgatagactggattaagaaaatgtggcacatatacaccatggaatactatgcagccataaaaaatgatgaattcatgtcctttgtagggacatggatgaaattggaaatcatcattctcagtaaactatcgcaagaacaaaaaaccaaacacggcatattctcactcataggtgggaattgaacagtgagaacacatggacacaggaaggggaacatcacactctggggactgttgtggggtggggggaggggggagggatagcactaggagatatacctaatgctaaatgacgagttaatgggtgcagcacaccagcatggcacatgtatacatatgtaactaacctgcacattgtgcacatgtaccctaaaacttaaagtataataataataataataaaaacaatacaaatggttaaacaaaactcagttttagggaagatacacaaaatcaataaactgctagctagacttaagaagaataaaagacagattacttaaggaaacaaaatcagaaatgcaaaaggagacattataactgataccacagaaatacaaaatatcatttgagactcttactaacaactatacactaacaaattggaaaacctaggagaaatggataaattcctgaacacatacaacctaccaagattgaatcagaaagaaacataaaatctgaacagactaataatgggtaatgagattgagtcagtaataactctcccaacaaagaaaaacccagggccaagtggtttcactgacaaattctaccatactttcaaggaagaactaaaaccaattctcctcaaactattccaaaaaattaaagaagaggaaattctttctaactcattttatgaggtcagtgttacccagataccaaaaccagacaaggacataacaacaaaaaactacagtccattatccctgatgaacatagacacaaaaatcctcaacaaaaatattagcaaactgaatccaacagcacgtcagaaatataatacaccatgctcatgtgagatttatcccagggatgcaaggatggttcaacatatacatatccataaatgtgatacatcactccaacataataaaagacaaaaaccatgtgatcatctcaacagatgcataaaaagcatttaataaaatttaacatccctttataataaaaactctcaacaaactaggcatagtagaaacatacctcagtatgataaagtctgtatatgaaaaacccacagctaacatcacactgaatggggaaaagctgaaatcctttcctctgataactggaacaagacaaagatgcccactttcatcacacctatttgtagtactggaagtcctagccacagcagtcaggcaaaagaaaggaataaaaggcatctaaattggaaaagaggaagtcagattgttctctttgcagatgacatgatcttgtgtctaaacaaacctagactccaccaaaaaactcctatatctgataaataaatttggtgaggttgcaggatacaatagcaacacacaaaaatcagtagcatttctataaaccaataatgaactagctgagaaataaatcaagaagttgattccatttacaatagctataaaagaaaaacatatctaggaattaatttaaccaaggaggtgaaagatctctacaaagaaaaatacaaaacattgatgaaaggaactaagaaactgaagaagacacaagtaaatagaaagacatcccatgctcatggatcagaagaattagcattattaaaatgaccatactccccaaatgaatctaatgactcaatgcaatctctatcaaaataccagtgtcattttcacagaaatagcaaaaaaaaaaaacaaaaaaccccgtaaattcttgtggaacccaaaaagagcccaaatagccaaagcaatccatagcaaaaataacgaaactggaggaatcacactacctatctttgaaatatatgacaagtctataataaccaaaaccatggcatggtattggcgttaacaacagacacatagaccaatggaacagaatagagcacccagaaacatatccatatatttacaaccaactgattttcgataaaggtggcaggataccttcaataattttggtgctaggaaaattggatatccatatgcagaagatcgaaattaaaaaataactcaagatggattaaagacttaaatgtaacacttgaaattataaaactactaaaataaaacacaggggaaacacttcaggacattagtgtaggcaaagattttatggctaagatctcaaaagcacaggcaacaaaaccaaaaatagacaaatgggactatatcaaacttaaaaacttctgtacagcaaaggaaatggtaaacagagtgaagagacagcctgttgaatgggagaaaatatttgcaaactattcatctggtaagggattaatatctaaaatatacaaagaactcagctcaacagtttaaaaaatctcatttaaaaagtgggcaagggacatgaataaacccttgtcaaaagcagacatacagatggtcaacgtgtctatgaaaaaatgcccagtatcactaatcatcaaggaaatgctaatcaaaacctcaatgaggtaccattttatcccagtcagaatcactagaattaaaaagacataaaaaatgctgacaatcatgtggagaacagggaactctaatacactgttggtgatgatgtaaattagtacagccacaatggaaaacagtataagttttcaaaaaactaaaaatagaactaccctatgagccagcaatcccactattgggtatttatccataggaaaggagtcagtgcatcaaaggatacccataccccatgcttactgcagcaccattcacagtagccaagatacggaatcaacccaagcgtccatcagtagaccaacggataagaaaatgtggtgtatatacatagtggaatactattcagccacaagaaagaatgaaatcctgtcatttgcagcaacatgcagggaactggagggcattacatcaatgccctcaggaaaacaaatatcacaagttctcactcataagtagtagcttaaaaggccaatctcatggagataagagagtagaatgaaagatactagaggctgggaggggtgtgtcggtggagcagggtggtggggagaaagagaggttagttgatgggcataaacattcagttaaacagaaggagtaagttccaatgctccgtggcacagtagagtgactacagctaacaatgatgtatatttcaaaataccaaggaaagaggatttcgaatgttcacaacacatagaaatgataaatactccaggccataggcactctgaacaccctaacttggccgttacacagtcagtgcctgtaacaaaacgtcacctgtaccatagaaatgtgtacaagtattatgtatcaataaaaaagaaagtaaagaaagcttcagactctcgggtgctggagaaacggcctccttttctctttagctgatggtgctgtagttagttccacacccagcaggacttctttcccaaagctccgaggaaatgagaagttgttgggagagggtagcagtaaagaggaaacagaatataaattttaagctgagacatcgccagctgattgcagcagagctagaggacagcatctttgggcaggaatccaggaagcagaaacataatataaaaggagcaaaaaggtttctttccttctccatcgattgaaaaaagaacaagtcagtgcaaaaatctgtcagaatgtctttctggaggctcacaattgtgggaggatgagatggtcttgacagccattctattttaccatcttccacactagaaaagtgaaatttatcagagcatttgagcttatctgtgaaaagtcttttcaaagtttcacccagatgagtggttgttgtttttttttttttttttttttttttttttttttttgaggctgttaccattttaaaaaaattacgacttgtgttagaaggctttgtccaagtaccaactcagtgctcggtatggaattcaccctaaaaatctaatgtttgtgcaagtgaggctggcagtaaccagaacagggactttgcaggggtgagacttctctgtaggaatcctggatactctttcaggacaactgacacccttgacttcatgctctcctattttaagctgaaagacttgcattttttattactaaaaagatttgaatgtggcgccatccagcaggttcactaggggagtcgtgtggtgtggagctttcagtaggaaccagtgttccctgcctggcgtggagggtgtactcagctgatacatacagaaactgacggatgtctcgtctcttctccatcattcttttcctcccttttccccggttctgcctttgaactaccctttcctcctgcccttttctcctccctggctttgtcgctatgtttctcctgaacgggtatctggaggggtaggcatgggggcattgtcagagaggaggtagggctctcaatggcaggcggggaagcagggccaacccgggcagctgtgtttgtgtttgctgctgagatcaatggatggaggggcactttcaggcaccgcacaggtgcctgtggtgcctgacttagggaatgggagtgcactgtctctcttcccctcatccttccctccatttgctcgtaagacgccagcctccccaaaagcgtttccatttccacctgctcctcatgccttgcacagcagctatggctatagagagaccatggaaggcacatggcagggcttgggagtaacggcatccgggagaacatcaccatcaggacatccacctatctcctccagatagccaggcatcctctcctccctccccatcaccacacagtgtgggctggccctgatgggaccgatgggacctgctatgggaacactaaaaggctctaaacctgggtgagctggtgcaagagatgtgggtcagaactgccagatgtccctgctgtccggccagcagcgacttgctgtgggccctgctgtccctgagtcgcaggcaggtggtccatctgcatgtggggcggagctctgcgcctgtggccgcccttcctcaagcagtttgctttgctgagctgcacctgcatcttggatttttaactcatgttttagactctcaggtcttttctctggggtggcatcctctgatcctaggaatgagtttatgttctgatgagaggttcatcatcatgacagcggctgatgatcatggaacattttcatggtgcccgggacatcctcgtgttttcatgttttattacaatttattcttataattgtctcgctgagttatttttattttccctgcttcacacattaacagactaaggtgtcgagagtgtaatttcctaggcagcaagtagctcagccaggtctgacacccagcttggacgccagcgttcaagcgtaactctgcggctctgcctgcccgtgttagcaagggggccgcagggcacagaagctcctgggaaaggaatttgtttttgctgggattttctcaggccactgcctcgcccctctggaatccttcaggataccgattgggtttggagcctggagttctggaccaggttggcaggtgagcctgcccctgggcccagggtccttttctggtttgcacaaggttacagatggcccccacacaagccagacacggggttgcatacaccatggaggaacactcagaggaggcagttgctcttgagaatccagccagcctgattgttctaatcagattagatcaaggagaaagacagagaatggtttgtgtataaatctcctgccaccagtagctccagtgccctgtgtggctgggatgaagctggagaaaataatgtgtgtgatgatagccaggatgccttgaacaccctccttctttctgcattccactgatgtctcctgcagggttttgcagccccagctcaccactttccttccatagttagaaccttccccacacatctgatcaaaagaaaatttgggctattgtgttaacagatgactttgcttttaattggtagaaccaggagctgtgggacatctgagtttcacagagatcttggacacatctctcaaggtcagctggcaggagcccctggagaaaaatggcatcattactggtaagtaggcctgtccttcaaaaaaggaaaagataagtttgtcctcacaaaaagaagtggctgtcacttcaaaccaaactgctgacagcatggacccgtgcccatggccttctcaagaggaactgaaaagtcttcctggccgtgtggcagagtcccagcactgggactgccccagtgagagccagcctggtctggggccctttactgtgtgggcagcagccatagtttgagatctgttctcctcgcatgatcttagtaggtgtccagagtctctgaccaatgagagtcagtcatgttatgacacatttgttcacatgcgtgtgtcttgcttaattctcatagcagcatggtaaggtcaatatcgatattatgaccattttacagatgaggaaactgaggccccgagagggtgggtgacctttccttcattcagcagatggcactgagcgctcctgtgggcagccagccttctcagacacagccaggtggtgtgactatgaggcttacgtgcctgtgtctcagccctcgtcccacagctgtgagccgcaagggtgagatctgggtcttctgactccagatcccatgttctgtcccctccccaccctgccctccagtgagagccctgaggagactgtgaggcaggtacttcggaggaggttctgagctgtaccagggatgggggctgagccttagaggcccctgggcagtgagatctcctctcctggtttgagggggtctctgtgggagacagctcaccttttttagggtttttaatgattttatttatttatttatttatttatgagacagggtcttgctctctcgcccaggctggagtgcggtggcgtgatctcggctcactgcaacctccacctcccgggttcaagcagttttcctgcctcagcctcctgaagagctgggattacaggtgtgtgccaccatacctggctaatttttgtatttttagtagaaatggggttttgccatgttggccaggctggtctcgaactcctgacctcaagtgatccacctgcctcagcctcccaaagtgctgggattacaggcgtgagccactgcgcctggccaaatttttataatgtctctgaaaaaccttttaggttaaagcttaatttaaatcttagttcaaaaaaaaaatcttggtttgacaaaagcaacataggctctagcctcagatgaggctgggcagggccccctgttctactgttttagtcactctaagagcctcagcagacctctgggatcctcagttacaactgaggggctgtcaggaggacgagttgagagaagttgtatcagtggctgcccactgcctggcccagaacaactcagcctccaacagacatctgttttttttctaaacattaccaaggatttctagcaagccacttaatcttcttctctgtcagccatatataggacacttctgtgtcagccctctctgggggctttgcctgtggcatctcatgtcccggcaggggctcctgcgtgggtattctgcagccgcaccccaaggttgagtgagttgcccgtcctgacgcgagcggtcagtttggagctgagctgcgtctccgctccgtggtggcagcgttctcagctgcctgcgggagccatggaattcaagtgcctgattgttctgtgaagcaagcttatgctctctgggtgtgtcctagaagcctgtgctgggactgtgctgcccagagaccaagagcctcaggtgatctctccctcctgccaggctgcagggttgggggccgtttcttctccgcactggcgtcctggatgacagcggcaatgatgaccctggccacttccactgtgtttgtcaccctagccttgtgggatctcgttttgctttctcagcaaccacacaaggggtgtcttataaccgaggcctggcgatgacaaggctgaggtttagggtggtgacgtcccaccatcacagccaatgggcatgtgcgcattctctcctctgcagcgttgatgtggtgggggtgaggtttgaaccatgctctgaaccccacagcatgggatgctcactttccccatccacagtcctcttagcatctccataatttctcaaagcaccctgaggccacagaaatgcctgacggttctgtttattaagtagttaggtccaaacaacggaagtgttaatatgcgctaacaattataattgccatgtaaaaaatactacacagtagttgaaagaaataatacttgcatttcttttttcagtgaccacagttagttcctaatgggatgtctgcacccgcctgggactgcccaccttctcagaccttgggaccagatggtccctcgtcaccctcatttcccggttcactttggtttccaggcagtacttgtttccttatcacaacatccaccaaaaactctgctttgcaaagacaggatatatccaaggactcgtggcatgctctgacccggaaatggagccacctcgggctggaggctcacgtgtgtcccactggcattgagtgtcctgtgcatccctgcagtgctcctgggaggtcactgcagcatcccaggtgccctggggcacagtgggagactgtgttcctacagtgacctctttctacacagaactccagctacatagcaaacccagtgccaaccccaccactactcatcagtagaatctcctgtaatcatctgtgccaaccagatcccctgatagagcggtgtgcccacagcccatacacaaggtcaccttggagccagtgccacctctcaaatttttttttttttttttgagatggagtctcactctgcagcccaggatggagtacagtggcacaatctcagctcactgcaacctctgcctcctgggttcaagcaattatcctgcctcagcctcccgagtagttggaactacaggcgtgagccaccacgcctggctaattgtttgtatttttagtgaaggcgggggtttcaccatgttagccaggatggtctcgatctcctgacctcgtgatccacccactttggcctcccaaagtgtgctgtgcctcttataagcatatagctggactttgtggggtttttaattttttgtttatttattttttgaaatggagtgtctctctgtcacccaggttggagtgcagtggtgtgatcttggctcactggaacatccgcctcccggttcaaatgattctcctgccttagcctcccaagtagctgggattacaggtgtgcgccaccacacccagctaatttttgtatttttagtagagacagggttttaccatattggtaaggctggtcttgaactcctgacctcaggtgatccacccacttcggcctcccaaagtgctgggattactggcatgagccaccacgcctggcctcaccttaacttttaaaaaaagtaaattaatgaatctggctctgccttccagaagcttatcttttgaagtgcccactttaaatagtgtgaaaactccaggaatggggggaagtcactactagaattggacacaatctgttgcacattctgaagtcatctgagaatcgcaagtgctgagtgtgtacaattaaaagggcctcctgttgcctggagtcgaaggaattaagcaaaggcagggggaactgagcaggggagggcactatagactgcaggaacctagtttaatcttgctttaaaccattcaaagaaaggaaaaacaaactagtgggaggagggatttttaaaagctgagcaggaggctaccattcggaagaagaagactttccagttcagacccttcagggaccagttcagtggctggaattagagctctgcttaccactgatcccagaaacggggctgcccgggtaggaaagaaagaattctggcctaccgtctgcccagtcgcctttcaggtctgcagtcggccatgttttggaaatctggcagagactccttggtagatgtgtgtacacagaaggaattccctttttacagatacacacgttagcccctgccctgccctttgtgaacacagcacacacttctttcctgtttaaagctgaaagaaaaaaatccatgggcataataattcacgttgagccaacatttcacggctaagcagtggttgccaatacttccaatttatgatcgtctgtttcaccagctaatggggcttcatgaactcattttcatgttttatttaaacaaatacctgtagttaaaagcagcagtctgttgtttatggtggagcttgacttcgaagctcgagctttcctgggctgggtgtagccagaggcctgggtttggaggtgcctgtgctgtcaggggcagcaaagttgcagtgagagcaccaggcagactctctgcaggttcctctcggcagccacgttgtccccttctgtgtgtggcctgtgtgttttcccttcctgctcactgtaatgtgcaccttgtgtcacagaagctgcagtggacgcctgcagctctttggaggagaaggtcctagaggagatgagatcggatgttatcaccttaccagcccagcatcaccctgtgcccccagtgatgcccgcatcaggggagctccccccagcacccaccatgtagacatagttttccagtggaacatgctggcagcaccatgaaattctattctgtgctgaaggcagagtgtctcattgagaagagcaaaagaaaaactgtgttcgtgggcaaacctggctgccggtttctggaagtgttggtgcggcaccaccatgctctcgcaggcttcctgcaaaggctgcacctgctattaaaggcagctgcaggagcccaggatgactgacggcttgggcctgggctcagcaccactttacgggccagaggcgctgttggaaacgtaggtttattagccctggtctgtggtgagcacccccagcttccattttaattcgaggcctggaatgagagggaagcacggagtagggggcggctgcgcctgcccgagtaaattgcccattgcccgctcattgtaaatttcagcgtcctccactctccttcagtaaactctgatttatgagggccaggatgcagacagacagtttgtgattggatgcactgctctcttctagagaatttactttagatcaacagaaaattatttctgaagctcctctggccattagtctcagttaggcagccattgggagcaggtaggatgccaagcgggaggtacccccgctcctggctccgggcgcctctctcctctctcctctgggagctggaagcagaggatgcatcccctggccagcactgcctgagccctccacgcacctcccccaaaagctgttgttcataaattaggggacgtctttcccacctcacgcccaccactctgtctgtgctcacaggcatcacacgtcttgggcctgcaccatttctgctggcgtttctctgcagatcagcctctctagctatccgtttggtttttgtttgtatccacaaccatttgagcacactatattatcaatgttgatcctaataaattctatcaacactgctcttcctgaagatgctggaattgccgtgtttcagctctaggtcgacatgacaaacatgacgctgtgtttcagtaaattctgatgaaaaacagcttttaaacaaataaaattttctggcagacaagttgtaatattaaacaaagtctgctcttcccataggttcagagtagaccccgaggatcaaattatttagcgattgaccaggtgtgacccaccaaggtcagggatgtctcagttcccttgcacacatcaggaggaggtgctggaggaggaggcgctttgagagcagggtctcgtgcaccatgagaaacaaactcacccgtccaaacccaaagaatggactcagagacccggagaacagcgaaagtgagacttttaatgccggtcttgcaagatcgagtgtgtggtgggcaggcacactcagcacggccacaacaagcgatttatcccctagtgctcaggcccctctcccagttcctcataggctgagcactatggggtggggcgggggaggtcacagtcttcccggacatcgcctattggttgttgggcagggggccgtaggtgtttttttagggttgtcctgttgcattttgttgcagcccacaatgcactgcaatcctagtcagctcagggggtcttcaggtatttgacttacgacctaagtagctgggcaggctgataagaacagacgaaacgagctattctgcaggatagtaaactttcatcttagactaaacttctttggttggggtggggacaactgagggattgggggaggctgagaagcaggcatttgcgattgaagcaggggcttagtgtatcctgtttcttctgtagtttgctgacctaagctgattcaaggtactttgtcttggaaacggaccatgtatccattatttccttcatccactgagggctgtcttgggttccagcaagtccacgaagctttctgtggcttggtttcttcctttgtgaaataggataacaatggctccaatttcaaaggtgtgttgtgagggttacatgaatgaatggggcaggctagatgtcttagacgtcagggtgggcagatgagggaaatgctaagatgtaaagcgagggcagggcccaggctgggcgtggtggctgacggctgtaatcctagcattttgggaggccacggtgggaggatcgcttgataccaggagtttgagaccagcctgggcaacacagtgagaccctcatctctacaaaaaattttaaaaacttgccaggcatggtggcacatgcctatagtaccagctacttgagagactgaggtgggagaatcgcttgggttgagtggttcaaggttgcagtgagccgtgatcaccccactgcactccagcctgggcaacagagcaagactttctctctctctctctctctctctctctctgtatatatatatatatatatatatatatatatttttttttttttttaataaagttaggaaggaaatgggagaaggcaaaaatgagtggttggcctgggtagtcggccttctcccctctccctgggaggaggaaaaggagaccaggacctgagaagcagccaggcgcctttgatgaagacaccacagaggatggtttagtgaccctcctgggcccaggcagagaccccaaaggcaggcaggcagcaccacttggtgacaactcacaggatggcaggtgctccaagtgctctggaggcacccagcagccaggcctcccctctggtggcccttgttccttggagctccccactgcgtccgcccacacgggagtcccctcagcccgcacacagaagctgccaggctgtacggggcctgtggcacggccagggggagcagtttacgacattaaatttttttcaaaatataaagtctcaagatgctgtcctctaaattcttgtttacctgcaagtgcaactcctagctttatttattgctttcatcagaatgaggaggaagtttcaggtgcgtcctagcgcttctatatccctgaggttattgactagaaatagggaagagcaagcgttttcagctgttttcttttgcctgtggacctatgagctctttccaccactgtctccctctttaaaagacacttttaagtgctctctgatcacattaactcccctccacgcgggttgattgattcaggagctagttgggtcttatttctccttttttttttttttttaagacaaagtcttgctctgtcacccaggctggagtgcaatggcgcaatcttggctcactgcaacctccgcctcccaggttcgagtgattctcgtgcctcagccttccgagtagctaggattacaggcgcccaccaccatgcatggctaatttttatattttagtagagacggggtttcacatgttggccaggctggtctccaactcctgagctcaggtggtccacccgccttggcctccccaagtgctgggattacaggtgtgagccaccgtgccccgcaggtcttttttctctaagccccaagtcacagtggaatcccaggttgaataaattttcgtcatgaggccccactggcctgaagagagtatagggggaaatcaaatttattagaaaacaggatatatgaaaaggggagagagagctagaagcaaaactcacacactcaggtgaaaataaacttttccagtgcattgcaaaatgtaagagtaatctgtcagtcatttcttgaaggaaaaagtagaagtgtttccatgaattagttgcaaccgaagagcaagccattgatttaaggtacaaaaaatatcggcttccaaaaatgaaatgattggccgggtacagtggctgtaatcccaacactaagggaggccgaggcgggaggatctcttgagcctaggaattccagaccagcctgggcaacagggggaaaccccatctctccaaaaaaatacaaaaaattagccaggcatggtggttcacgcctgtggtcccagctactcaggacgctgaggtgggaggatggattgagcccaggaggttgaggctgcagtgagctatgattgcaccattgcacttcagcctgggcaacagactcaaaaataaatagatagatacatacatacatatatacatacataacattttttagtggaattattggtgaaatgcattcataatttgacaagagaaggtcgaattgagcacagcaggctggcagctgtcgtcatgtttcagttcacgcacctggtgctgaggttaccagagcatcccagaggccctgtccttatgaagctcgccctggtagggagggatggtcccctgtggtgggaccgtcactcccataagcaggtttacgagatcgcattgggcacacagaggaaggagccttgacctgtgtctcatgtcagtagcacagtggctctaagctgccttcagcacatccagccaagctctccatagctccaagcctgcaacgatggtgctgtggaattcaggtgagcccttggccttcaggagaccaacactggtctggtcctgttgctttctaggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccaggtcagtagaatcgtgtgcggtcctcctgctgtcacctttctcttggagattcccgaggctagaagttgattggcactttggtgtggaagccactgagtgccttgaaaaggagtagtggcctcctgccaagatgctggagggtaaatgggtgttgaccccacttcagccccattctccagagcattccaccacggcctcacgtcccttctgtcttcccctcctgctttggcctcagccagttcccagaacatgcgttgaaagtgtttaaagccagttcccaatgcatatctaaaatgccatgaatactttcaaaacagtagcgatgattgtattagtccattttcatgctgctgataaagacatacccgagactgggccatttacaaaagaaacaggtttaatggacttacagttccgtatggttggggaggcctcacaatcatggcggaaggcaaggaggagcaagtcatgtattacatggatggcagcaggcaaagagagagcccgtgcaaggaaactcccgtttttaaaacccatagatcttgtgagacttattcactatcatgagaacagcacaggaaagacctgcccccatgattcagttacctcccaccaggttcctctcatgacacatgggaaatgtgggagttacaattcaagatgagatttgagtggggacacagccaaaccatatcaatgatgatggtgtgtggtttaattgggtaaaaattggtatatatagcgaccaaggttaacactagaagcacatctgggtgcaagttaccagagttttcctgagatgtcttggacattgtttatccagggcagggaaatgggttagctgacctccggaaggctgtgcttccagaaacactctgacgcacactacgtctggagccacagagtggagtgttagaggggaaactgaggcctggctgctttggccaaacccctgataaccaaggtgcagggaggcactggagttgctgttccgtcattgccaaggctgaacgcttgtagctggagaggggtcttaaagccttacccactcatcctgggtagtggctggaggcaaatcaaatggcgaggactgctttggggacaccatgttctgtttaccgtgcttgaagtttatcgccattaatgattgaagaaccatttaaaaatccagagagctgagaaataggaaagagtccacttgtccttcaatttaaacattttctatttcaaattcattaaaaactagatgtggaaaggacccttgagatcctacagaccctgcccatgccgatactgaattgatcaccaaaatagtttcattgtccctgtgcaagacctggtttcaaacaccccaagcaacagcaaatgaggaaagcattcctcagagatagtgaggtctgaaagctgccctagccttgcatttttcttttctttttcttccccattttatccccttatctttctctagagtattttgcatggcacagtaacacgaaagctctcgttttgaactcataatgctacaattccgggtgggagatgctctttggggagcggcatctgaagggtctctcatctaggagtaggcttgagccacgggcaccctcaacgggaggctcattcagaacccaccttccaccttatccagttgcctgagcaactgaatagaagcagagaaaggagagttctgcacttgcacgagaatttgttcgtcttggaaacgaaatccaagaagcctaaggctcaagacctgatcctgaccgggtgtcacgtcgcctgggagcaggcgatcctgaccgggtgtcacgccgcctgggagcaaccctgggcctatgcactcttccctccatccctccgaggccgcggtaattatgaaaggaagtacggcccgctcgttctctgtgtggtttgaggagccaggaagaattacattcattcatcctttcctcattcagccagcatctgttaattacctacgaagtacagagatgcgtaagacatgacgtgtgcctgcagagtttctcatcagggaggccatgttagcgacgtgtctcccaaagcccactgggtcaccccattaaagcaaaaaccatgcactgatcatgcccctggggaagctgtgctgcttctcaccttcatggttttgagagcaaatccttttttggtatagaatcgttttgaaactgtttacttttgaagctgacacgtttgatacctttcctaagctgtgacggactgtaaatctctccctttcctccctggttcctctctagaccttcctggtgccccatccaacctggtcatttccaacatcagccctcgctccgccacccttcagttccggccaggctatgacgggaaaacgtccatctccaggtggattgttgaggggcaggtacgtgtgtcgttagactgggagctggcatttgcgaagagcagtgttggggcctgtgaatgagtggtacccctgcagatgatggcttggggtgtcggggagatgggtgtgcttggagagggagaaccaggggctggagatagcccagataccagggcagaatgtaggaagacaaagaacaagatgtcaggccggggtcctaccaggtgataagacaaggataagaagggttaaaatgaaagttgtgattcaaaataggtacccaaaattggatagtgtcgttgattgagtttttaaaaattctatatcacaattagctactaaatatactaataggattaattgcttggtacagcttgtgtgtcattagctatgcattcattcaacaatatttttagagacgattgttctatcagcaggcactattctgagcacgggggctattgcagtagacaaagctggctgagtttctgctgtcgaggagaaaagtgctgtctgggaaagaaagacctccagctgtgggaaagctgttatatttgagggacagcgaggagggtgggtgctggagggaggggagcaagccctgcggtggcagggagtgagtctggggagagctgggggcgggttccacaggacttgagagagtggactccgccgagagacttccggtccgactccagctgtgcaagtgctggagcacgcaggggtccgggacagtgccaggcttgaataggatcatgctggcattggtgaagccgtgcaatctgccacttccatgttccaataaaagcaggaggaaaaagataaagggccaaattatgaggagtagtaaagtttcaaaatagttattatctgtagtaaaatccttgtggttttcatgactgtacttatgctatactgcaagacgatccactcctggaaattggccgtaaattagggaacaaatcctatctacctcttcaaaagtttcattaagcaaacatttctgaaagtctaaggaggatcctgaaggcgcaaaccatctggatgggactgacccacaaatggggctggaacaattatttacttaggaaaaatagcagtagagccctacctcacatcatcacacaccagggactgttgtggcgttgagggggtggggagggatagcattgggagatacacctaatgctaaaagacgagttaatgggtgcagcacaccaacatggcacatgtatacatatgtaacaaacctgcacattgtgcacacgtaccctaaaacttaaagtataataataataaaattacaataaaaaaagaaaaaagaaaatcagtcttcagcaaatgaagactaaattgatgaaagcaaactttaaaacgcttaggattaaatataggacaagaatcacaatgtctcatgaaaaccaattctactattaaaatccatctgcagaagtagccaggcaatacttttaggcccgcagaagcacgcgctgtggtctttggtgtctgacgatgccgcatagctgaggccaggaggcagcgctctctgcaggctttagaatgtggtgttacgctagggctaggcaggccacagcgacagaaacgccagcgtcttcagggctcaacatacaaaagctcatctgtgcatccaggcaggcctaggagtggatgacgctcctttggcccatgttccgttgcccagaacttgggcaacgtggccctgtgtcactgcaggagagtctgagagtgttgcatttcagctcatctgggagggaaagacaaggagtgatgtggggaccctcaccacagtttcttggccatagtatcctagctttatgtcatacaacctgtttctttaatttttttttttttgagacagaatcttgctctgtcgccaagctggagtgcagtggcgccttctcagctcactgcaagctcttcctcccaggttcaagtgattccccctgcctcagcctcccgagtagctggggctacaggcacccgccacccacccagccaattttttgtattttagtagagacggggtttcaccatgttagccaggatggtctggatctcctgacctcgtgatccgcctgcctcggcctcccaaatcgctgggattacaggcatgagccaccgcacctgacctgtaaagaggttttacatttttaatgtaaaacatcttaaatatatgcaaaaggaagaatagagtaagccctcttatacccatcagcaaaagtcaatgatcctcaagattttgctgcatccatccatccctggttttttattggcgtattttgaagcatatttcagaccacatgtcacttttcccccatacacatcacacatgtgtctaaaatgcctgttcacatgccaatatggatgaatttcacaggcataatgtttaacaaaaggaaaaccagacccctgcttggagcatatactgtgtgattccatttatagaatgttccaaaacaggaagaagtaatctttggtgttggaataacaggttttcctgggacccttgtggttacttaccgtgggggtgacagtgactgggagggggccacctgaggagggggcgtctggaatggcaggagtgctgtcttttgatctgggtgcttattttgtgtatacaccagtcgtctgtgagcttgcctgtatgtcttacttcagtgaaaactttggccaggcgtgatggctcacacctgtaatccacactttaggagaccaaggcaggcggatcacttgaggttgggagttcgaggccagcctggccaacatgtgaaaccccatctctactaaaaatacaaaaattagccaggcatggtggcgcacgtctgtaatcccagctattcaggaagctgaagcaggagaatcgcttgaacctgggaggcggagtttgcagtgagctgagatcatgccactgtacttcagcctgggcaacagagtgagattctgtctcaaaaaaaaaaaaaaaagaaaagaaaagaaatttttacatgaaaatatggatgtcttttctcatgataccattgtcacacctgataaaattattattatttttttgagatagaatctcactctgtcacccagacaggagtgaagtggtatgatctcggctcactacaacctctgcctcctgggctcaagcaatcctctcatctcagcctcctgagtagctaggaccacaggcgtgtgccaccacaccagctaactttttatatttttggtagagacagggttttgctgtgttgcccaggctggtctcgaactcctgagttcaagcgatctgtcagcctcggcctcccaaagtgctgtgattataggcatgagccaccgcacctggcaatttgaacattttaatatcatctaatagtcagttcacactcagattcccccaaattttccaaaacatctctttacggtggttttgataaaagtaggattcacgcagggttcacactattcattttgttgtcatgtctctcaaattgttaaaaaaaaatgttaacagctttattgagttgcaattgacatacaggtttaaactgcatatatttaagatggacagtttgacagcttttgacttagctacacatatacacacacctgggaagctgtgaccacagatgagataatgaacaggttcctcaccctcaaaggtgtccttgcagcccccactatccctccctaccaaccctccccgtccccacaaccactcatctgcttcctgtcactataggttacagctctgttaatctagtggaatcccccactcttttcccccatgcagttgcctcgttgagaaaacccagccagtcatcccatgggacatctgcattggagatgcacctggttacatccttgtggggtcacttgacctgttcctctaccccgtttgccctgtaaactggaagttcattgcaaagaactggtagattccatttccactcctccctccctccctccctccctccctccctcccttccttcctttttgcctccctcctcccttctttccttcttctctccctcccttctcttgtccctccctccctcctttccttccttccttcctccacccctcccttctttcctccctctctcccttcacttcttccctccctcctttacttcctccctcccttctttacttcctccatccctcccttcctttacttcctgtctccctccctcccttctttcctccctcctttcctctctccctcccttccttcctttcttcctctctcccttcctctctctctctgtctgtctccctccctccctaagactgcttccctgttactacagcagggtgggggcacgtaggtctagtcgccccactcagggatgctaagttgggtggcagagcgtagcagcctgatgcctaccttgtgaatttctccatcagctttttatctaatggtctcatccatccatgatctttgcctgaattaattatgttcttaggatattcaagatgataattttatatttctatcagtctttcctcatttagctgttggaactctaaaaagaagcatctctgctcatccctcagactatttagttactctcaaatgcaggaaggcagaataaatgcttaattcttttcccttaattaccagtttccagggtgaggaattggtcccctggttacttccaatgttaaatagatttttctttctttttctgtcttgtgatctcttttgctgagtatcatcatgaaagcataggttcttacctgttcagtgggtttcagtcacctgcagtcattattctttttgaacctagaattggcctgtctttggcctagggaggctttcgtatcctggggctccggcatgaggctccactctttgatgacttcctgcctcaagctgagatggagccatgcctgcagggccttggtttcatgagtgtcaaatgctgtttaaagacgataacctgagcaccaaggtggatctcctcgctcccagctggtccctgcttcgacaccttcccagtagacagaacatattttctgaagcatcatgagttcatactgacgtttccaatgaaatttcaggttactgaccttaaatgtatatgttatgttacgttatgttatgttatgttatgttatgttatgttatgttatgttatgttatgttatgttgttacttaaatgtatattttattttattttattttatttatttatttatttgagatggagtttcgctcttgtcacccaggctggagtgcaatggcacgatctcactgcaacctccgcctcctgggttcaagtgattctcctgcctcagcctcctgagtagctgggattacaggcgcccgccaccacgcccagctaatttttatatttttagtagagatggggtttcaccatgttggaccaggctggtgtcgaacaccttacctcaagtgatccacctgccttggcctcccaaagtgctgggattacaggtgtgagcccactgcgcccagcctaaatgtatattttaaatatattttcccttactctaagactgtgctttttaggactcctaactcgattatcttctttatcctcctattgtattaagaggttcaacctgtggtctgtgaatttgcctgtgtatcttacttatatgaaaactttatgttaaaacacaaatactattaggagtttcaaaattataatctcagtggtatgactaacagagactactgaatgaaatttaagtatttgtccttaaaatgtgttataccatggaagtgtaatatattcagtttatacctacagtttatattcagtttataatatatttagtttatacttacagtatacaagtacagttgcagtactgttctaaagccactgttcttttctcattgtggttatctcgatacagatttaagtgcgttcatttcaggacttgttttgtttttttgcttcaatttttagcactgactttctttaaaaatcattttacattttttttatttatttattttgagatggagtctcactctgtcaccgaggctggagtgcagtggcgtgatctcagatcactgcaacctccacctcccgggttcaagctattctcctgcctcagcctcctgagtagctgggattacaggtgctcgccaccacgcctggctaatttttgtatttttagtagagatggggtttcaccatgttggccaggctggtcttgaactcctaacctcaagtgatccgcccgcctcagcctcccagagtgctgggattacaggtgtgagccactgcacctagctcattttacattttaaaaaattggtggaggattttaaactaattcttgaggatataactcatttacacgatctcaaagtcaaaactatttaaaaagtgacattcacagaagtttctgttcatttgtctccttaccctgttgcctgtctgccacatagataaccatatttattagacttttggtttttcctttttctttttctttctggcaacataaacagctctgcgtatatgtgtacttcctctttcttccacggaaggtggcatattgcgccttgctgtcttccggtgacagcacatcctgaatacccctgggcatcatgtgtgcacttgtcctttcttctcacacctgcacaggtctgcccggtgtgcatgagctggggtttgtttatgtagctagtcctctgctgacacgcattgggatgtgtattagtattatatcactgccataacaaatcaccaaaaactgagtggctgatacaacatacatgtgtcatcttctagttctgcaggtcagaagtccagcatgggtctcaccagagccatgtttcttccggaagctctggggatgagtcagcttccagggtcattcgggttgcggcagaattcagtccttgcagttgtaggactgaggtccccatactgtgctgtcagccatggtcattcccagctcctggaggtcaccacggtctgtggctcgggatccccttccttcatcttcagagcagccggggcaggtcaagtcctctcagactctggctctttcctcctccttccttctcatctctctggcccactcttcagcctcccacttccacttttaaggactcctgattaccttgtattcacctggataacctccctgatgtaaggttcttacccttaatcacatctgcagagcctctcctgccacataaggcagcgtactcatgggttccaggaattagggtatgggcatctccagggggcctcattcagcctcaagctagttttcagccttttgcatagtcattttgtatttttgccactgtatctttgggggagattcccaggcatgggttggctggatcacaaggcaaatgcacatgtaaacttcccagacattgccaaatccctcttctgcagatggtaacatgttgcattcccagcagcaacatgtatatattttttgccatgcaaaaaaaaaaaaaaaattgaagtctaatttatgactcctttcttgcatgcctctggtttttgaatcataggcagaaaggttttccccactttcaggttctaaaggaacccaaccaattttctggtttcatttttacatttagaactccatccatttggaactggttcttgtatatggagtgaggtatgaatccattttcatcattttgcaaatagctacgtaattgcctcagtgccatttattaaaatgaccattttttttcctgatttgtaacattaaattctcatacgcactttggtctatttctgaacttttcattctgttctattagcctggttattcatgcactaattccacattgtttacttagagaggctttaaactatgctttaatatctggtgaggcctgcttccccataaccaatgtgtgtgcacagacacacacgcgcgcacacacacacacacacacgcattgcttgactttcttaggattttcccggccactcttgtggacatctgatggtgttgaatctttctgttcaggatcatgctacctcttttcacttgtttaaatctacttttctcagctgttttctcttggagaagcactgggctctctaatcctgccttcacctgctctcaaaaaggcaggaaaatgaggggcgatcaatatacctcaaaagctgtaatgtgaagaatacgggctttgagtcagacagacctggttccccccttttttagcacccctgtttcccagctctgtagacgtgcttcttaacttctttgtgagcctgaatttccatctggagaatggggtcagtagtaccatctgcaaggttgtcatgaggattaactcacgtatggctattttaaatgatattttctgcctgtgttgtttgcataggggaacacaattgatttttaaatatttttgtttctttaataaattcttctgtgttctaagtgctttcacaactatgaacacgtttaattctcataatggctctctggtggctgttataaccccgtgtcacagatgagacatcaaggtgttggattacctgccgaggtcacacagccaagccatgaagccggattggagcctgcaaacctcggaagtctgtggctgctcagcctggtgtattggtgttacagccagaaactttgggaattctcttgttagttggttagttttactgtaattttctataaagaattcatatcatctgttaatggcgacagtttttgtttcttcctttgaattttttatattctttctttctcttttttgtttcttcttctttgagtattttgtaatcttactgggagggctaaagcgtcttctatcatatcgaattgggacaatgatagaagacaatctttgttttgtcactctaaagaaattattgtaagattttatcatcaggtatgacatttacaccattgatgtaggctttttaaaaaatatatccagcctgtattgggttaagatgattcttttctgatcctgatttcctaggagttggttttttttttttaaagcataaataaatttaattgcatcagactattttctcatctattgagctgctcatttggtttttctgatttcatctgttggtaaggtggttcacactgcccttctgtttcactattccggagctcctgagacagaagcaatttggtcttgatgtttgttttgtttggggttgagattgttgtatccatgttcataagtgaacttggccttttctggttgtagatttggcctgggttttaagatcgatagtgtattttctcaccagttttcataaacacagtttggattgagcttgtgttccttagccctcaggcagaggactctcgtgggcatctgcacaatgaggtcactcaggcggaggtgagacccttgtgggcatctgcacaatgaggcccctcagagggaggtgagaccctccctcaggtggaggtgagacccttgtgggcatctgcacaatgaggcccctcagatggaggtgagactctccctcaggtggaggtgagaccctccctcaggcggaggtaagaccctctctcaggcggaggtgagaccctccctcaggcggaggtgagaccctccttcaggtggaggtgcgaccctcgtgggcatctgcaggatgaggtctctcaggtggaggtgagaccctccctcaagtggaggtgagaccctcatgggcatctgcacagggtgctcagtgcctcccaatcctgccacacgttgtgggtgtggaggcgcccagaccccgactcagttcatcagaacccctggggcagaggctgcagcactcttccatttgtgaggcttggaaatgacagatctgcatctccgctgagggtcccgcctcagggggcctctgtgctgggccttggaggcaagatgtgctcaggcagcctgtcccgggctgctattctccagcagttcagaggttttagtgctccagggaagaatgaacggggcaagcttcctgccttccccatcgtgggcttgccccttccccaggcctgtgttggttgcacacctccctgggctgtctctgagtgtccagggcagggaagctccgtcacgtggagcccacgtgtgggtgactccctggggctgcctgactcctgggccagctcacagcctgcagccagtggttaaacatttcatgtggaatttccaattcccttgaagggtaatctttccctttgatttcaaaagtgttttagaaactatagacaagccttaagaatcctacagagaattcccctccacccaaaggcctcatccatgatttgcccagttttccccaaaagccctcggtaacaaaaggctccactccaggacatgggctgcacccagtggtctcctgtgatctcagttatttcttgacttctgtgaccttgacaattttgaagactacaggccggttatttccctgattcccctcaatttggatttatcccagtgtctttaggagtcgtcctaggtgacgcatttttggccagaatgtgggggaagtgatgctgggcacctcctgctacaccttgttgggtttgacttggccttggcatgtcccgttgttagtccagttattttgctaacttgactgagatttctcccctctaaaatgaccgccacttctgcaccacccactttacaattaatcagtattttgtgagaagatactttgagattctttaaaaacctcatttctctttccagtctcatccaccagtttgtcatccattaatatttcttgctggaattaattagggcaatgagggcaccagtgattttttaaaaattcaatcatttcttctacatttatccattggcctattcctgaaagcaaaagctttctcctcatttatttttccattaattatcatcagtgtggactcatgactttttattttgggtaacagattttaacccattgctatcattgctaattttgatgctcaaacttccctccatttggcgatttgggggtggcggggagcccatccagctggcttctgtattcttttgatgtctccatcattctttgagcacttccttatcttctggcacaagatgttcccaactcatcttgttctttctctcttctttcccagccatttctccagggaaccttgggttagtgcagtggagagtgggatttagaaaccaagatccaggcagtagtgtgctcattgctactggggcatcactgctcccagctaggaaatgtacatatatctatagctaggtcagtttctatatctagccacacatactgaaaagcattatttcacactatcacctccaaatacaatgcaaaaccctcagtttatgtgagcttcccttttctacatctatccgagcccttctctggctcccagtatgctcagtatatttatttttttgctgaattccactctatgtggccagtcttatgatcaaagtgggctgctgccctgcttggacaccattctgcttggatgccttctttgcccagatcctgacccctgactggactctttcactgctgcccttaaaatttttgcatataaactgaagttatcaaagtctaacatgactgcactatcttctttccaggacttaagtacaggacttaaaaattcctgaagtccagtcaagtcatacttgttatatgtccagcacatcaactctgcctcacttttctatatctacaaaggcaatgatccttactggggcattctgtctcacagtgagtgctggcttagatttctccacatttgccattttcttttcttttcttttttttttttttttttttttgtttgagacagagtctcactctgtcacccaggctggagtgcagcatcaggatctgggctcactgcaacctccacctcccaggttcaaatgattctcatgcctcagcttcctgagtaactgggatgataggcacgtaccaccacacctggctaatttttgtatttttggtagagatggggttttaccatgttggccaggctggtctcaaactcctgacctcaggtgatccacccacctcagcctccaaagtgctaggattacaggcgtgagccactgcaccctgccaacagcaaggtatgcttttaacaatgatgaatgagcaggcatctctttaaacaccttctgagggtgtttcactggcaggccagtgtagataagagctgctgttcagccttctacagactcaagcagaatatactccaaccctctacatcaccagccaacacctttacagctccgtccagggaaagaacagttctgcagccccctcttctcattcttaatgccggaattctggccacacgttcttctggggaactccacactgcttctctccacgtgccaccttcctggccttcatcacattccatggatcatctctgactcatcccccaggaaagacatcgtgacaagcagcgagcagaacaaaaccgtcgggcgtgtagacacaagcagcacaggctttgggatcacagcgacagggcccggaatcccagctccatcactttctagctgtgaggctttagggaagtcttttaggtcatgttctttagccataaagccctaataacagtgcctgtctcacgggtgattgagagaactagaacatggtgttacattgacttctgctttctgtcaagcttgagcaactttacgaatgcatctcctctgagaaacctgccagcccctgaggctgtctgtggctctgtcccagcctccctctgtgctcgcctaccccctgtcccgtggtcctcccaggacgcctggttctcattccccagccacttctctgagaatgtcccatgggctccctggtccaggcaggctccagaggcacccatgaagcccagctgtcctaaactccaggcagcggggcccttgaggctgtgactagtatagatgaggcctctggggcctcctatacctcaccccctttgaatgggatgcaagacaaacccaggccttctctgctgtagggagactccagggctgcctctcacagcctctcacccgggaagcggttgttgactcctagtctgtgcctggccctgggctagaatttggggaggagaaagactccggagcacatggtctagatacaaagtcattaatcacatagaagccagggaggtgatgtcagagaggtctgctggggcgccgggaggacactgaggaaggaacaatagaacccatcagttgggtgtggagggcccaggaaggtcctaacagccaagccccgtctcgaggctctgtgaacgtgagcccaggcggagagcagcagagcagggcagggacgaaagctcccaccacaacactctctgccagaagagtgttcacgtttcttccctttcatctacttttcaattgtatcttctttgcagaaaagtttcctttagatgctaaccatttttaaaagtgcaccaagaaggttttattacttagagttaccttcagtgaattatggaatgaaggatcctaatcattggaggaacccattgaaaggccctataataagttgatgctcagatgtgggttgccaaaaaaaaaagcagcagcttttataggtatttctggctcagtaatgctttgcttaattagtaacctttgactgtagagtgagcaaaacatctctttgagcatttttatggtgcaccataaaagggagaatgcaaatgttatatgttttcatttgccactcctgtttgtctgctcagttacctctgtaaacccctgccattcgcagccatttgctgtgctctaatagccaaaataacgtctagtcttctcaaaagcctgccctgagcagagttttccataatgaagatgctagtggtaacactttaggtacagctaaaactgttttcattctgaaaatggaaagcaaaaaaaaaaaaaaaaaaaaaaaaagtcccacttagtgcttatttgtgcataatagtagccattttcttagaagaaactgttttagaaagtgttatgggctaataaagcacaagtctgtttagtgctggtctctctgtaactaaagagtagtggagatggagcagccgggcgcccaggcgtccccaggacgcttagagacgccgaggctgccggcggcgtcgacagcgacagcgtttggaatgacgcatgcctcggtgaagtcgggggcgtgaagcaacactgtctctctcctaagcacacgctgtgccgagggaccggatcctgggctgatggatgggaggccacgggctgtgtttcattttgctgtttgctgaggcactcacctgcgaggacaccttgcaggatgtatggggctttctgtttctctagcacgtccttggtccaaagcctcttgcgatacacctctcccagaggtgaatcctggggaaaatgtcgtctcagcagatgagtgtatctgctttccctagtcagaagttgaagcccatacaatccgggggcagtcccctttttgcctaaacggccagggtggttttttttgtgttttttgctttttttgagacggactctcattccgttgcccaggctggagtgcagtgatgtgatctcagctcactgcaacctccgccttgtaggttcaagcgattctcctgcctcagcctcccgagtagagtggctgggattacaggcacctgccaccacacccagctaatttttgtatttgtagtagagagggggttttgccatgttgtccaggctggtctcaaactcctgacctcaaatgatccacccacctcggcctcccaaagtgctggtattataggtgtgagccaccgcgcccggcccagccgggggtttgaaagccaaatggattgccctggaattccggggtgggattgcccttccacagaacttgcttctgctctactcacccctccaatccccatgtgctgacattcgctgtggtccagtgctgtgctaggcacaggggcctctgaggaaagtacaaggagaacctgccttcagtgagtaggaaagagagactcaggaaagaagcaagataccaagacctcatggcaggtggccatgcctcagagggagaagcaaaggaccgggacctcagaggaggtttcctttattgttatcaaaccggacttgtggacctccctggcacagcaaagccaaaccattgacatcgggattgcagcgagagaaagtgaggtgtgtctttcagggcaccaggccaggagaatcgggtcactcaagcctaagacctgacctctcctatggcttacagtaaggatccataaaggcagagaggcagaggcttcaggcagagtcaagcatcaggacacggaggtgacacattggttttacctaaaaggacatcttaaagcaggaacccacaggttataggtaaattcaaagattttctgatctgtgatcggttaaggaggtgaagctttgtcgaaacattttggatcagcagaaaagaacgttagctctggcctgagggtgtgacttcctccaggctccttaggaagaaatttagaacaaacagcagaggtcagagttccatcctcagctcctccatatctgaggtcttcctcacctcccccacatctgagctcttcctcagctcccccacatctgagctcttcctcagctcccccacatctgagctcttcctcagctcccccacatctgagctcttcctcagctcccccacatctgagctcttcctcagctcccccatatctgaggtcttcctcagctcccccacatctgagctcttcctcagctcccccatatctgagctcttcctcagctcccccacacctgaggtctatgtgtagcggacctgcatagccaacccatttggtgggagtccgggtttctgaaaaacaactcagggacatatggtaagatgtcactttagtttctattgggaaccaagcatctcctgactctggcttccttggctattgttttcagctactttcaccttcttgtttgtcaagttgctcctttatttatttatttttaatttttatttatttatttatttttttccgagacggagtctcgctctgtctcacaggctggagtgcagtggcgcgatctcagctcactgcaacctccacctcctgggttcaagcgattctgctgcctcagcctcccaagtagctgggattgcaggcactcgccaccacacctggctaattttttgtatttttagtagagatggggtttcgccgtgtgggccaggctggtctcgaacttttgacctcaggtgatctgcccgcttcggcctcccaaagtgctggcattacaggtgtgagccaccacgcccagcctcgctcatttacttctcagggctagctaggtgcctggaatttcccttgaaggaactcaagatttttctttatttccatgtttgggggcccaccagtccctaagaggggttcctgctccatctcattatgaggatcttccttggaaaataggcagtgtggacatgtgggtagaaacctgtcctgaaatgtagctgtaaagcgtccactttcctgtgcatgtcttctctgtgatttgctttcctctcttcaaaagtccacagtgtttataagcacatcaggcaatgtcaaggcttagaaatcccagagtctcctggaataagacactcagatcccctcactctacctttactgctgccagcattccgtctggaaccaggcctggctgtggcagggcagagccagctctgggacctgcatggatttgtgtggccacaggcaaggccaggggaaggtgaagttattacctggtaaaaccagcagaagagaggaactttaggcaccttagcaacgagccaccctcccggcaatggttgttaggggtgtgggggatggtcactgagagctggctggttggcagaggatggagaacagaggctaggggccaactataccgggatgggtcgtgggacctctgtaagcctcagtttcttcatcataaaattcagagaccagaagttcatttaacgctttagcatgggactagcacatattagacatttaataaatggaagttcctaataataaaaataatgaagttaaggcaagtgtttagcatccaagaaggctgcttgagacactgtgaccttcagaggaaagacctccttccccagagggaggcctgtggagtgtgcagggccctgtcctagaaaatacctgggaaaccaagcagaggccagcagggcaggttcaggcaagatgagcgccacataggagctgagattcaggggccggggacactgaaacccccacgggggtcgctgtggtcagagaacccaggtctgcgaagtccccagtgactgtaaggatctgtagcccaggaagaggcagcctgggctcaaacacccacagtggcagtggagagtcaggctggagctactcacagtgcactcgagcagaatcacaaactcgcacagcttgaaaatggcaaatgcagcagtccccagctctttttcccggtagaaactgactttaggaacagcaaggaggcttctcacccagcacactggttcccaggcttcacccagctgggcagagggtcaggagcagcccatctctgcagaggcattggcctgttcctgccccaccccacctcgcagcaaacaaagatggcaagacggcctgggccgactctgggtgaggggctcacctgggtcaggaagcagacagctcctgtacggccaggggctctcaggttgctgtgtttggtacagtaacgtcctgtatttattttttatgtggttaccatctttgtcctcccaggaacacaagctcagtgagagcagggactttgtctgagcagtgccgcatctccccttggcacccagaacagggcctgctgcatagaaggaaggcgtcatgccaggaagcgcctgtgagcaggtggacagggcatcgcacacatgccatccgggacagacatagccccagacagatatattgggccgcccaaggcccaataaagtttccaaccttgattgacttcactgtccacctggccacctgttacctctgtagggagaaattctagtgtgcccgtctcctgcaggttcataagccaaatgcttttatctcatcacttcaagatctggggctggggatttctcatcactacttctgtctcctccttccctccttatggaaggacgtgagacctgtctgtggccctttggataagtatctgtcagcatttcggtcataataaaccctgactgtagttgaatttctttttcataataggaggaacaagagtgacattatctctgaatagtcattcgcacatgcacaggagagctgtcattggccctaatgactccttccataatcccacggtcatctggtaaatttgccgaaacgggcctcattttttgttctggtgtaatgtctctgcctaagcgtttaggtgctggggagacaggtgacaatgacatacatactcagaaatctcagaatgtttcttggttgctcgactgtccataataacaccctcacagtggcttttctctcttatttctcaaccagcatacaaaatctatatgagatgaatggtggaaaaggggcctttttgttcattcatctgtcagatccgttgaggtcctattatgggacctttaaaactaccacaggagaggaaaatactgccgcatacgtgacaactcaagtgggaccaaaggaagtgttttaccacaaatgtcattttcgaaaaatagaggtcaacgtatatataaatcacaaccgtcaaaccaaattaaattttatgagactcatatttccccgttctttccgaggaccattccctgctccgattccttcatcctaattctcttgttggatttttttagatttgcctgtgtgtttcatttttccagccattaggttttatatttctttccttcattcgcccattcacccagcagacacttattaagcacctactgttttatagattttattgttccaggtatcgtgctacagattagattactaaggtcaaaaccttttagtttctccctccgagaattcacaattttcaggaggagggatgtgagagggaggatggaaatgtactcggttttttcttttttttgttttgagatagggtctcgctctgtcacccaggctggagtgcagtggcacaatcttggctcactgcagcctcaacctcccaagctcaagcaattctcccacctcagcctcccgagtagctgggattacaggagcacaccacaatgcccttttttttttttttttttttttttttttggcagagatggggtctccctatgtggccctggctggtctcaaattcctgagctcaagcgatcctcctgccccagcctcccaaagtgctgggattacaggtgtgagctactgtgcccggccacaaatgtagtctaaattttggtacacatgagagtcgtgagaattgttgtaatgatctatggccaggggagtatgtgaaagcaaatgagtgagcagggtcagccaggaaggctctgcagaggaggtgagactcaggttggaccttgaaggggacacagtctttcgatgggagggaagacattccaggcacagagaagagaggaatgaaaggctcagggttagaaagttgcacagcacctgtcgttttaaagtatagatcttatttttattcgggaacggtgatgccaacagatcgagagacaaatggcattggaaagacagtttgttgctgacagatcccaaggggagggggcagggaatgccacacagggccatgtgcagaagcaccgggtgggtcaggaggcagaggaggaggggactgtggcaggagcctctgctgtggcttctgagggaagggccgggccaggcaaggttaggactgcctggtgtcacagtctcagcgggctccggggctgggggctgttcctgctgtcagatgcccagccccagtgacaggacagaggcatgaagccctgagtgtgagcgctcacagaggatgaggtgggactgggctctaggtacaaaaggtactacctccaggtgagctgcttgctgtctctgggaactggctcaccctgggagggccatctctccagggccagccaggcccaggtgtgccaggtccagtggaagtggtggctaatgcaccgtgggcagggccaagcaggcacagagtggggcgtgtgtgagcgggatgtgatgggagatggcccaaggggagccgcagctggtgggaaaggccatgcttgggggctggcttgtttttatctaaaagcacccctaagaaaccgtggctgctggtcaccgagctcgctggcatgtgccggagtgtccggggctgacctcgtcccactgggggctcttgacagccctttagggtgaccactgtggtcctcgctatgtggacaggaagtctcaggagctcagtgtctctcgaacgtaggcccagccaggcctcatgccccagagattttggccgaggagccactgctgctctcctcacgccccttcctgggcaacggagcagaagtcctcaccagcgtttcaggaatttagaaatattagcagggaatcacccaacatgtggcacagggagtgtcaacgtccctgtttccccttgagagggatcagatctgatgggagggagggacagatgcggatggggaggttgcaggactcagctcagacacggccctgggctcctagggcaggggccatggggggcagacatggcctccaggagaagggctttatgaaggagctggttccttcagggcatggggttgagcgggaaggctgtttcgggggacacacttgggagatgtgaacaaactggccagaatgcagagagcacagggggagctaaggcaggcaccaggcgctgtggactgagcgtgcccccaattcctgtgctgaaatcctcacccccaaggcgagggtgtcagcaggcctttaggaggggatggggtcatggggtggagccctcaccaatgcgatgagtgcccctctccttccaccacgtgaggacacaggggcatttggccatccccagcctggaagggagtcctcaccaggacccacccaggctgaccccctggtcccttcagtcccagcgctgtgaggaaatgaactcccattgcttgtaaaccacccagtctgtggagtgtcatcacagtcgcctagtggggaaggtggtgtaggagggcaccaggcacccctgggcctggagagggaggctggaccgctcggcacagcaagagccgtgaattggagtcgggtgagatggatgagctgggggcctgtgggttaacaaggaccccagactcatctgcccctccttccctgtggctgtgagccccaaggtccacaacaccctgaggcctgccccaggctgaaccctgcagggtgcgtgacgggggaagggaggcctatgcggaggtgcacacaggggtctcctttaggccagtgctctccgcactggttgccagagaggccgccttgcctgggccccgaaaaccaacagctgggcagccctgaccctttggtttgtttgttttaaggtagcaaggacacttgcatttttttttttttttttgagacggagtctcgctctgtcacccaggctggagtgcagtggtgcgatctcggcaagctccgcctcccgggttcacaccattctcctgcctcagcctcctgaatagctgggactacaggtgcccgccaccacaccacgcccggctaattttttgtgtttttagtagagacgggagtttcaccgtgttagccaggatggtctcgatctcctgacctcatgatccacccgccttggcctcccaaagtgctgggattacaggcgtgagccaccgcacccggcggaaaaatttgcattttttaaaactcaccgatctgtcaaaatagttcaagcaagaggttgggagcttctacatcagggtcctaccactgaaatcaagcaaatgtaagagaggctgtggaggagaccccaccatgtgcagcaggggaggggtgacagaaggagcactgaccctcgatgacagaggacgatggtgtcgtgaccagaaatagagccttccacaggcggagcccgtcttgggaggaagatcgcggttctggggtgaggctgtcacatgtgagctgctggaccccagaagcgtctgcctgtggtcggtaggaaggaggtcccgcacccaggtctctgtctccttgtggagggacaggaagggccctaggaaggaagccatgcaagagagaagaaagaggaggcaaggacacactcaggagggtcagagaaagggccagatggggagtggagggagatcgagagagccagcaccccaggaacccaagcatggagctcaggatcagggaacaaagcccatcactccacagcccttctgcctctgaagatccaaagaatattaaacaggaaagacaaaacaaacgacaacccggaaagacagaagtccccagggaagggctgggaatctagagctgggctgattcaaagcctgaagcttccttgggagtgaagataaacgcagcacagcgtcgagtcccctgccggcttatgaggtgtgcaaactctgcgatttgtttgagggaactggcctctgggccttcctggtttcctgtgcctttaccagaagcccccatctgtccctccctctgcaggggccctccagccacctcctctcaggaggtttcatttggctgtggtgggcacggggaggagccgtcagaagcaggggtactcagtgtctgtggaagttgctagacgtgcaagttttcctgctgacaccagagtttcagccaggcagggtgcgcttggcttggcagctttccatggaaggggttctggagcatctttttctcctcctcttagctctggatggaggggggccacctcctcacgtccctcctcccttccccacacgcagctgcaccttgtctgcttcctctccatgtgcagaattacctttgggatgaggttaatgactctcctctgagcagccattgaccctggcctccggagtgctgagctcaccatggccaccagagcctcccagcaggggtgttcctggtcctgccctgcccaccagtttccaccagtttttccagaggccggatctcatgtgcacaaacagaccaagcctcctggcccactggcgccaaaccccggccagacctgggagtgggcaagctggggctgcgtggcgggcggcagcatccccgtgggtataacagacagacagctcccctaatgggcctgaaggaccgcccctaccgggtggcatttgaaatagatgccatttctgcctttgtccgaaatatcataaagtactgtttattagccttaaaaaaagttaaaaaaaaaaaaaaaaaaaaaagccgttcaaaatcccggcttccccacagagcttttttttttggagacagagtctcactctgtcacccaggctggagtgtagtggtgcgatctcggctcactgcaagctccgcctgccgggctcacgccattctcctgcctcagcctccagagtagctgggactacaggcgcccgccaccacgtccagagaattttttgtatttttagtggagactgggtttcaccatgttagccaggatggtctcaatctcctgaccttgtgatccaccttcttcggcctcccaaagtgctgggattacaggcgtgagccaccgcgcccggccccccacagagctttgatttgttttatctttaaagaattctgcctccctctacatcagcacattgttagtgagcacccagttgcttctagaacattctttcttggccttgaaatctaactagagagccagaggagcccagccagggttaaagaactcctgtctctcacgaaaaaagagtcctggtctctccagacaaaaatgtaaaccttttattatagaaatttcagtttctcccctagaggtcgctaagtgtagttacatttttggtgatcatctgttttggagctccgtgtaaagcaacccattttcagtactgatttttaaatcattcgcatgttcatttgtaaattcgttaatgcattaaacaccaagttgaggctggaccctgggagagatgctggaggtgcagggatgcgtgagaccctgaccttgcctcagggcaagtccacaagcagccagaagtgatgacacatgtggtgagaggactcagcagccgaggaggagtcagtgccgtgggggtggtgcgctccagcagggcttgccacactttctgtaaaggtcccgatagtgaatacttgaggctttccaggtcagacgctctcagttccagctccgcagttcggctgcaaaagcatgaaagtggccagcagccgcacaaaccagtgacagtggctgtgttccaataaaactttatttacaaaaacaggaagtgggccagattcggcccctgggccggagtttgctgactgcagtactagagccctgcttgtttgtgtttgagacggggtctccctctgtggcccatgctggagtgcagttgcataatcaccactcactgcagcctagaccctcagagctcaagcgatcctcctgcctcagcctccagagtagctgggactacaggcatgcaccaccacacctagctagattttgtatgttttatagagaatggggtctcaccacgttgcccaggctggtctcgaagtcctggactcaagcaaacctcccgctttggcctcctacagtgctgggattataggcgtgagccactgaacctggcctagagcctgctttaataaacctgctaggggccatcacgttaaagaaggtaattgtgtttgacttactgtttgttgatttggcccagactctgtgaagttggatgctacctcatagaagattgtaagttgcaaagccagaggtcacggttatattgctctcatagctggttttatttctaactttttgatcttattgagcattctttctttcattcactctacatactttgacatatattcccctccgaaccagttttaccatcttactagttcctcattaatgagtgaaataaatctttgacacacactatatatttgtatgagaatttgtatgcatgtatgtatttatttatttatttttgaggcagggtctcactctgtcatccaggctggagtgcagtggtgtgatcatagctactgcagccttgacatcctgggcgctaatgatccccctgcatcagcctcctgagtagctggaactatgggctgtgccaccatgcctggctaattttttttttaattattttgtagagatggggtctccctctgttgcccaggctgattttgaactcctgggctcaagagatcctcctgccatgtctcccaggagctgtgtttttatttatttatttattcttttgagatgaagtcgcactctgtcaccctggctggtgtggagaggcacaatctcagctcacagcaacctccacctcccaagttcaagcaattctcctgcctcagcctcccaagtagctgggattacaggcatgtgccaccatgcccagctaatttttgtatttttagcagagacggggtttcaccatgttagccaggctgatcttgaactcctgacctccggtgatccacttgccttggtctcccaaagtgctgggattacaggtgtgagccaccgcgcctggccaggagttatattttttgttttttgtttgttcgtttgtttgttttagatggaccttcactctgtcgccaggctggagtgcagtggcatgatctcagctcactgcatcctccacccccctggttcaagcgattctcctgcctcagcctcgtgagtagctgggactacaggcacgtgccaccacacccagccaatttttgtatttttagtagagatggggtttcaccatgttggccaggctggtcttgatctcttgacctcgtgatccacccacctcagcctcccaaagtgctgggattacaggcgtgagccaccacgcctggcctgggagttgtgtttttaaatgaatgctttgacagtgatctgcactgtgctgggggtactctgaagagggtataggagtacagaattaggacatagattctggcagcctggcaggggcagtgagaggctaagagggatgctgttcagaggcttccgaaaggcccggatgctctccagattccaaaggagtcagccagttgcagagaggaggggtggaaggagcagacacactctgagagggggaagagtggtgcagggggacaggtgttggagactgcgtgatgcctccaggtaatgacaaaccgcggctgcaggaggaagtgcaggcagagcctaatggagccatgtggcacctgcctgggttccccaatcatttggcacctgttccaatcgacatctttcaaaaagggagaccaggcactgggcgggaagggcagggtagtttgaccttggctgccaccttcagtggtccacccttttcccaatccattgatcctggccctgaaactgttttatgctcagcaaaacaacagccctgtagataaccagacactcgctgctcagaaggcaggtgagggggtcatctcatggagaatggccacagggcctagcaatggctccctcctcaggctctcctggtgggaaaggatgaagtgaagtggagatcagccgccccactgtcccccgtttcttttttttctttcttttttttttttttgagacggagcctcattctgtcacccagcctggagtgcagtggcatgatctcagctcactgtaagctctgcctcctgggttcatgccattctcctgcctcagcctcccaagtagctgggtctacaggcacccaccaccacgccttttttgtatttttaggaaagacagggtttcaccatgttggccaggatggtctcaatctcctgaccttgtgatccacccacctcgacctcccaaagtgctgggattacaggcgtgagccaccgcgcccggccagcccccgtttgtgaccgtgcagtggtttcccagcatctctgcagagggagccgcacgcccggcgttctcagagaaacccgatgagcctggctgcctcttgctgtgctttcccccactctcctgctctctcaacgcggcgcgtgcctttctctcccgggcagcctcccgggccttactggttctctttcgttcctcttggtcgtgggggtggaacagccctgaatcccagagctactgccctgaccaccgctgaccccgcagcagcccctgtggctgagagcctgccctgagtgcccagtgcctgaacaagatgagggagcccacagggtcaggaagcccccaggcctcaggtgaatgcttctggggccaggaaagcagccagacagactgaatccatacatgccgagcatccaggccagaggagggcagggagctctaggcagagcccccgcccaggaccccagcgttcctcagtcttgtttatttctccctcaggcagccgaatacacacatccagggtggggagggtggggagggtggggagggtggggagggtggggagggtggggctgcaggggccaaccagaggaaggagacctggagtcgcttagcaaaggtgaatgagcgtccgcagtgcagcttggggtcttgagagtaagttgaacccgccaggcgtctgtttccccctcacacatgcacagaccaggcaaggacccggaaggcaggaggctgccgggaaaagcgcccaccggtcacttggcaccgtgagctacgcacgtgagccacgtgcgccctgactgctggctctttccttagtgcttatacgtgattgataaaaggtgctaaattgacggcctgaaatggaagtcatccctttttcttcctttcttcttcttttttttttaaacaaacaaaacgtattctccatgaaatcgcccagtgctttggtttaacacccagaggactggtttcactaagaggagcccacctaagtcaccgaggactctgaaaccgctaaaccatgccacagggccagcattcaacacggaggcactttgcacccagtaaaatccaactgaaaaaatgtggggcttggtcctccgcactccccagtatctggtcccagcccgcctacgacccccatctcctcccctgagacattgcccaggcagccgggggcctcccacggaagcctgagcagctcgtcttgcttgcccttccctctgtgctgtggtgcgtgttctccattacctggaggcctgtaaggtgtcgtgagctgtgccgatgtgtgacaaacatttggtgaccttgaatgaatcactctttttctgggcctcagcttctttcagcgtaacataggctggaataatatcctccggcttcctagcttatgggtgggcccatttatgcatcagctgcatagataaatatcgcacggctcctctccactagacactgtgccggggccagagctttcaagccaacctgagtgagctcctctgagatccccggatcgtgaagttcattctctttttgcccatcaggattggatggttccagtctcagcattgtgctcctgggtcctttccctcttcacagacgcgatggaggaaggcagctgccatgggccctgatgggggatagggaggcctcagtcctgtctgactcaagagctagtccaaccccaggttcgcctagacccttcccttctccaagatgagtgttctgtggaaccttaatctatccacataactcttgttttctgtgtctctgaagtgaggatttgagggtttcgatggctaccccagtgctgagaactggctcactttggctgaagtgaggatatgagggttttgatgtctaccccagtgctgagaactggctcactttggtgccaggggacttgccccctttgcctctggctgtgcaagctgcacagtcttttcctaattacaccaccctgtggttttgccgacttccggggtattcattatctacgctgacctccagctcgttctctaccaaatattttggccggtcattctacatttcattttattgtttctttttttcgttgaggtgaaattcacctcacataaaattaaccattttaaagaataccattcacaacttagtagattcccagtgctgtgcaaccaccacatctgtctagttccaaaacatttttatcatgccacaaagagacctcatacccaatagcagtcacttcccatcccctcctctccccatcccctggcaaccaccaacctgcgttctgtctcaatggatggaaagatcctggacatttcgtaaactggaatcgtgcggtgcatggaccttgggtcaggcttgcttagctttccatcagtcatgttttgagatttgtccatgtggtagcaggtgtgggtgctttgttcctttctatggctgaatcctgttccatggtgcagagtccttttgtttatccactcagtgctgggcgtttgccttgttcacggctttgactgtcgtgactagtgcactaggagcatgtgcctgcaggtatctgttaagacacctgttgtctgttctcttgggtcagtggctgggggcggagttgctggcttatgcggtgactgtgtgtagcttttggaggagccactgaccatgtggatgttttcagctgaaagcgttgagagttttgcgctttgcctttcgagttctctaggaagcaagccaccagcatgcctgcttacacagtctcctctgcatccgtgtcgccagtttaccaaggtcattttgaattctcctgccaccctcccaagacttagccacccaccaccttggtttcctctgcacacttagtgagcacgtttcctatcctgtcatttaagccacttacgaagtgttaaatgcaccaggccccaggccaatcccactccagcagccagtttgtcctgacatgctctccatgcttgcagccggccttctctgtgtcccttgggtcccccagagccacacggccacacgaaaccagagtttgcttgtgatggggctgcagagatctccaaagatgagctccagggctctcctggtgggcacaaggccgtggctgtctctcccgtggctccctagctggcgcagcttgtgtggcaccatcaagggggagagagggacgtggtcagcttggggcagtggcagtagaagcggcactggcactcgggtttcttaagagcacaaggatgagtgagaggtggggctcggggtcagattaggggaaatgaaaatgctactgagcagggagatggtgtggagctcccagacagggagtaaaattagcacgagacagaccatggggcaggagcaaagactcgggagaggaagaagctggggaacttggagggcaccctgcaggcatcgccagcagacccggaaaaggcaagtctctgttgaagggagtggctcttccctcgtcaacactgccaggaggcagtttctttaaatcttaaggggactgggcctgccgatctggcttccagggcagaagactcatccttccctgcctaaggaccttccttatgccgtgggccagcaatggtgtctgtttggtgtgtgtttggggcagaaagggttggggtcgaagctggacccccagcctgtgcccacagctctgtcactgcttaccatggtcctggccaagtcttcctctctaggctttctctgagccctcacttgtcaaacaggaggaaggatgagatggtatggaaggtcccctccatcactgatggcctccaagccctcagaggtttgttcccaggggtttcactgtttgggtccagtccttctgtggcccagttcttgactgtgagcttttgactaaaactcacccagacttgatggtgggcatagcaagagcctgtatctccaaggcacaagagggggttgtgcaggactcaacttgtcccaggtgtggggacgccttgcagccctgcccagctcaccaggtaccagcaggtgcacatggtctacatggcagcctcagtccctaaggcatgtccagcccatctcagtgtctccctctgcacaggtgggagctatcggcgacgaggaggagtgggtcaccctctatgaagaggagaatgagcctgatgcccagatgctggagatcccaaacctcacaccctacactcactacaggtgagaacagcagtgataagctgttacaggaggaaacactggcagcccaggcaggtgccttctgttggcaatagtaaaacccagtcgtacgtatgcaaatcagatgtttcctagtggcaataacagtacctaaaagccttaaggagcaggcgggatgcatagcttggtgttattccaagggagatgataggcagatgttagactcatgaggctccttctatcagtaccagctggcaaaacaccccatagaaatggcccactgttattatattaggctgaataaccaagaaccacaggcagcagagatgtggcactttaccaaactccacaacctgttgggactattaacgtgccgtgtgcaaacaaagcagatgtcctaggaagatccttctgctccccttcccaagcagggcccaggagctgctagtctcacttatcaagcaattaacatgccatttaacctttagcttcttgaaccccgaaactgatccgggcagtaaatccttggctttaacaaagggtagggtgattatgagctgttagtactgtgatcacttcccgtaaggcctttgaaggagatggaatttccagttatcaccagatgttgagtttgataatgtcattgttctgccaggatggaacatttcatacgattggagaatgaaagaataggaattagtaattcagggactaaaaggtgaaattacatctttatgaagaatttttctttccggcacaaaaccaaagttagagttaaaaaaaaaaaacaatgagagatgctatttagcttctattcattttaacatccttcaggagcttagaacagacaaatcaggacacaatacactgggttttaaagaaaaacatttagcttaaaatgagctgttgggattcaagacttaccatgtgaaattaactgaagctatatagttatttcaaagaacagaaactgtaagtagagatcagtgtccctgtctgaaactcaggtacatttggggaaacctctatagtaaatgtatatgtgcatacttgggatatttttctagtatgtaaattgaattcaaataattgtttatgtatgtgtaaagaagagacagaactgaaagcattcctgtagattttagagaacattgaactccaccttcattttatagttaaggaaacggagatcatctgatttgctgtaagtctcacagttactcactggatggaatcacagagtgtggtgtgagcggatagaggcctcagttacctgacaaagtttattctgccaaggttgaggatgcacccgtgacccagcatcaggagatcctggcaacatgtgcccaaggtggtcagggcacagcttgcttttatacattttagggagacatgagacatcaatcaatatatgcaaggtgaacattggttcagtctggaaaggcaggaaagcttgaagcaaaggcaggaagactccaagcagggagggggcttgcaggtcacagataggtgagagacaaagggtcccattcttctgagtttctgatgagcctttccaaaggaggccatcagatctgcattgatctcagtgagcagagggatgactttgaagagaatgagaagcaggtttgccctaacgcagcttgcgttttccttgtagcttagtgatttggggttcaagatattttcctttcacccctcattcttctcctgaaccaacagaagaagagatgcagagtgccgttgatcatttaaaaggctggacttcaaaactgccctttggtagtgacatcctgatattccaattctgtcccatagctacttgcactttaacccctcgaggttatcctaaacttgaatcagggcaactgatgacatcaatttctggacacccaatccatccaactagatttcacttgcaaatttaaaattgttgagttgcaactgatgtacctgtacctttctttgaagtcttttaggggaaaaagggcacatatgcaatttgcattttttttttttctgaggcagagtctcgctctgtcacctaggctggagtgcagtgacaccatctcagctcatgcaacctctgcttccctggttcaagccattctcctgcatcagcctcttgagtagctgggattccaggcacccgccaccacgcctggctaatttttgtatttttagtagagacgagatttcgccatgttggccaggctgatctggaactcttcacctcaggtgatcccccgctgcctcctgcctcagcctccctaagtgctgggatttgatcccccgccaccgcctgccttggcctcccttagtgctaggattacaggtgtgagccaccacacctggccacaatttgcacttttaatgaaaccaggtgaaaagagggtgtccttgagcaatagcctttatgatatgagtagacacctatctgagccctcccttgagaaacagtcagcgcctttgtggtttcgttcttttccttcttacctttgctttgccgtgactctcatcagtggtttttcctttagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtggtgagtgggggtgagaagggaggctggaggcacacgggtcctgagtgagccagggcacacactaatccagggcttaggagtttcttagtcacgcctttgtcctagtcaaaactaatctcatcgtcaaaccaaaaagtattgcattttacaattagtgttggatctcaggccagcccaggagatctgattaattagtagcattactcactctcttcttggaactgaggaatattccttggggcaggaaagctgggggtgcctcacaccagaactctaagtccttaagctaggtcaacatggaaccaatactcaatatttgtaagagagccagcctgatatttaatcagaacatttgcccacaaaattaagccaaaatgtattaaaagaaattatatgcagccaaagttactgacagggtttcatttaattcacagaacaaaagtttcagggaagaataaagtagatccttctaagactatttcccccaggaacacctcctccacggagttggcctcacagggcaggcccatcccttacaacccgtgagggtggcagttctgagatgtcagctcatcgcgactcctcgttccttcctagcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcaggtgaggggaaggcgattcccatcctggagacaccgcattagagatggggctgagtgcccctgagcctccagatcccaggctagtggcgtctcattggcctgtcccacttgtgtctgtcttggagctttcctaatcccgggtttggccagactcggcaggaatttctgtctgatttcattagggccccaagccattcattggaaactggtgatgatttccaacaggggatcgactcacattactgttttctaaattagggataattttcgctaacgatgaaaagcaagaatgtgtaaagttcctatggggaatctttaaaatacaaggtattcaggaccttcttgtcacaaattaatagacgtagtatgttaagtaatctagcctgtggtaataaataggcctctaaaagtttaattgcttgaacataataggagtttacttctcactcatattgtggtctaaggtgggcgttcctgtttggcgggtggctctcttccacaaggtgattcagggacccaggctttaccgttctgtgggactaatctccttctgcacccagctgccagcagggaaaagaaggcaaagaatggacctcttcagacctgttcaggagtggaacgtcactctgttcatcttcttggggctcagtcatggggctctgccagttgccaggaagcaatggagcagtgtttttggccaaccttgagcagacctctgctgccctgtgctaatgctgaaagtggctgcctaatcttctgggctttgtggactaacttccgctggccaactgtgggtcataggagcttttcttgcccccctccttaaatttttagaaacccaaaggaaggacggcaattaacgctcatgaaggactcactgtcacctgaccccggtcccttcagtctgatctgaattagtgaggttctgtctggagaaggaatgaaccagctgcacctctgccccaggcttcttggatgagagtcacagcttgtgcttgacagatggaggggctgttcattctggactaacctaggctgttagaaatacaacttaaattcctgacctttgtccagacatgggatgaggaggaggtatgaagggttgagatggtgaactgggtcagtggccagaggaaaagaacaagactcccccactccttcccccagggagcctagatccattttgcttattgatgtcaaaccctcttattcgctctcttttgcttctcttctctgactctctgcgttaatgagaatatttggctccattgtttttgctgtcgtagacatggctctgtttcctggagacagctcctgagcccagcatgagtcctcctttccttggggctcccagggcacagaatcgctcttgaagctggggagtcaagagatggccagggcctgcccacagctgtttccaccccagagtcctcggaaatgccccggatctgccctctctgcaacccagagcctccctgcttctgtccctgtactacaatgccgtgcaaagagacagtccccctgttgttgttttcagtagaaaaattaattaacttgctagatgctggaaactgccttaggagacacagttggaactcagagtgactttgatgggaaatggacagaaagatgagctaggaagccaagtgcgtgacgggtatcagagaaaacctcgcacagtcagcaggaggaggcggatgacgtgggggcacaaggcctgttggcatgggtggaggtggctttggggggctgccatcctcaggacagaggagtttaaaagggaggaaagcatagacacttggggggcccagggctcccgggcctggcctgtctgctctaaagatgaagagggaaacatagaaggtggtgccgaggtgggagggcagcctctgaggacagctggagtgaggacgcagatcagctcccagcaataaggaaaggggacttggagccctgggcggtgccaccccctcacctcttcctaatgctcatcttatccgtgccaggtgctgcaatgggtgcaggtattcccaacaccacccctccaccctcgagacagccaggccggggtgaggagtctgcaccctgggcttgggtccagcagcgcccagcacaccgagggcaccagcacgtgcccagtgcatctgcacgtgccacccgctctgtgtgccacagcgtggaagggcctgggaagctctggataaaggctcctctcatcctttcttgctcattccccgggtcccgttggtgacaggtctgaacctgccgccacccttgtaggttactgtaatgcacagtgggttgcaatgcacagaagccccctgggtttcctcaatgctggttaactttcagccaccagcaccaagccaaagctcctgtgccactttgtggctttatttcttcctactcttctcagagggcaggaggtgagggtagacaggaggactcttaagcagtagcagggagaagcagaaccatggccttgtgggaatgctgttagggcgtggcgtgaaccctggagcccaccaatgagagccccggaagagcagccgtggtgacaaccagtgtgcttctgagaggaccagtgtttcaggatggaactgcccaagcagcagggctgggcccagtgtccctcggctctccttcagactgaagctttcattacgttccaaaggaaaggtggagacgcacccacatgcagcctgggattgtggtcacgtggatttcaaaaatctctgttatcttcactgtctgaatctttgtgacaaaggagagaacttgagaagttcagagggacagttctaaatccagtaaaaggcaggccaagaaaatagtttttcagaattaaaacttctgccataaccaacaaaaacttatggataaaatataactttctggaatcttaaatgtattggccaggcagggtcctcacacctgtaatcccagcactttgggaagctgagtctggaggatagcttgagtccaggagttcaagaccagcctaggcaacatagtgagaccccatctctacaaaaaatacaaaaattagccaggtgtggtggcatgcacctgtagccccagctccttgggaggctgaggcaggaagatggcttgggcctgggagtttgaggctgcactgagctatgatcgcaccactgcattccagcctggccaacggagcaggttattatgcctctaaaaaataagtaaataaatgaattcatcaacacactcataagaaaaacagggaaatcctcaggtgtcagaggcataacaggaactagaaagagttcagcaggaagtgctgggctggtgccgcagctgccctgggtgggataggatcaggttggatctttcctggtggtttcaggacctggggtaaggagtctgcaccctggtcctgggcccagcagtgcccagcacactgtgggcaccagcacgcatccagtgtgtctgcaggtgccaccgggaactgtagatacactgggcaggccatgcagtaacatgagagtcagctttgaatctgtgtaagggaagagttagggcctaaactcctgcagttgagacacggctcttgaaggcctttccctccttcctaggagaggctgaaactctgcctgcagaggtttgactgtatgtctacctggactctgagtagagaatgaaaagtcagtctgagccctgtgcccagctcaggactgggttttgaatttgcattatatggatggcccaggaactcccagaacagaaattaatgtaacatttggttccagaaaccaaaagcacgagcaactaaagaaaaagtagatacattagacctcatcagaatgaaaacctttatgcttcaaagaatgtcataaaggaaatgaaaaaaactccccaaatggaagaaaatatttgcaaattatgtatctcatgagggatttatatctagaatatataaagacttcacaacaaaaagacaaatgacccagttaaaaactgggcaaaggatcggcatagacattcctcccaaggagatttacaaatggccaccaagcacatgaaaacatgctcaacatcattaactgttagggaaatgcaaatctaagctgcaatgagataccacttcacactcctaaaataagatggctaaaataagaaaagttggacaataacaggtattggtgggcatagagaaattggaatgcttgtacgttgctggtgggaatattaaatgattcagaaacgttggaaaacagttggcattcctcaggaggttgagcagggagtcaccatacgacaaagcaactctactcctaggtatgtacccaagagagcagaaaacatatgtctacacaaaatcttgcacataaatgttcatagcagctttatccatagtagccgaaaagtggaaacaaccaaaatatcactcagttgacaaatggataaataaaatgtggtctatgcattcaatggatgattcagcaataaaaaggaatggaattctgatacatgctacagtgtgggtgaaccttgaaaacattaggctaagtgaaagagaccaggcacaagagaccacatattgtgtgattctatttgtaggaaacatctagaataggcaaatctagagaggcagaaagtaaattcatggtttcctagactaagagagagcatttgagaggaatgggaagtgatgggtgatggaaacagagcttcttttggggatgatgagatgttccaaagttcatcatgatgatggttacacaactctgaattcactaaaaaatgttgaattgtacaatttaggggaattgtatgatatattaataatctcacaataaggctttaaaaaaaaagctcagccttcctgagattaattttatacagataaaatgttattaaaataagtatgggctgggggctgtgattcgtacctgtaatcccaacactttgagaggcagaggcaggaggattaccaggagcttaagaccagcctgggcaacatagcaagaccccatctctacaaaataaaaataaaaactatagaaaattagccaggcatggtagcacatgcctgtagtcccagctacttgggaggctgaggcaggagaactgcttcagcccaggaggtcgagcctgccatgaactacgatcatacccctgcactgcagcctgggtggcagagcaagaccctgtctctaaaaaaaataataagaatggctcatagattgtacactttgcgtatggttggaaggcccagaaaatctgtgtgtaatatcttcttaccctcagggaaaacagtgatcaactcttcctgaaatagttacatatcataccccaataaaggattttactctcctccaaaaataaaacaaaaagaaaatacacaaaaaactaaagaaacatggtttcaggccagaccatctgggcaatcaacagaagcaaaaatgattcctctctggagagatattgccaaagccaaattatccaaaataaaaagcctttttaaagatgaatcacaattgtcaagcacacaggcaatgatttgccatgagtaaaaatgaccagttttaaaaaaagagagaaagatagagggcttcaattacattaacatacatacaagtctgagagaaatatataataactacatttaaaattattaaagtcttagtaaaataaagcgttaacattttaagtaaagattaaggtaccatttcttaaagcagatttgtttttagaaaaaataaatgggacacagtcattgaaaatgaaagcagtttagacactgtcaaaaagagaattaccaaattaaaagctagatttgagtaaataactcttaaaacaacataaagacataagattgaaaatagagattaaaagacttgaagaacagaatgagatctaccacatagctaataggactcgaaagaggaagcaaatgagagttacaaaatacacagagataatagccgagaaattccagggttgatggaaagcattatttacaagactgaagaaacaccaatcccgagtggagtaaataaaactgaattcataccaagatgtatttgctacaactgtaaaatgccaaagagaaaaatcttaaaaacaattggagtgaaaggcaaataatcacaaaggcaagaccatttgactgaggtgactattcaggaacaacagaggccagaagacaatgggataataatctcgaaggagctaaaagcaaataactgccaacctcaaattttatacccagataaactaatcttccaggattttattcagaaaacagcaaagtaaatgctatataaaaatgaagacaatttaatcaaaatagatatattgttttgataatttttcaaataatactcttttttttgaggtggagtctcactctgtcacctgggctggagtgcagtggcatgatcttggctcactgcaacctctgcctcctgggtgcaagcgattctcctgccttagcctcccaagtagctgggattacaggtgcccaccaccatgaccagctaattttgtatttttagtagagatggggtttcaccatgttggccaggctggtcttgaactcctgacctcaagttatctgcccaacttggtttcccaaggtgctgggattacaggcataagccaccacacccggccaagaacactcttttaaaaaaaaaaaaaaagaaagaaacctatggcaaaactgctgatttgagactcttttttttttaaacaaacatttccagctgttgaaaacctatctttatagtagtcaagagaatgcagaggataatattttatgtgtaaatgtattccagggtttttcttctgactttgttttttttcagacaatcttgtatcatcttttacacaagaaccctgaggagactttctctagcgatgttgtttatttttgtagatgctactgtgttttaattaatattgagatatagattttgtatcaaaagaagcaagtggatttacctttgtcctagctgattgtagcatgtatggtgatacggtttggctccctgtccccacccaaatctcatctcaaattgtaatctccacatgtcaagggagggacctggtgggaggtgattggatcatgggggcaatttccgccatgctgttctcatgatagtgagtgagttctcacaagatctgatggttttataaggggctcttcctcctttactctctcttttctctcctgctggcatgtgaggaagttccttgcttccccttcaccttccatcacgattgtaatcctgaggcctctccagccatgtgtaactctgagtcaattaaacctctttcctttataaactacccagtattgggtatttatttatcacagtgtgaaaatggactgatacatatggctagaggggaatcacatagagcccttgcagaatcccctgtatcagcctcactgtttttctgttcatagttcatgttctgttcacttgttcagaggattttgatcaagagtaggaattgttcttgcaactgaagctttgttttgtcagttattacattctttcttattttgagggttatagcttatggaagggtattttttagtttctaattgaatgtgtgtttaattagaaactggtgcaacacatattgctctgggaaaaaaagttttggttcacgtgtttccatcaaaaattttataattgggttattgatcttcatttcaagatgtggatgattcagattctggacatgttgaatgctggaataacgagctcccagggacccctcttagaccagtctctcttctggttggtgctggtgctccatctctgcccgtcctaccacctggggaatctcaggggcccagatgctgcaggacttccgctccccctccttgtgtttagctcatcagaatggagatttcacagccttcttctctgggaatctccccacctctgactggcaaggccctcccaggtgcagcagttttgactttgggccttccctggccctactaacatctgaaacttactctccccagcagaaaactcgatccttttttgaaatggggggaggcagggatgagatggggaggtgaaggggttgccagggctgaatggtgagtggacctgatggagagggagaaggattggagagagaataaaacaactgccttttgtctgaaataagtctcccctcaatggaaatagcagctcctgggagcttaggaatggcccagtgtgcaggagtgctgaaaacacgcagagaacacacagcagaatgctcggagccacatttcaatgaagtttacagttttgaagtgcagtttaacaggttctgtgacatcttatgatatattatgatatattctaaggataaatgaggccttaaaaaccgagagagaccacatgaggaggaacagtgagctgcatagtgtgaaatcctacagaggggagagaaaaaaatgaaggagaaaagaagccatggaatggctttgtttttaatgaaaggggaattcccaagaacatctcaaaacgtaagatgtcaggttggaaagggagttgaatctacttcaaaatagatgatgggtaagaggtttctttttcaattcttgaaaactttgcaactccatggcagatcttgtcctcgtaggatttaaatgcgctgaaatttccatcctgaactctgccattttctttgctttagctgcctcacctccctatctccacgtgagaagttcagctgcgttcaaagccccgttggtgtccgaattgctgcaatccccaggttgccctctttctccagggacggggttggctctccagtaaatacctgctcatcccaccacatcttagaaaaacagctgtgatttgtaggtctatagggagaattgggcactcacagtttcccacaggaagcagttaaagattacagaagtagaccatttgtgttgctatgacaatggcctctctttttgcagacagggacagaggttttagaacctggtaccaacgtcttgggcatacagtgtttggtgttcttaccttattctaaatatattcggatacgttgtaggtttacattttttttttaatgttagtgccccctttagctcatagttgattcaaggtcccagtttatcaaacttttgtataaaatgagcaatgtgcaagccatttcctggtaacagccatggtggcatttaagacaccctatgggagctctgtgcaggcccagggagcaggagtgagccgggtggagccacagctggaaggcaccagggacttggggctgcatctgtgacaagcccccttcctctttggagaactgagcaaacttcacattgcaagtattccctttccgtgacacctctctactcaaataaatggatagtatttcatagaagcactgagtaactgaatgaatgactctcaactgacatatttgggaagattggactggctggcattatctccctccaaaaatagaagggggctcacagtgtttttatagtgacaggcatcactgggggttttctattttgtggacacattcactgacctacacccagcagccgatctaatgtccatgcagggaaggtgctcagcatggtagggggagaagggaagggagagatgctgcctcccagggctctcaggatcagggagcgtgccccttcctgggggcaggcatcccaggcctttgctctgcaggttcctctgtggtttcagagaccccacagggtgtggtgagggttgcggtgaggccactgactcgcgtcctgaggcttagtcatcctcagccgctggccctgttaggctatggcctgctttggggctgtcctttctcgcccctcccttgtctagggaaacacctgtttgtggtggtgaggcgagaagcttcccacacagcatgagaacagctcttctaggatgcacatgaaccctggcattgtcttaaagactgtgttcgtgtcatagcagaatgccccaaacggggtggcttaaatgacagaaatgttttctgttaccattctggaaggtggaatctgagctggaggtgttggcagggccatgatccccctgaaagcttgggaaggatctgtcctgggcccctctccagcatctggtggttccgtggctcggacagcctctctcccatgtccccacagagttctccctgtgtgtgtctgtctcctcccatggcactctccctgttgtgtgtctgtggacaaattcctttttttatatgggcactagtcatactggatcaggggcccaccctatgcagtatgaccgcatcttaacgagttacatctgcaacaactgtgtctccaaataaggtcaccttctgagataccggaggttaggataacaaaataaggattcagggggcacaggttcaagccataacaaagatcaaactactctcgtgtagaaaatcttgcaattaaatgtcataggttgcattattgtgcaagccccccaccatgttactttctgtcttcagactaactaacagtgctaccctctcagtctctgtgtaatgaggaagtctgaatgtctgaaggaatagatgagtgaatggatggatggataggtgatgggcgaatggatggatgggtggatggtagatgaatggatgggtggatggatggatggatggatggatgggtgggtagatggatggatagatggatggatggatgggtgatgggtggatgattggatgtatggatggatgatagatggatgagtgaatggatggatgggtaaatggatggatgaatgaatagatggatggatggatgggtaatgggtggatggatggatggatggatgatggatggatgagtgaatggatggatgggtgaatggatggatggaaagatggaatgatcgatttatggatggatggatgggtggatggatggatggatgggtgatggatggatggatggatggatgggtagatggatagatggatgatggatggaggaatgaatggatggatgggtgatggatggatggatatgtagatggatagatggatggaggaatgaatcgatggatgggtgaatggatggatgaatgaatagatggatggatggatggatggatgaatggatgggtgatgggtgggtggatggatggatagatggatggatgatggatggatggatgagtgaatggatgaatgggtgaatggatgaatggatggatggatcactggatggattgattgatggatggatggatggatggatggagatggatggatggttggatggatagatgagtgggtctatgaaagagcagaggaagtcctcgcaagtgttcctgctacagaggtgcatgtgtgcatcctgctgttcttggagccctagtagggcttgtgaaggagaaggaaacagatgcttctactcacctctgtgtgccagtgccctaccaggcacctcagtgtttgctttcattctcactctaaaggctaggactggtcatagcatcctcctttcactttcttcaaaacaactagctattgatcacctgctgaccaacaagtgctgaccaccaggaggggagagtgagaagactcttaagtaaggaaggtaggccaggcttagcctttcacaagtgggacaactgaggcacaggtgatcagagcagcatctccagctcccaccctgagtccggccttactccatcactccaggctatttccctgggtatcctggagaccacctgattcaaaaggagactttgccaccaaacagtatcctcccagaacctccgttgcttcatctgcagagtgaacccccgaatgggatatggtggacttgaagtgtctctcctcctttttcaaccatgggggccctgaagtatggcgggatcttcagtcccagctgagagcagctcctccatgctgtttataaacagggccttccctgactgctaggggctagctcaggtccaggttttcctatctgaatggtgtttgaagtttaaatcggtccacaagaaaattaacaaagcaaatggagattgtctagaatataatacccttgtttttaaagtttcactgcttttatacatattatatctgaatcagtgcaaacatatcaagacaaattagttcagtgatgttgtacacagaagagagatttcatgaaagtaagaaaatgatcttacatgtgggccgggagtggtggctcacgcctgtaatcccagcacttgggaggccgaggcggacaaatcacttgaggtcaggcattcgagaccagcctggccaacatggtaaaaccccatctctagtaaaaattcaaaaatcagccaggcgtggtggcacatgcctgtaatcccagctacttgggaggctgagacaggagaatggcttgaacccaggaggcgaagttgcagtgagccaagatcgcaccactgctctccagtctgaaataaagaaaagaaaattttcttacatgtgtatgggtcgagaatggcatggctggcctcggctgcccatctccttttagaaaaacattcattgaaatggatgaatgcgattttctcagctttagttttctgatcggtagaaaaggggtaacgatacctacttcattgggatcattgtgggattagatgcaattatgtaactgaaggcagttggcacagacaggcactggataagcacctagtcaacctaccctcccttccccttcttttgtgtaaatcctcacgcccccttctctcttcagcttctcctgtccctatcacagaataccacatttagagctgtcagtgaacaggcatgtgtctgaaagtcaggatttcctatttgagataaaagtctgcagtttccacaagttaatacagcaaacagaccaagcatcttttttttcttgcttggtggactcaggtaaaattgagctgctaagtacccaggatttatggaatttgttgctaatattaaagagatttacatgtccgttatactcctgtaggtttaatctgatcactacaaaatgcttagaatacgttgctatttcaaggacaacttgattatttgggtgaaagctggatctttgtatgtagacactctagattttggatgctaatctacttcattggttctttgcagttccttcagccgcccctgagaacgtgtcagccgaggctgtcagctcgacccagattttactgacatggacatccgtgccggaacaggaccagaatgggctcatactgggctacaaggtgtgtgatcacaggatgacctccctttgcttaaagagtgggctggggaaatgggagcatgtgctattcccccaaagcaacgagcttcctcttctcctacagatctgcagcgtcagccagtttgtgatttttattaagatattcagttgtcttatctaagcctcattgcagcctgggaattaggcatcagtataactatgacacaaatgccaaaacagggcaccagaagaaaagcacagccggagtggaactgacctccgggcctgcgcctgactctgccctcgctggcctcagtgccgcgggccagttactgaagccctgtgcttgtgtctccccgcttgtaaaacgggaataacgatggtagctttgtcccagggttggtgtgagaattcagggggtcttttacacagcacgccttgctcatgtgaagggctgggtgaggtggatcgctgtgtgcatgtttctatgtgtgtcatcacggtcctagcaatggcatccgctggcagggttgaatctgtcccagcttctctggggagccatttctgggttccatcttccatgcatccaccccacccctttaaaacccccttctgttcctcgttccatcactcggggcgacaggctctgtctccccatctgctccttggctcagcaatgccaagcatcagaatgagctgtttcggacccggccagcgaggccacgcttgtctcagtgctgctccctgggttttgagcgtgcctcctccacctttccgtacttcacatccctattctttgttttccccgcctgctctcccatgtcttctcccttccccgggtgttctaagtgcgccctgctggctctgtgacacatggcagtcccgttgaggggattcagtgaccaaaacttcacaccacattcctggggccccgagaaacgcgcttgctgtgctattttcaaacacctccctgctgatgctatcctttatggccttccaggtccccgatctcagggagcagttcagagaaggtgggcattgagtgaggtcttagcaggaggccctggagcagagcagcttggggtggggtgccctggaggagagcatagaggagagcagcttggggtggggtcccctggaggagagcagcttggggttgggtgccctggaatagagcagcttggggtggggtgccctggaatagagcagcttggggtggggtgccctggaatagagcagcttggggtagggtgccctggaatagagcagcttggggtggggtcccctggaggagagcagcttagggttgggtgccctggaggagagcaccttggggtagggtgccctggaatagagcagcttggagtggggtcccctggaatagagcagcttggggtggggtgccctggaggagagcagcttggggtggggtcccctggaggagagcagcttggggtggggtcccctggaggagagcagcttggggtggggtcccctggaggagagcagcttggggtggggtgccctggaggagagcacagaggacagcagcttggggtgggatcccctggactagagcagcttggggtggagtcccctggaatagagcagcttggggtggggtgccctggaagagagcagcttggggtggggtcccctggaggagagcagcttagggttgggtgccctggaggagagcaccttggggtagggtgccctggaatagagcagctcggggtggggtcccctggaatagagcagcttggggtggggtgccctggaggagagcaacttggggttgggtgccctggaatagagcagctcggggtggggtcccctggaatagagcagcttggggtggggtgccctggaggacagcagcttggggttgggtgccctggaatagagcagcttggggtggggtgccctggaggacagcagcttggggtggggtacctacagcatgcacagctgcagatggcccaaggaggccagagctcccggtctgtgtgaggacagcaggtcttctggggcaggaaaccagcttccatggctggaaaacccagggggctgctggctcctgtggcaggaagcagagtgttgtctgtgttcataatcgagtctttgttttagtggctgtggttggcatggctgcagttgggccctcagatcttgcagattatgaccaggcagcaggctcgccaagccgtgggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatggtaggtccagggttcgcgccttcgggagccttgctgcctcccaggttggcctttccaatgcaaacaatttggattgttgtcgcttttaacttaattttcaaaccactttcttttgcagttgagggaaacaaaacaaaattgtttttcagtcactgagcacttatatggccaatttcagcctggagtggatttttacagcctaattatgaacctgtactgagtttccctcataactctgccgtgggcagtgctggggagaggcagcagaggctggggcggggccgagctgtggatgtcagctgtggacgctcctcttggcaggggctccacacacttcgtgtagtgcccccttatctggcaacacatcccaggaccccagggaatgcctgaaactgcagataaaaggagactactatagtttaaaaaatccacagtggacctcatgccttacttccctcggtactgccccgtctcactgtttgcattgtgggaggtaattagaggttatagaaagccccgtgctggatggcccagggtccccagctccctgagtttctggacctgaatcacaaggacgccttgccagctttgttttcatggaactctaaatcatcggtaaatatgttttcccactctgcagatgtcaaacacataaaggttagcgcctttacattttcattattaaacagactgtaatgaatacatcagggagagaaatgcggatctctcccgccacaacacccaccctggggatcggagtggctgaagaagtgaaacacctgtaggttttcttaagcatctttgctgagtaactaaatgagcccgaaagtcctcttaactgctgagtggaaagcactctctccacgttgctgagagagtgccacccctgatcctcgcctcgcctcacggagagacgggaaccctgcagaaggctttgtccatccttccctgacacaaggtctcaggctagagggagatccaggagggaatgggaatgtgggtgttgtttccttgcaaaactatctcctgctccagtgtattccaggtttcccagatgaaagtaaaaatgggcctattagaaactgtgtgtaacagcaggcccactgcaactgttccctcctgaagcaggcgctggtgagtcctggaatgccgctgcttcctctcccacagcgctcctgtagacatgccttcctcctctgctttccagcataatccccataaacagcctgggagagggctcaggggagcaacgctgcttaagtctgaagtcagcgtttgcgtatctgtgacttagtcctagttgggagcctgtggcctcctacagacatttatttcaccccaaaataggcgtcataacacacattcagaatttaaaatactgttcccagcttcatagccagggacagacgtcagcggcccagaacgacgaacatacatccttttattttgatattgattgtttcatgcccattgcctcttacctgggaatcggtcagttattaattccaacaagaagctctcatactggccacacacttacttgcctgttcgtttaagtaaatgtattttatgagggccacaaccctattattcagcagttccaccacacctagctgctttttcagttattggtgccccgaaccacacacaagaattattatatgcatttgtgcacaccaactcttaattatctaggatgatgcaggagagaggtggcatgcctacgagagaaatgattgaggatacacatgttatttcatcagaaattgtaacctccgttagagttgggaggaacttcaggccgcctcatctaccacctgctttgcagatgtcaaacccagtaagggaatccgagctcagatgagggaaatccttcctctcaacctgatgtttgctctcagagtcatttagtgactggtctacttgtgtcctggtaggctggttacactcacactattcctggcatagttcgtgaaccctgcttttgagtcttggaaagcagacgggcagggtttaaagggaagtgtttgctcaagatccttagggagccacactaccagtgacattccaaaagtcatcagtccaaaactttagggggttctaaacccacgacagtgtagcctgtggtagttactgcagccagctgaccctcggaatcctgtgtaacctgtcacgcacccaaggaacactgtcttgagatctgaatccctgtggtttttcccttcagccccaggcccaccagtgaggctcgtgttccccgaagtgagactcacctccgtgcggatagtgtggcaacctccggaggagcccaacggcatcatcctgggtaagggagcggcggtggccgggcgtggtggctcaggcctgtcatcccagcaccttgggagaccgaggcaggtggtttgcttgagcccaggagttcaagaccagcctgggcaacattgtgagaccccatctctccaaagaaaaaattcagactattagccgggcatgatggcatgcacctgttggtcccagctacttgggaggctaaggtgggaggatcgcttgagcccaggaggttgaggctgcagtgagccaagattgcatcactgcactccagcctgagagagagtgcaagaccctatccccaaaataagaaaaaaaaaggagtgatggtatttaaaaggagagaaataacaatcaagttgatgtcttccgtgtttgttagatgtttatgaggttaaacaaaaggctgtctccagcagcctagcatttcctgaaccgagatgatcatgggcctcttgactgttttctgagctacgtactaaaggtttttcttatggaatgaaattcacatttttttaacgtggaatttcttccattcgtttgcggctcatggcgataccgtttgtaaccgaccttcccttcctctctgaaatatcaggctatgttgatgtgtgtttgagaaacaacaggctagtttttcagagaagatgcagacctagccttggttcccatgttcctggaaacatctttctgctgcagcacttgcacccaatccttgtaagaagccgctgagatgaagcgcatgccctgggtcccggggaacgcgtttacttctgacttttcagcattacagccagcataccaactctggtaacacagatgaaaagcctgaatttttccgttccccaaagcaacaaattctattttaaaacatcccagttccttgactcattcaccctttcacagagacaaagtaaggactttccctgtgcaggtgtcgtatgtacagtggggggtgaggaatgaatgaggtgtgcctgtcctcaagttgcccacagtcccgtaagggagacacatgttgagagtacagtgagataagccatctgaaagaggtttcattcagtgcctcacacacagctccttctgggtggggtctctgtgggtggaagtctccttttgagagggatctggagataggtggcttctaaagccttggaagaagggaagggggctgtccactcagccaagaccgaatgctttcagcctttgggagcactgacagctccaaggctggggatggaggctgggccgggtcttgagctactgtgagctccctgctgtgtcctggagaatgtggccctgagacctggacgttttaaactggcctgttagaggcaagtgcagcagccacagaacattgccccagccccaggttagctctcgggatattgccataccagacaccccgattcggctagcctgtgttctaggtgatttacggtaaagttataaacccagacttacaaacaggtggtaaaattcaccacttttgcctgcatttgatcttaggattctaagacttggtttgaagaaagagtttcacatcactaaaaaaaagtttggaggcctgtgttgaacggcagcaggaattcatccaaggtctttgagtgggaaagctgcgcaatcagatttgccttgtaggtaatcactccggcagcctgagaagggtggacggaaagtcagatatttattgagcccttgcttccctgagagggggcctggagcttcctaagtcttctgcacaaggaggctgtgacctattttcgctttgcctctttctttatgtgatttctggagttgctagacagaagtgtttggctttgagtacggcatttctcaatcaggtgacctttggaattgcgggttcctgctactaaaatctcagttgagcagccaccttggaggtgagcatttcagggcctggcccggcggagagggagctatgagccacatctggtgcctgcgcagtgagcccagtcttggggtaggaaatggtctgcccagcagacagctgtggcgaggagatttgcaggagccccacccaggcaggccctaacctcagcacagcacccaggcatcagccttttctggaacaagcagggctaatatctgattacccgggagctgtccccagcatgctgtgaaacaagaaacattgacagagtcacaggagtccacaacaacagtgttccccgtgaagaagcaggctcgccccagccccacctccaccctggcagggcccctggctcccactgccggcctcggtagaccctcccggcaagtcctcactctatggtcacctccgtccactcactgtcagcttaccgggctgccaaggatcagttctggagtgcggaggcgtgggagcggtgcaggagcaaagcatgtgcttcatctgtgcttctctcttgccacagacggacgcgtgctcagattccagtactgtgactttgacccagggcgtccttgcacacgtggggaggctctggcctcagccggctctaggccccgccctctgcctgacacccacttcagggcatctgccctttctgaggactcacgccgatgtcctctgtagccccgggtcctcactgccccgctccctgcacgtgtctacctggtgaggcttctcctcagcacgcccgccggagtgaggcccgctgtccactgagcccatcagctggttttatcatctgtcgtttactttccagactgtctctgacatttctttttccgatgacaagagcactataaaatgataattgaggccacaatgaaatcccatttcacattcgccagatttggcaccataagtagctgtgataatgccaagtttacatgaggatctggagaaacaagacccctacacccttgccaggagcgggagtttgtgcgtccactttggggagtgctcaccaggaaaggtgagcgcattcacactgcaccccagacgctctgcacttccaggccttcgccctagagaaattcttgcctgtgtgcacaaggagaaacgtacaaggatgttcattacagattcactgaaatagcaagaaagaaagcagctgtcgtctgcacaagtcagatggcacgaaccttggggctgcctgcttttcctttcccctgtgttttcaacactgcatcacggacaagtaggccggcagcctgggtaacgttttggactcagatctcagcctatgcttattagctgagtgaatttatgcgtgtttcttagcattcccatgcctcagtttccccatccctcaaaggggaagcacattcgtgcctccctcactggttagagttgcacttagaacagtgcctgccacatagtgagtgctgagtaaacgttagcttccgtatcagatcgaatatttcatcgtttccctggcaccagaggaggctggaggctccctggacttgagagctcctcctagaccattgggggctcagcctggtcctagtattcccgttgcatgcagcagtggtgtgctgccttgatttgtcctccataactctggttgctgaagcagaggcttcttgccgacaagagaaagaaaacttagaaggctgcttgggttacagagtgttcctaaagtgcgtcgggaggtatggatcttgatttgtggtcactgaaagccactgaagcccaagtgaggagaaggataatcacttaaatactttgagccctccaaccgtgctgaacgctgctgaatcacacagcaccgtgtctacctgcgaggcagacaacgtcactgccgagcctcctctgtcatgcagcattggcttgtaattgtaatgcatgttgtccgggtaacctgtcacccatgggtcattacagccggcacaccacacggcggaggctgcaggaagacaggaagacaattcctgcaaattcagatgggtgttcacaggggagaaagcaaaacatcttttcgtctgactcactttacatccagagaccttgaatcaatgttcccactctggcagcttggccttctgagtacataaacacctctgccgcccgagcttttgtaatctatatcaaaacatgttcttgcatttccaaaagagattaacagcgtgaaccacagcaggcacctagaggagaaaacacttgcttatttgcgtaaatattttactgtggagtgcttttagcatttagaacttttctttggggggatggggttggaaccccctgagtacagacgtccctccctcacccaccagctgacaccacatggccttgactggtattacgctaacgtgatgatgcgtgagctcttcagacccacttgggcctgccctggccagacacgcgggatcccgccctgccagcaggagggcctaacatttacctttaagcttattacgaagggtgtgcgggaactctgcggagaatcaggagctccagcaagtatgatccctgttggcagattcagcgttttgatccccagcccttggatggataagctgcaaaacccacaggccacggcatctaggctcggccagcgtgggcgtcctggggcgattcagtggcttgcgggttctctgacccacttgcccaccaacagcagctgcagagagatcggcagcacgtgccccagatggtcgtgctttggagtcatgagcgctggggtcccagtgatgctcactgaacagcaactctcagacaatgccttttgtttcccagggaagtgcacaatttattaaaggtttgcaactagctgggcacggtggcacacacctgtaatcccagctactcagggggctgaggcatgagaatggcttgaacccgggaggcggaggttgcagtgagccaagatcgtgccactgcactccagcctgggtgacagagcgagactctatctcaaaggctttgcagccacctaaaacgtccggatagaagtctccaaattgctctgtgtatagctgtgcggcgtcagtcttcaggctgacctggagctgagatgcctacaaggcttccagtatccagcctcagctccttagtgccaccttcttgtgtctcgagcagtggacggttctggaacttgtctcaggcccgtggcgcagtccctttctggattctgattgtctaaatgtgcagtgccacctccgtcttccaggtgtattcagaaacccactcaggcctctcacttgatgtttttaatcttccatttggatcaatgtgtctcgtacttggccttgctccttttaatgctcatattatcataattcacccatacccttaaaaacagggctcctcgtaagccgcattttactgctgctattgattcggcctgttcattcctccctcgcacacgccgccgtcttctggccttgcgtcgctgaagtgcagcgcactgatgtttctgatctcgctgtaaccgtaattacataactagccttttccacagaaacgctcttatctctgaacaccatctatcattattctctaaaaatgcaaggactgctactcagctgctcctttgtgccatttatgtacagaaaaaaagctgtcttctattgtccatcgagtctaggactttttaaacgtgtcaaggtgagctataggcattcatctttatgttcagcagaccgtggtgtggcgaccagctgatattatctttattttagggcaaataataggaaggtacaaatagaacacacaggccaaggagttttcttccagtgcctagggaaccagatcagagagagaagaagaacccagatttctgcaattagcagggatgccgtcgtgctttgcaatctgcatacattgtctcactggggctttgccaggcctgcatcctaaaggtcaggggaggggagggcgaccccactgcaaactccccccttcctacttgggtccagcggcactgccacgcagtgcactattaaacagtcattaaaattcatgcttctaaagggaaaacatgcttttgttatgttgtgcagaaatcgcagaatgaaaaactcatactgagtgtggaaatccgggtttgttgagtactcatatgcgtagaaaaatgattaccaaaggccaggcatggtggctcatgcctgtaatcccagcactttgggaggctgagaagggtggatccacgtgaggtcaggagttcgagaccagcctggccaacatggtgaaaccccgtttctactaaaaatacaaaaattagctgggcatgttggcacacacctgtaatcccacctacttgggaggctgaggcaggagaagcatttgaacctgggaggcagaggttgcagtatagccgagatcataccattacactccagcctgggcaacaatagtgaaactctgtctcaaaaaaaaaaaagagagagaaagaaagaagaaggaaggagggaaggaaaagaaaagaaaagaaaattgatgactaaaaaaagtcccaagacagctacagttatctctgagtggcagcatggtcctcctgcagaccagcataccatcaccccagcttccaggccatcacctgggactctgcccaggggctttctgtggctgccggagcctgctaggttttgaggactgggccatacattcaaggggtgcccccaacagcccttagccaaccgctgagaggcagtgggcgcacactgcagctccccccgtgtcatgtgttggggacgaggctaacaggttctccaccggcccccacagtgggaggagcccagccccacggcccctgccttgatgcacacacgttcatcagcttcttctccgtgtcacttctctacccaccccccatttcctggagtgacctcccaaatcgccacttgcactccagtcctggcctcaaggtctgttcgtggggcacccaccctagggccaaaggtgatttcatgggtttttttttcctgctttttttgggtggcttttatacaaaagaagcatctatctatctgtatgtataaacaactatatatgtgtgtatatatgtacgtgtgtgtgtatatgtgtgtgtgtatatgtgtgtgtgtgtatgtatatatgtgtgtgtatatgtgtgtgtatatgtatatatgtgtgtgtatatgtgtgtgtatatatgtgtgtgtgtatatgtatatatgtgtgtgtatgtgtgtgtgtatatatgtgtgtgtatatgtatatatgtgtgtatatgtgtgtgtgtatgtgtgtgtatatgtatatatgtgtgtgtatatgtgtgtgtgtatatgtatatatgtgtgtgtatatgtgtgtgtgtatatgtgtgtgtgtatatgtgtgtgtgtgtatgtgtgtgtgtgtatgtgtgtgtgtgtgtatgtgtgtgtgtgtgtatgtgtgtgtgtgtgtgtgtgtataatcttgaaaagctgaagccccaggagcgctatgggactgaggggctgagagctttagcaccgcatcagagggcctcgccctgcgctgtctgggctgtcttggagctgggtggagccctcgggactcaggcagggagagtccatcgatgggaacgatctggtaatggggcagggccccaggcctccctgaacaacaagaccccactgttctcccatgagcctattcattgtgcacctctgggccagctctgcaaacggtgattcctgccaggcccacactctggaagtgtgacctccagagtgccttgtccccctgtcaccacctccctgggagcacacaggttcccttcctcgtgctctggctgctgcagacagtggcgctgctcctgcaggccttctctgccgccccgctccaccccagcctgcacctcacaggctgctcgtccccctctcagatcagtggctttgcctctggcccccgctgcatagcgctctccctgggcccacctcagctgacctctttcctgatgttactccccaaggctcttcccgaggactctctttctttggcactttctggaacaattcagcctccccagatgggagccctcacatgctggaggcgtggctctggagctgggcccaagtgggacccccggccccacgatgaggggctgtttcttgatgttttgcagtttcccccactctgtgtcggtcaccttcagaatgtcctgctgagtgactttctctgaattgttttctgtttttttctcccttttctttaatcatcagaatcccatcatactgcagcaggggggagctgaggccaacagcagggtatcctgggaagagctggggctcgatgccgagggaccccagccctgccctgtttactgtgtgctcgtgggcacccagcccctccttgcctgcaaatgtgaaatggaaacaggaatatctgcctggggaatgtcatgaagtcttaatatggtagctatgaagtgcctggaatatagaggcccctaataagctgtgtctccattttaaaaaatgattaatagaggccagacacagtggctcatacctgcaatcccagcactttgagaggctgaggcagaaggatcgcttgagccgaggagttcaagaccagcctgtgcaacatagtgagaccccatctctattttaaatttttaaaaaaatgattaataccaagagatgagaactgagagtcaggcagagattagaatttgcctgagggctgggtcaggagccaggtctcccggctccctgctgtctagtcaggagcttctgagagagaggcaaggaccacacacgaaaaacaatccacaaacccgaggcagtgtatcctccaaggcaagtgaggtgaggcccacgtggggcagtgaaggggcaagtgcataaccacatgatggaagcctgtgtagtctgcggcatggccaaaggcagggctcaccttggaggacagaagagtcaggtggggccattgatagaaaggagggtctgtaagcaaacctcagacagcttggcaagaagaaaccagttcccacataatccccaaatcctgtgatccacaaggagtgcctttgaacaacatcttcatttcatctcaggattattacctctagcaatggaataatctgggcagagataaaacatggtgaaacagtaaagattaaacaataatgaaaacacgtctgtaaccatgccctgctcctgaaagtaaataatacctcattaattcagacatagtcactgaaaggcaatttggattttgagcgagaagtcttaatcacacacaactctccaacatattaagtaatgaatcaagggaactcaggtaggctggtgggatccataggaaaggcatgttcctggccatcggggatgctggggaaggccctcgttagtcgtctgtcggggccaggcctccaagcatcttccacacagggctttctctttctcttttagggataggcatgtttttgttgttgtttttgagacagagtctcgctcagtcgcccaggctggagtgcagtggcgtgatcttggctcactgcaacctccgcctcccgggttcaagtgattctcctgcctcagcctcccgagcagttggcattacaggcacctgccaccatgcctggctaatttttgtatttttagtagaggcggggtttcaccatcttggccagggtggtcttgaactcctgaccttttgatccacctgcctcggcctcccaaagtgctgggatcataggtgtgagccactgcgccctgccgggataggcatgttttttcacacggtgaagaagaaatctttttagccacttgtgcaaaatcagtgagatgatcccacctcgacagtgtggagggagcaggctgaaccctacgcatacatacatgagtctgtttttaatgcaaacttgatttttgctgccttagcgaaagattcgtatctcttcatctctaggaacgatattcagatgcctgaacttaacactgggttacacatcattcttggtggttttggttttgcgtttttgttttttgttttgttttctgtttttgctggagacagagtcttgctctgtcacccaggctggagtgcagtgacgtgatctcggctcaccgcagcctccgcctcccgggttcaagcgattctcctgcctcagcctcctgagtagctgggattacaagcgcccgccatcacgcccggctaatttttgtatttttagtagagacagggtttcaccattttggtcaggctggcctcgaactcctgaccttgtgatccgcccacctcggcctcccaaagtgctgagattacagccatgagccactgtgccctgctaaagttttgtatttttagcagagacagggtttcaccatgttggccaggctggtctcaaagtcttgacctcaagtgatccaccctccttggcctcccaaaatgctgggattacaggcgtgagccactgtgcctggctgctttgcactctttacctggcacatttgcatgatttttgagccatgtgaatgttacacagctcaagaaatcataacaatattgaatgtctttagacaaaaggcagcttaagcctagaaggtctccaagatgaacatcgattatgtggccagagatgctttttccaggcagaacacagccgcccagagacctcagaattagggtcattctcccagccccgaggaagcaggacattgttggggaatttacattttaagggggaactccgacccagggagtcctgttctgaggcacacgctgtaggtagttaactcaatcaggcattgcaaagttgggggtgtcactcctcagggctgggctaggggcttggccatgtctgttctgggcccctgtgctgcttccggtgggcattcagcaccctgtcctggagctgcaggggcctaaggcaccacgcccatatcagtgcctgtggacaggtccggggaataaggttccatggaggctgtgaggaatgataactctgtggtcataccggccaccacagggtgaggaactgctagggaaggggtcttgccagctggaggagggaggagaagtcgtgactgcaattgttttataataatattaaagccaggagcaaccaggcatggctgtgccagccaggtcattaccaccgtgagcccccagagccctcctggcaccccgtgaggtgtcctgccatatccttgcaccatgtagtccagcaaactgaggctgggagaggctgcatggctcatccacggtcacacagtgaatgattggcagagcgggattccagcccagaggtgcacccccaaaggtgtgtccttcctttgaagggcccgctagcttctattggagaggatgcttctgcgcagtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatcttggagcttcacagcctcgtcctcatccttgtcttgtatgcttcctgacaggcctgcggcgagggtctggcatgggaagcgttgcagggatgcagcagggtccctggatgtgcctagcagtgtagccgctgtggtcacgctctcctcaccgtcagagtgcggggcggccaggagccccgaagcctcagactgagcttccattgtgtgtgcacggctgactccctactctcactgtgcaagggtcggggaaacgggaggcctgtgggaagagctggccctctccctactctcactacacaggggtgtgggggaaggggaggcgtgggggaaggggaggccgggggaaagagctggccgccgtctctaggctgccctcggtcagtcagtgactgggaaggaacaggagtctagcagggacacccttgccagagacctgaggccagcagggccacatccaggaagtctcagaactcccggtccccattgtggggaagacagcccgtccactggaggcagggcagcggctgcgacagccactctgggggcctaagttcagggtcctgcagacacctgcgcctagaggtggctgcgtcatggacagggcagggcgtgtgtccctgtctgtgtggcggtgatgacggtgctgatggtgagcggtgatgcctggggcctgatgtgaggatgcccttgaggtctgatctccgtgtaattgtcctcccacctcccagatggcgggctggggaggggtttgttaaatgcgtggatgagtgacaaggcgcaggagctgggaggatgcctgtgagctcggtcgttcatgaaccagagacctgagagcaggaagagctgagagagggaggggttcacccggaacagaggctgagggcagggggcaagcagcgtggggtcgcccggcagctcctccccacagagggtgagccaccagtgcagaggccactccacgaagaggcagcactgatgagaccggagcgcggctctgttccccccgtgcgtcctcccttgtttaactccagcagttgattttttttggaagccacagcgccccgtcatttctggttttaatcagcgcaggagctcagccgctggaccacacgttgtctgtgagccaggcagggtgcggactggagctgcagagttaacaaggttcctccagatgccagcgggggaggcctggggcggccagtggagaggagtgatcgttaataaggaacgtctggtcaaccccaagcccctcccagcggaggaactgagcaagccaggagccctccctcaactgggcagcacagggggattctgtaagcagagctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctctggggagcagggagggactgggtccctgtggcatgctcgcctcgtgcccgcatcctaaggaaagatgaacccgtgttcacaccttgttctggtgaaggatggagcaggaaacaagcttcacagggaaatccacgtggggccccaccattcatcacagccatgagaccaccctttcagtgcacaggcagtgacctccagagacggggaagagacagatggccttccaggggtcagcacagggtgtgggcacagggcttccctgtgccgtgggtgactggctcagcagctgtctcccatgtcacctgcctgcagggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagaggtaagaccttgggggacccgggggtactgcagatgttgtgggcacagcttcctcaatcaggccctctggggtctgcggggtacctgggaggcttcggccttcccttcggagaaagagaagggatgtgagcatttacaaagcacccattgcacctgacatggagctggacacactatcaaacagcattgcattcacaccttcagcctcacacctgctctctcagacacgtgagcactgcgttcacaccttcagcctcacacctgctctctccgacacgtgagcattgcattcacaccttctgcctcacacctgctctctcagacatgtgagcatttcgtgacacactttcagcctcacacctgctctctcagacatgtgagcattgcatgacacactttcagcctcacagctgctctctcagacatgtgagcattgcattcacaccttctgcctcacacctgctctctcagacatgtgagcatttcgtgacacactttcagcctcacacctgctctcagacatgtgagcattgcataacacactttcagcctcacacctgctctctcagacacctgagcattgcattcacaccttcagcctcacacctgctctcttagatatgtgagacggtctcaggtttaaggaaagcaacattgctcgcagaggctgagtacctggggcaaggctgcagagtcaccacatttgaggttgagctccccgaaagcagcccccagtctctgatgttaaacccacgtcctccgtagagcaggtgctcagtaagtaagttttccaaataactgccttcccaatgagaactgccgggcgagcagggctctgctccacgcacggagacaggtgctccatgcactgcacttggcctatccttcctgcagcccacggagcagcatggcattagctctgatttttaccaaagatgagacagaggaaactgagagagttttattaatttgcccagacacacaactgcagagctgagatttggactcccctctgacaccacgaggccgactcttcccatgaaagtctatagtgggcgcccttctcagtgggctccgcgcatgtcctcgggccttgcagcgtccagggttggtgccacaggaccctcacctcagcagccccagctcccactccaggtcctgatgtcatggccagacccagggaccctgtgggaatgaggacgggagggagcttgcaggcaccactgcagggatacttggagcacacagttctggccacgctcctatttttgtttttttatttttgaaacaagtcttgctctgttgcccaggctggagtgcagttatgtgatcataggtcaccgcagcctggaatgcctgggctcaagcaatgctcccacctcagcctccccagtagcggggactacaggcacacaccacccagctaattatgttctgaagagacagagtcttgctatgatacccatcttggccgcccaaagtgctggggttacaggcatgagccactgtgcccagctaatattttaatttttgtagagatgggggtcttactacgttgcccaggctggtctccagctcctgggctcaagcgatcctcctgcctcagcctcccaaagctctgggattgcaggtgtgagcccctgcctttggtcctcccatagcattcagtgaaagcacatcccctctgtgaccattaccactatcattattattgttattagctggagggacggaagccctcagtcgccacagacacccgaggtgcttctgcaatgtaaagcacatggaagggatgccctgtgaaaggagcgcccctatccccctgctgccaccctgggtatcagcactcagggctgtcggcttctcaggaagatggtaatggctcccaagcaaacgttttgacttctttctctaatgtatttgtgtggttttatggttcatttatcttaaacattgactgtgcccctcccgcgagccaggcacgtgtgcaggtgcatcacagacacggtctcacagcaggtcctcttatttccccgtgtcctgccccacagccccgccccacagtcccgccccacactatgccacctgattatccggaccagagatttcggagattttccattggggcccccatcctccatcctcgtggctcagggagagggaatccaagagacttgctagttaccactaagtccaagagagcctttgaaacgggatacgctgggccacctcccctccggagaccaggtgaaatcacaagggccagaacgtgtgcttacggaggcaagtgctgatgaagtgagacgggagccctcctcccacacccgccactgggggccgacaatcaattgcagctttacacacgccacgcattctaatcagaatcaataatcttcatgataaacaattaaacaattattccttccgccgcggaacttctctgctgaaatcgatggggtgcagaggcacagcggcggcagatgatgggcactccaggccgggcctggccccaggcaccccgcgtcccgcatccaagctactgcacacaccagaggcagtgacagcccagaggtgccctcacctacagcagcactgagtagatgccgtagatgctttaggccctgggtgactgcaagaaggaggaaattcagcgttaaaggtggactgagcacaacatcagaaaaagagagaccaaagggaccacagggcttggaacagcccccaagaccctgcgaccccagctgtcatcacagacacagtgcctggtggtctggcagcccagggactcctgtgtggctttgttcctgtctgttggtctctatgagtagtgcatccgaagtcagccttaagatagctgctcagctgggtgtagtggctcacgcctgtaatcccagctctttgggaggccgaggcaggcggatcacgaggtcaagagatcaagaccatcctggccaacatggtgaaaccctgtctctactaaaaatacaaaaattagctgggcgtggtggtgcacacctgtagtcccagctactcaggaagctgaggcaggagaatcccttgaacccaggagacagaggttgtagtgagctgagatcacgccactgcactccaacctggtgacagagtgagactctgtctcaaaaacaaaacaaaacaaaacaaaacaaaaaaacagagcctctcatctccctgacccaaggaagggactggcttcagactgtccaaggcatgcaggcagctctcatgggcaagcagtcagccctgtacagcagcgtagcctcctggggatgttccttgggaagggcagcctctcacatgtccctggtctgtcctcatttggttgcagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacaggtactgagagagcaggagcacctccccggggaacggggccctggccgcctccagccagctcctgtccagatagtggggaggctgtgtgggccaagcaggtgcacccctgagagcacaggccccctttctttttgacactccccatgctgggaatcccagaactcctgggtcctggagctacttccaagggcccacccccagccgcttcccggagtctgctcttccaggtgtgcagggctggtttggtcaccccaggacccagggattggcgaggcaggggtgatggggggcaggctggacatgtgggctggagtcctagcccctcccaaggctggcaatggggaggggaccatgtggaggagggctgggctggcctcgggtgtccagggctggagggacgttgcgtccccttgcgttctcgaaagcagcagggagatggatggcaccacgagtactgtgcttccttagtgatggctggggaagatgggagggcatgcctaggacacgactagaatccgtccactcactcagttgtttactggacctctgggctcagcatgggagagggttgcattgacaatagcagcggcgttctgtgggtcccccagggtcctcacaactgcggtttacagacccacccactctttacagacaaggaaactgccacagtcacacagatgggcatcccagggcttagaagccaccccaggagtccacaccctcaccacatgccctgaccaggccctcctggggcctgtctggttcgcaggccctgcctgggcagggccacccgggacacccgccttgtgcttctcattggcccagagtttggtcacttgttactgagctcacactccaggctgtggagcgggggtcttggagtgagtccctccatgtcgcagggctctggagcctgcaccaatgactaagagggtagaggggccaagacggttgtctccaggctggccgagcttcctctgtctctcagatggtcacataggtcagctctgcgtccctgcagtcacccagtaaggggagaccatgatcccactctacagaggaaggccaaggtcagaaaagtcggtcatttgctcatatcccccacccagcctccgtggcgcccagccatcctcgtcttcgaggctgcccgtctcagcccttcctgactgaacctgaatgtagggagggaggcaggtcccaggtgaagcccctggcagctcctcagaacaccaccctggccccactctgccctgggggcaaagttcaggctttggagtgagggctgattggagtgtgggtgtaactggtcctagatgtgacaacagggggtttcaaagagaagagaaacctccaaaacccccatccctggcttgaggaccaggcccatgacagaggcgaagcacttgcccagggaggggtggccgaccgggcgtctcagtacagagctgtgaagctggaactgtgcaggctcagcctggcttctgccacttgccgttgagtgatctggggcaagtgacgggctctcaggtgtctccagctccctggcctttgagttgcgaggcttggaggtgataaggccctttggacggtcatggccatggatgccagtatcgcctttgccaccccacacagtgtccccaggaggcacagctgggtgtcaaatgcaaatcctgaccagagtccctgagcagtccaaggagggtcacacggaccatcgggaacccatgctgcggctcccaggcccccattggagaccacagaccagcaaggaagccagcgccccagtgcacagctccagctctctgtggccccagaggacccaccctggcacagtcaccctctgcagtctcatggtccaagcagccctctgctcttctgaaaatcgaggtggaatggtccctgcgcacggggcttgtttccagcaaggccagagccattgcctggcttcccctcttacagggcacaacatctggtgaggtccgtatgctggcgggttggaatttagaaaagctgttccgtccccacaactgtggttatgcccctcatgttaggaaaacgaggctgcagcagctccggcttgatgtcccctctgaggtgttttccctggtgatctagtcactcagcttccagacagttaaagctctgacaggacttcaccaccaccaccgccatcctcgtcgccatcattatttccggaatcccctcatcctgtctagcacctgtcattttcaacaccacttccatgtgtcatttcatacgatctttgtaacaaccatgtggacatgcagcccagacttctcactattcccagtttacacacgcagacattgaggcagagatatcttaagtaacgcatatgcaggtgccttgacgtctctaaatggaagggatatttcctgaggtttttgtagttgtcacattccgtgagccagaggtcaaggctccatagacacagtccacgtcctacagttaatttacaagggtctgcgacgtatgaaaacccagtgtgtgtgcatctgaacaccaaactttccacagtcagtctccccttagtagctgcgtggccttggaaaagtccaacccttggctgcctgctaggactctgtcctctcatctgtgaaaggcagggctggagcggggatcctgctgttccctccagctctgtgagtccaaggtttgcctcattgctgaccgccacggaactggcagccaagaaataaggcaatcggaagagtcagactgtccgccaggttcctgccagcatctcacttgccctttgagctacagcaacagaactcgaggggcacagctctctcccctccagaggaaggcactcctagtggcagataccatcctcccagagccctggaattctcctggcacagccccgagggtcaggggagtatggccaggtgcgcccagcctgacttaataaagtacacaggatgcttagcttaattggcagtgtgctcacatatataaataacctcaccctttgtgtaaccatctaaaagaaggaaaaaaaatatccagccactattcctgaaggcttctgaagccaaacagactaatcgtgtgtccgggacttcatgctggcaaggagaggtccatgtttcaggacagacagtttaatttggtataggagagaccaatgtcaatttcctaatgggccagaactaggacaaatgcttcctctgcctatcaatagagaacatgtcacaggagaatcccaggaaagtgatattttgtacactgccacagtataatctcccttcctgtttaataatcctgacagctacattttactttcaccagttgtgtgacatctgtgagtatccagaaaacattaagagtttaaatgtctcaatttggtgactgtgactacgtccagggaatatgggtcgagacccccagggagaggggttgggtctgagacgtgttcaggtgttgccagtgtctggttggtggttgaagttgtgagacggggtagccacccacagaaatgcagtagagaggaagaagagaagggctctgagcccagtgtgacttggaggttctggatgtcactttaggacagagcagtggctgtgcgggctcagggggtggctgtgcatctggctgtgatgggctcagctcctcctctgagctctgtcgtgggataggtgcgggggttccaaacagaagacagaaaggcgcagagggaatgagcatggaaaacagcagggattcaacgaatgtcagcaccacggccctagctccttttgactgatttcttttttttttttttctttttccgtataatgtaattttttaaaaatatcattatttaaggatcagatgggctgggcatggtggctcatgcctgtaatcccagcactttgggaggccgaggcgggtggatcacctgaggtcaggagatcgagcccatcctggccgatatggtgaaaccctgtctctactaaaaatacaaaaattagccaggcatggtggcatgtgcctgtaatcccagctactcaggaggttgaggcaggagaattgcttgaacctgagcggcggagattgcagtgagctgagatcataccactgaactccagcctgggcaacagagtgagactccatctcagaagaaaaaaagaatcagatgaacttggccaaggatatgatacatgagcttgatattctttgtgatacaatagtgaggtctaagtgtttgtgtttgtttggttggttgttttatttgtttttgtctgtcacctgggctggagtgcagtagctccgtcatcgttcactgcagcctccaactcctgggctcaagataccatcctgtctcagcctcccgggtagctaagactacaggcatatgctatcgtgcctggctaatgtttaatttttttttttttagaaatggggtctcactatgttgcccaagctggtctcaaactcctggcctcaagtgatcctctcacctcagcctcccacagtactgggattacaggcatgagctaacatgcccggccaatagtgaattcttaagaaacatttttagtgccttccagataagtaaataaagacagcagtgaatcgctttaaaaagatgctcagcactcatccattttataatagaaccaaaatgaaggaatggagctcctcctatttaaaagactctgcatttagctctgaggcaggaacgtggaacttaagctatgtccttccccgacgcccattccagaacactttggctgtggaggtcaagtttgtgtatgtgattagccgtccgaggcagtacgagtacaaactggctttctaaatatatcggttattgatttggggtaagcaagagttctgatagcaagttcagagagtgagggtcctgtattacccaaattatttatttcctgagtttgggatgattagaagaaagagattagatggcagatgttatctcaaaaatatccctaaatctatccagcttctgagtttgtatgtggagatttgggaggtgaggcatggggaatgagcaaaggcccggggagtcaccaggcagcatcagtggcttcctggggacaagtgagggctccggggtgggggagccagagaaagctttcgggaagacaagaaagagcacatcacatttattcattgcctgctgtgtgccacgatccacccgactccatgaggatgcgtgatgggatgtcattttcacgacagccctggaagccccggtgctgctatctccatgtccatagccgaatacagcaaggctctgagacactgacttgctccagtgagtagtggcagagccagcattggaattctgcttagcccactccaaagcagaggtttgggctggcttggaagtgtgaacagagtgcagaattgggaggagttagaagggttacaggagggtgttcttgcatcctgtgtgcatttgtccctttatcatggagtcaccaaaatccatgctctgccacaggagggagcatggcaggagcaacgggggtggggggcttgaggatcaaacatttggtctaggaggtagaccagtcatccacaggagcagcgctgcagggaggtgaggcaggttggggtgagtgcacagaggatgctaccgtctctagtactgcagagccaggagaggggttgatagcactgccctctgcctgcctcatttgggcagtggggctgctgctcccatcggctgcctgctggagctgctttctgcctggttttgggggcactggcgtggcttccaccgagagggttaactcccccagatccgcattttgtgttccctgcagctcacagagacacttaatcaatccttgttgaatgaagtgagtccggcaaaacacaggcctcacgctaagaaccctgctctctgtcctcctttgcacccaaacccatttgtctgggagccaggctgatttgtccagccacctgacacgcacttatggcacaccacgtgtgcccggctcagtgccagacccaggcaggacagtggagaaagaggggtttcaaggagcttgcagtgtggctccaaacccccaaatcatagcaaagtgtgaagtactaaacagtggagtgctgagtataattacagttcaatgccagaggccagtgagaaaacaaatacatcaataagtaagcataatcgcaaataaataaataagtaaacaaatcatttctgcaacacctactgtgtgccagatacaacactggtatttacgtgtcctcataggcaaccccccaccccagcctgagaaacttcgcagatggggaatagcatccttattcaatccttccacccatagatctgagcacctcctgggtgttcttggctcttgggatacagcaggaaaggaggccgactcggtccctgtccttgtggatgttgagtcttgtaaagacagatagtcgtcaaggaaatgtcacccatcatgatgcagaagatgaagggaaggaacagggcacgggggacagcaggcagggccatctgagcagatacttgcagatccataggaacagctgatccttagtgagcttgccccacaccacacacctgactctgctgagtgtctcacctgagtttaagcctcacctcagtttcacgatgcctgtgctattagcccaggtaaggaaactgaggcaaagtatgctgtccaaggttaactgggaggtagaagccaggcagtttgactttggggtccacattcctgatgcccactctgctgcctcctggtacaggagccagtggggctatggtgggtggcgcagggggaggaggcagggaggtcgtgggagaagacacatggttatcacccagatgaggcaaagtaactcctaggatgccaggaacagaggggaaattgtttgttttaacttagcaaaggctgtctaccagaactctggagcaaaggtcatttttatggtcggacttcagaagcatctccattaaagctgggaccaaggccagctgtctcctgtggctgtttttccagttgtggacgctgagtgcagagggtctgagatgtgcctgcggtcagggactgggaagtaccaagaccagaccaggttctggagggctgcagtggaaaagcaggccttgaggtgtgagctggtagagaaacagtgtcacctggtcttaagcaggacggggacctgaaagcaggaatagaatctaatcatggtttccaaaaatggttatcagttttctaaaaagcagaatccttcctttaaaccaagtatgacccaggccgaatgcataaacctgatgggcatggagctcttgttggctgatgggggctgtgtgggcctctggacttcagagacttcagagtcctgggggtccacagggctccatttgaaagccactggtttacagattccattgggagtgaggacagaagactggttttcaggtgatgagggcttcggtttagagtgatagttgagacttttagacatgggtaacagaggttaagagtcctgaggcaccccgagttttctggtctggaaactgaggaggatggagccctcatctatgaagagccgctgcccgccagggaggagaacagagcagtttcctcacttgctcattcggaagtcgaatgaagggtatctgagaggaaccagccagtgactgggttgcagggcgggtccctgaccggctggggcttcaccaagatcccagcattgtctgcacggaagagtttggctgaagtcttagtctcaggcatggcatggggcttggcacaggagacccattgcatgtggagtagctggacggacggacggaaggaaggaaggaagaatgaaggaggggaaggaagaaagggaagggaaaaggaaggagggacgggaggtggaagggagagaagggaagaaggaaggaaagtgggaagggaggaagaagggagagaaggaatgaggggagggagggaggaatgaagaaaaggagggaaggaaggcaagagaaaaggagggaagggaggtggaagggagagaaggaaggagggaaggaagggaggaagaggggagagaaggcagcaaggagcggggagggagggaggaaggaaggtgggtgggcagatggaagcgggcccgaagtgctaacagcagaaggcacctcaggaaaacatgagtcccgttaaaatctccgtcgacgggctgggggtatttttcacttggatgcttgacagggatgtggtcttttgtaaagtgacatgtgaatattgccatttactagtcttgtagcagtgggcctcagttttatcatccttgaaatgggaataatgatgcctcctctcccagagctcgtgtgagttcaaaggggttgcacttgccaagcgcctggcaccgtgtcagccccagtgaatggtaggggtgcggggctggcgggtctctgcctgcagccggccaggaagtggaccttagagaatgctgcaaggctgggtctggcccagtaaagagctccaggaggacggagcgtgagaatcaggcaggaactcattttatacttcggatcagcacaagggcccggggaattagctcttcctgaggacttctctggatcccttggagagcagtgatgtgccgactagagtgcaggggtggctccagtgaggggttggcactgcctccccgaggagccctgagcagaatcttccccctggccaggacgccctgcactccctgccctctgtgcagctcctttctccctgaggatttcaaccgtccaggtgttcaaaggcttctcccaggacaggtccagggtctccttcaagcccctgctcattgcacctaggaagtgattgggtccgacccaagaacagcctccttgctaagctgtctcgggcccacacaggagcccagagctctcagggcaggggagggatttgcccctcttcccagggcttcaccaggaatgcctgagggcaggacagggtggcagggccccggcagtcacggtctcttccacattgcagactgaggcccttcacctcctacaagctgcgcctgaaagccaccaacgacattggggacagtgacttcagttcagagacagaggcggtgaccacgctgcaggatggtgagcaacccggggcccagaccgcgttcctggccgctgcccctggagcccgagatacttaggccacactttcgtcttgagccagaaaggggccaccagggagtggtggaaagcagtagaattccattagtgacagacagctcggagggtttccgcacagcctgtggtcataaatcaaggtttcaagggcttccaaatggaatggaagtttctttgattggcttctaaagcccctactatccattagcatcccagaaattgaataattgatagggtcattaaaaataaatgtcagcgggtagctgggttttaagagattttccccatttttctcattcacgagccactctttgacaacagcgcaggtaagtgatgggaagcgaggtctcctcagagctccaggtggcgttttcagccgctccgtcctacctcggcggcgtcaggcctgaagatggattgttattctgtgtggcccaggcctgtggcgagcccaggaggcagctctatcagccgcgtccagcggtgatcacaggacgggtgggatggaaaagagtggatggtgggtaatagctcagctcccaggctggaaacccagtacttagttcacccagcagcgtttcatcatcattcccgcaacctatccccaaagcactgtcttttccatttaacgctccagtggaagaattttccaataaaccaatttccagctggctcaccctgtgacctcacatctccacttctgctctctcgatgacctggaagtgtggtttctcccacataggcctcccttggcctcagggaccagcagagggtttgagcaaaccattcccggcttctcagcaactcacagaggctgttttgctgcaaaccctgcactcccagcagagcagaacctgcaagagcctccaacaggccccagctgtgctcccaggaaaagcacacttgcccctggaaaagcactggctggcttctgtggctcctgcctctcatccagctcttttctgagcacaaatcctgggagtttattggagctttggggaaagccagtgagaaagagaggagccgtcccgggtatatggggtggtccagggccctagtgagccctgctgggccctgaggagccgggctgagccccaggagctcactgtccaagggtcccacatcgttagattcaaccaactgtggattgaaatgttcagaaaaaaagttaaaaatacaaattaaagatatacagtgtaacaactgtgtatttgtttggagagtgttatgaccttgtacaatttctagattactcatgagagctcctacaattataacattgtaacattgttatgtaacagtattacaaattataacgttgtaggaggactgatgagtaacctagaaatgatttaaagtatgcgggaggatgtgtgcaggttacacctagaaatgatttaaagtattcaggaggatgtgtgcaggttacatgcaaatactgcaccactttattgttagcaaacctggaggcaaaagctacttgtaactggaaaagcctttccggttaatctacttaaagtggggaccaatttcacactaaaccacaagggaaaggctttgcaggaactaaattacaaaacaaaaactatataaatgcattcattttaacgttacctttaacacagttgaggtaatgtttgcaactaagcactaaatcttagaataaagaacaaaaccccacacaagctgatgtcattgtcgtaatctctctgacagattgtgtgaaagcaaagtgcaacagcctcctttgacctccagggcagcatccaaaaggaccatttttgaaaaaaatattgaagggcctcttcagactccagaggcctttcttaccctttgatattcagattgggctttgatgcacctatcttgtcatcgccttccctgggatgtgcagtttctctttgcaatggagttgcattgtatttgtgttgtattgtcttacactatctagagattgacaggcacagactctctccaggggttggggaaccctcggcaagatagggagagtcctctgagtatgtggacggtttactgatgaacagtttctttttatagtgatttctatttccctgcacaacctcacaactcaaggacattgagaactccctgtaatggcaccgctgtatcaccagggctgtcaggaagctggctagagggcccaccattaagctggaaccacaggaggttaagggggttggagggagacccatccctaaaacagaacggggaaggtggaggtgtgactgatgcaggcactgccagggctgaggagggggtgtctggcaggtccagaggaaaatcacagagccggtgaccccgggacccaatcttgggttctaagtggagaggcatctgctagatgcacaagtgtgcctgtgggaagaacatcgtcattccgttcagtgaatatggactggatacagaatgcgtgtcacacttctgctgggcccccgggatcttacagctgggaggcataagagttcagctcaatatgccaagacaggaccacacagatttggagggagcagaggaggcagggaagaggggcacagaagacctcttggatgtggcagatgacaagaagtttagtttggctagagtgcagggcatggccataggcagaggtcaaaccagccttgtccctccagagagcagagcagaaccatggcagactccccttcacttcaccctgctgtcccagccagctgcaacctcaccagaaatcaatctcctttcctgacagccttttagtgtttcaaaccaagtgacctggcatgatcatgtgtcctattcaggaaaagtagctctcacctaggtatcttaaaaaaaagagaaaaagataagttcccctgctctcccagaagacctgagccctgcagggagggtctcgagccagagagctccaggacagcctcactggaggggtggctctcggaatgtccaccacagggagagcccagtctgggtctgtttctcggggccattgttaaggttggctccctcctatcccgaggacaggctttgaaggagaagctctgggaagccccgaggaagggcaggagaaggggacccctggagaaggaaggaggcagggctcaccagcctccccatactcactgagggtggccctgggaagggcggcagaacataacaaccaccctgacccccgctttcctctcctgtgtgtttcagttccaggagagcccccgggatctgtctcagcgacgccacacaccacgtcctctgtcctgatacagtggcaggtaagagcgcggggaatcacgcgcgttttgtcaaatgtgttctcatttccctgcgcattcagccacaacggctgacatggactgcaagctgagccctgagctaagcgtttgagagtagaaccaaggagacacaccctcagactcaaaaacgcgagggggaaatggtgtcaattatcatctcggtgtaatttccaaaacattagaagcaggactgtgatgcacgtagagaatgaacttgactccccttattcaggagggaccggcaggatggggaggccagtctgagagcgttggaggaactgggtatgtcttggcatttcaccgaggacgttggagcaaggcttctgtgtatacacaaattggttatcgccctacaaggcagtaaaactgcaaccgctggagttagcttttctagagaagtcatctgcaaccagacaaaatatctaccggattgtacatattttcccaaagtctgggggtgggtggtggtggtggtggtggttgttgttgttgttattattattattattattattattattattattattattattattttgggacagagtctcactctgtcaccaggctggagtgcagtggcacaatctaggctccctgcaacctctgcctcccgtgttcaagcgattctcctgcctcagcctcccaagtagctgggattacaggcgcatgcccctacacccaactaacttttgtatttttagtagagatggggtttcaccatgttgaccaggctgatcttgaactcctgacctcaggtgatccacccacctcagcctcccaaagtgctgggattacagacatgagccactgtgcccagccaagtctaggcctttaatctccaatgtgcagtgagttaaatgaaggcatattcttccagataatcacacactccttgttgggcctgctcagcaatgctccagtaaggcattgaaggacacgctgccgtctctttcccttagtttcaattttgggcaatgcttactgacaagtacattgatgacaaatataacagagggacaaaactgcccaaggaagggctgcaggccccagggagatcccagctgaagagtggggcggggagctgtgcggaggactcagcccagggcctgtgtagcccggatccggggcagacagatgttgagtttccccagggctagagcttggcctggcagcagacacaacagatggacaggcagggggccaagcacgagggcagagtcaaagtttctggcccacagggaggttcctgaggccagaatgggggctgctgtgccagggagctgggaacatagtgggatggggccagcatggggtgggtacggcatgaggacaggtcagcctgggagtgcctgctgggagctggggtcaggagggcagtctggtgggcacgagattcttccttggggctgaagctgtcctcaaggacaatggcagggtgcccgatgcagcaggtgggaatgatggttcgggaagtcaggagaaaatcaagaggggaacagtggtctagacatggccttggagggcgaggggatgtcccggccacatgccctccgccggtgcaggggaggcaggaaggggtcctgtggaaagtgggggctgcgggaaatggaagggatgctgggaaacacagccaaggccaccagtaggtgtcccagacagagcatctcccagggccctgcagaagggccactccaagggacagtggcttcactttgcagcacggaggatgaggtccaggaccaggctaggacaggaggtgccagagatgcctgctgggccgggagagagacgtgctgagtgagcagcgccagccgcagccttcctgggcatggtcttgaggtgcgtagtgctagagatgccagagaggaacccggtgagcagagccaggctgggctgtgggtggggccagccagggggagcttgggaggggctccgctttcaccctcttgctgtatgatcctatgaaatatgaccatgtttgaggtatgaaagtggcaatttatgtgattcaacctgatatcacttgctactgccacttatctgagggatggagagtaggcgtttaacaagctgggttctgtgaagagtgtgtcatctccttcaagtgtccatggaggtgtgcggggctgcgtctcggctgcctttctcttgctaagggatccagcttctctgggtaggataggaacctttccaggcaatgaaagaatgtcccagtgtctcctggtggaactggaagagcacttctgtggcactcagccctactgagtttaccagagcataggggggccagagtgggaaccacgaaaacagcctgggccccacctctgcccctgggaagccacagcccctgatctgtctgggagccactggaaaagtgacgaaggacccacccgcaacttgccatcgggtgactgtggccctgagaggcccctctgactccaggttcctcctttgtaagaacagaaggtcacaaaggtgagctcaggtctcacacaacatctccagtctttgggggccgctagacccccagacccgagcttcagccctgactcccgtgagggtctccggtgggaggttagagacattcaaaatggaaatgcaaagtcccaagtgctcgtttcccagcctgcaccaacacagtcaatcacaagaacattggcactttgtaccatgctgaatcctaccagaaaattcacattttctttgtagacgtggcggcagcctgccaataccttacctaggtaagctcctttcctataaaggcagtgagcatcagggctgggatgcgtcacctcctccaaacaatggttgtgaaggcatcacttgctgtcagccccagtggacggtgcagggctcgagctccccttggtgctgctggacagctcagggacgtgcctagtgccacctggaggagctgggctggtgtgtgcatcagccgtccccctccagagcccaacagaacaaactaattgcaagaagaccagagcaggaggtggtcaatacaacgtcctgtagaaataaatgcttgtcaactgccaggcaattgaagtataattaaaattatgagtaatttactgcattagaacaaacagaacaaagaaaaagaaactaggtttaaatatagatttgcattccaaataaaatgtttcacctgtaaaccttttgtgttttttgttttgttttgttttgtttttttagtaattactttaaaaatgcaaacacagggccagcactttgggaggctgaggcgggtggatcacctgaggtcaggagttcaagaccagcctggccaacatggtgaaattctgtctctactaaaaatacaaaaattagccgggcgtggtgatgggcgcctgtaatcccagctactcgggaggctcaggcaggagaactgcttaaacccgggaggtggaggttgcagtgagccaagatggcaccattgcactccagcctgggcaacaacagcaaaaccttgtctcaaaacaaacaaacaaacaaacacgggctgtaatttcaaggcttatagacccatttaaatgcctcccttagtagactgtcaggcttgattattcttagtaggacagtcaatccttgcctttcatgggatccagttctgtttgaaagctaaggagtagaactccttctgtcttccagggtggagtgcagtggtacgatctcggctcactgcaacctctgcctcccgagttcaggtgattcttctgcctcagccttctaagtagctgggattacaggcctgcaccaccatacctggctaatttttgtattttcagtagagacaggatttcatcatgttggccaggctggtctcaaacccctgacctcaggtgatccacccaccttggtctcccaaagtgctgggattacaggaatgagccaccatgcccagccttgtgttttcttttaaagacagggtctttccctgtcacccaggttggagtgcagtggcgcaatcatagctcattgtagcctccaactcctgggctcaagcaatcctcccacctcagcctccccagtgtctaggactacaggtgtgcaccacgatgcttggctacttcttcaaaaaatttcatagagatggagtctcactgtatttcccaggctggtcttaaactcctggactcaagcgatcctccttccttgacctcccaaagtgctgggattacaggtatgagccactgcccagcctgtaagtgggttttgagactgttttctagcaaagaaaaaaatcccaagcaattgatcacaccatacgggaggctctcagtgtaaaaggcaccttcccagaggagggttacatctgcctgggcaaaggcagggaggcatcccgccgcttcagaacacatcttggggctgtttctttttctcttcacttgtgccacccacagaggaccaacacctgcatggagtgctgagttccagaggggactgaggcaggccacagaatgtgaagagctttcattaagcgcagtgggctctttaaggcattgataggaagacagcagaaggaacgaaactaactctggccagaggggcacctgaatgcacttggcaggactgccaggcccctgcagtgaaaggctggagaagcgcgtggcccccggcacagcctgaggaaaggctcacgggtgacgtcactggtgtttgatgttgtgtctcacgggtattgcgtgttgagcctcctgtgctctcagaaccatcaggaccaaactccggagagaatccctgttctactctccacaaagcagaaggcacaggatggaaagtgaaagctcagatggtttcactgagcttccggcccgggggaccacggtggccggatcagatttggatttgggcacctgctctgcctgaactcgcaggagacagtggcacgtggttgagcctccctcagcccagctccctgtctctagaactaggagagttaggccctgccctgctgctcccctacctcagcagagagagctgggtgggaggttccacagaggccagcaacggcagagggtccgaggtcaccgttcaggcagctggaaggagagaggctttccctgcaggtcctgcctcctcctacccccaggccttccctccactcaactctgtggctccaaggtgcccaccctcctgggtcttccccagaccattgacttcttcctgcctcccctacctggtgataaaacccaggcacactcctaccaggtcatttgcatttaaacaggctcttttgctgtggcacgcctgtaatcccagcactttggtaggctgaggcgggcagatcacgaggtcgagattgagaccatcgtggccaacatggtgaaaccccgtctctaccaaaaatacaaaaattagccgggcgtggtggcgggcacctatagtcccagctactcaggctgaggtaggagaattgcttgaacccgagaggctacagtgagcaacccaggaggttgcagtgagccaagatcacaccactgcactccagcctggcgacagagcaagactccgtcttgaaaaaaacaaaaacaacaacagcaacaaaaaaacgggcttttgaaaaatgaagaacctccaggaggctgctggcgaatttctgaggcgtggcaggcacagggaaggtgttttgaggcaggactcccagttcccttcaagcttctctccacacagatggccaagccagggtgcagtgacacacagatgaggtcatgttgaactccggcaagtcccactccaccccagggctctgactgagcatccgccatggctgaggcctggcccaggtgctctgggcatttaaacatgaacaagacccgaacatggcctgcccctgggcatatgcagagtcagagacatgcgaagggctggggacacgggtctgtggtgcaaagcgaaccttttgtttccagtcatataatactctggaggccatctggccagacttctgcctgtcttgggcacagggttgagcctgggagtttgagcagtcagcccaagcttgtactgcaaggtggctgcaaggccacgacccaaatctagagcctgaccttgacctcatgggttccatggagccgccctgctgatgcctccgagcacctccggagttggagagcctctttcacagattacagacaggttaatcccaaagtccaggaatggaaaatatggttgaacccagttcagaaccctgtgcaggcaggcccgggcatctctgtgaagccaccggaccctttgtaagtgacgctcccactgggaagatgacacctgctagcagagtggcctctgccagctgctgccttcaaggaagccaccctctgggggcacggccgcctggaccccctccccaggcctggaagactcctgccaggagcggatgcattttgactcttcagtgatttctggtgcaaacagcatcagttagcctgttggccaaatgtggccccagcccggtggctgacggacactgtgtctgttgggcaaggcggattggccatttcttatagctctaaatcatctcattcgcctaggctagaaatatctgtgagtccaggatcagtaatcttcggccccttcccctccatcttccagccccagaggctgggaaaccacacttgggcccagggagaacatttttattttcccaacctcctaacttcctgcttagttgatagttttggtgaattgaatccagccttcgtcacgccacctgagcttccctcctcccccagaagtaaattgcactctctgtaatcctgtcttgtctgtgcatctgcagagctggctgaaggcctctgcagtcttccttctgaggtaccagttcctcgagctgctgcaggtctattctggggcgagagggaggctttgaaggtgacctcagggcgaggttgcttggctggtacttacagagcccctgctgtaagcttttgatctgtctgctcgcctcttcgtcatgctgatagtcagtccagagcccagaaatggaagctgaggtctctcatcttcactgcccagactccagccactcccaccccaccaccagtgtgaacagcaaggacaggactcccagcaggaccgcctgggaccatctgggtggaccaggagccttgggcaaaacaatccggctctctgggtgcgcaggcatgtgctgggtgagagccattagcggggacctgttgctgtgtggttgtcaggggcccaggagaggaaagtcagaagcccccagggtcttggaagtcactgccatctctcattcagcaaagggctcctgtcagtgcatttttgcaagactggttgttaccgggagtagcagtaacccaggaatccaccaagcccatccatggctccggtggattggaggaagctccgttctggccagtctccttctggggagcccacccaagtggggaatgacccggcacttgggctagtcctggctcaggcactgggaactgtacctgtagcctggctgctgctcctagacccacccagacctgcccctgcccttcatgcccctcgctcccgtctagtggggctacaccaggcactgtgcccgccttgcagagggccagcccttctcccctcatcaaaagccgcctcctcctccaagggcagctcaaacgccattccctgcagttatcctccagttcttcctggcagtgagctcgccgtctctgaggcttcagagccgccttcctcactcagtctctggcacccggtgcactatagctcaggagatctcctagatgcaatgagacggcaaggctggaatatattccccaaggggcggagctcagtgtttgcgtgcattcctccagtaacatgccctgagctcttggtgagtcagtgtgaggagacaggtgcagcttttcaaggagccacagcaccaggccttcctggtggctctggcactgccctccctccctgcgggagggcccctgggcacagagctctcctgcctcccttagagccacctctttgcagtggcccgagtcacacaggacagatgcgctgtattctttagggtcagcagaatgaccatggaaagcaaacggccatggagaacacttccttggggctcagtacagaaaccactctgtctcctctttctgaaatccagatggcctgcggagaattgcctctcttcagtctcacataccgacttttccaacttttccatccattgtatttcttctaagaaggttaagtaaaccttctatttcattgtggctaacagttgtgtttgaagaaggatgccttacagaataagggttttaatttcagtctcagctgtggcccatgagataaccagggctagagtttgaaagagcagactgcaggatcacctaagcccagtagttcgagaccagcctgggcaacatggtgagacgtcatctctacagaaaatttaaaaattagcctggtgtggtggtgcaggtctgtagtcccagctactcgggaggctgaggcaggaggatcgcttgagcccaggaggtcgaggctgcagtgagctctgatcgcacccctgcactccagcctgggtgacagggtgagatcctgtctcaaaaaaaaagaacagaacagactacctggaacccccttgtgtggtgatgtgagtggatgtgcaagtgtgtgtgtgttatgcacacacaggatttccaccacgcccccacatctctggtggtgctttcatcacgacactgtcgggagccagattgcagttgcatataatactgaccggtgcccactcctagcacaagggactaatttttaaagactaagagtaaaacaactgaaaacctaaaagctgctctgaatgtgattctatagactccacagggaggaaaccgaacatgaaccccatcaacacccccagtttttaggagactgtctgacatgcccagccctaagggatggggtgcagagcaggactggcggcccggcatgggggagctggagaaagagcaaatgagcagcccaggacacctgtgagtgactgttgccggcgtcccaaacactgctttgtcgtcaaaatcatagaaaaggaaaagagcatttagtaaaatcagcaggcactgtagcctcccctacctgttcccctatccagcctcgactgtgcctgtaattctcactccttccttttctgccagctttcagcttcccaaactcatagctccctggtcaggtttggattttattgttttcctggcaagttgagtagtgctgggaactccttgagccggtgaaggggtgcctgctggagaaaggggtcagtggccacagggtgtggacggatggggtggccacgtgccccagggaccctgccgtgccttgctgatcgtctgccgccgcctcgggtacaccgcaccctggagagaccctcatctgtgctggctcactttctgctttgtttctctagctctattactggaggcgctttgaaaagcttttccatctgtagattgtcccgatggaaggcaagcagcgccggggagggagcgggtatccagagaaaacctgggatgcccagttacatctgaattccagaagaatcattttcagattctgatttagctgggtgtcttgtttttttatagctttaaaaaaagcaaaaaaatcaagagagcctcatttgacattgaagtcccgggctctggttcggcggttctggcctggtagctgagcatgctccagccccgtgaaggcggccagccagggccagagtagagaggctggagcagagccggcaccaaggtcccctcatccactggtggtggccagtgaagggtaaagagagaaaaggaaaagccagcagaaaaaaagtccctcccagataatagcccaactccaccgtccatttgagaatttggagctagatgccgggcagtgccatttccccatctctggtctgtggtgggcagcgggagtcctcggacctggggctgcaagcccgcaggatggatacgtgacccttgtaactttctgcaaaattgaagagggctgtggggcattgacaagcacaccgtggggggaacacaggggactcagacgcgcccccacccccagacgacagctctctcagcccctgggtttgctcactggggtccgacacccctgggccaggagcggagctgtgtccaggctggagtagtgtctaagggtgtgggtttgcagggcctctaagacacggatcgcaaagacccagcaaggccactcagttgttcccgttatgcttttccgcgtctgaggggggattatatcccgtcgtgctgttcctgaattgggagcatcacaggggtgtcagaaagtcctcagagagggacagctgctggcagccctgcatggcagtggcctgggggctgcttgagctaatgtggtagcaggcctcattttggaaaacctcctgagtctgccgggtacacacggtgcccctctggcatgtgcgtgtcgcatgctgcatgcgtgagtgttgaacgcgtgagtgttgttcctcgttgctaccacagtgcaagcccccctcactatccaagccattctgtcggagagcctggggagcaaagaacaccgcttcctccacgtttgggttttgcctcgtgagtagcaagagtccaaagaaaaagcgatttctctaaacatccaacccctcctggtgcctgggttcagatagtgaggaccagagagagtttggattgcaaggatgtgttatttaccgggggcagcaaaacaagttactacgcattaggtggttggaaagggcagagccttattctctcacagctctgggggccaaaagtccaaactcaaggtgtcggcagggtcctgctgcctctgagggctccagggaggatccttcctgcctcttccagcttccggtggccgatgacaactcttggcgtttttcacttatggacgcgttactccagtctctgtccctgtcttcatcgggtgttccccctgtgtgtcctgtgtccaaacttccctcttctcataatttccctccactcatcaaattaggaccctcccctaatccagtatgaccttgtcaaaaccaattgcacgtgcaaagaccctgtttccaaataaggtcaggttcacaggcaacagggcttagacttgagcgtgtcttttagggggacacagttcaacccacagcaaaggggctctcgtgcagcaaagctgtggctccgcccagggagcaggatggtgctgcggtgtgggtgcctcacagtgagcccgacaccggaagttctgtgcacatccgtcctctgacgaggcttcgtggcctcgtcttcagccatcttctggtcacagcttagaaggttcctgttccttatccctcatctgagtatcccaagaagagaccagatgctcggaggctcagcacccagatgagtgcagaagtcactgaggctttccagggcatccgcctggagtgggaggacccttctcagtctcagatttgtctcctgcgtggaaacatcctccccaaatgtacttataaacagaaaccgactgaaggaaaaggcaagccttgcgctgggtctcgagtggtgaacagccacatcctaaagtggacaggtcttgaggtctcataaccctgtgtttagattccagcaagacctgaaactccacttccttatctgcctgtgctccctattccatgggagtctaatgtgtgtctaatgagcgcctagccatggcttggtaagaactgcagggtgagagctggatggcaagggtgtattgtttgcctggggcagctgaagcagatcaccggaccgcaagatgataggccaggccagccatcatgcgaggggccatggggattccagcctgaggactgagtccggcacagtggggtggcctggcatggggaggcatcagtgaggggtacagtacggcagccacagcctggatggccaggggagtgagggagggtggggtcagctggtgggtgcttcagagcaggccgcctctcgaggttccaccctgctctgggctcaccacacagcacccagcctcctcgccgtctgtgtctgtccccagcctcctgccccagcctgggggctcatttgaggatttgagctggacaggggtcaaaatgctgatgtccccacacacatgcacatgaaaactgggattctgagagtatctccacagcttggtgctgtgccctgggagctgcctgggttcgtcttgatgaatctgacacctgtcgctggaacccacgactttcttctgtgcagctggctagttaaacaggggtggaggtgagccctgctgcaggccagctgggttgactcccatggtgtggctgagtcggtgtgatgtctttgcagcctccgagggacgaaagcctgaatggccttcttcagggatacaggatctactacagggagctggagtatgaagccgggtcaggcactgaggccaagacgctcaaaaaccctatagctttacatgctgagctcacaggtgagactgtcccctctgtcctggtacagggagggaggttcccaggggacccttggtatctgctcagtgcacatcatggtgggaaacgctgtggaagaggctgagagaagaggcagccctgccctcaggaacagggagcaggcgggtttacccaccaggggcacacagggtgcaggtgtgcggcaggtgggtgcagctgcggaggcagaggggccttgtctaccacagactgtgttaaggggagagcagttgccaggcctccagtgactgcactctaccggcgtcagtggggaagggctttgggacctgagatggaggcagggggccagtaggaacctgttgcaaaacccaagtccagggacaggccccgcctgtctgtaccagacagcctcagcgtggagcccatggtgctcacccccgggctgattttggctctgcctgcactgcgccatgatcgttgctctgacgagggcccagctgccttcaagacagcttctagaaccctggagagggacggctgccctgcccgttcccacccctcctctgttggatggaggttagagggggttcatttcctggcacccaccaaacggtgtcacaaaaatactctttgccccttgacatcctcgtgccggggacagagtgaagaagcagctccagaacacgccgtgtggacggtgccctcccgctttctgccatccctgtggcaccagggctgcctacctcacgcgccaatgccagccgcggggccttccacgcacccagtgcgcggacggcagcagctcctatgctcctatgctcacacagcttgaccccagtacagcgccaggcatgatgttgatgaatgttgaagacgggaaattgcagcactggtgtctgcactgttggcacaccccaaaggtggcccttgctgaccaccagacagttggcatctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggagaaaaggtgtcctgccactcagtgctaagttgtgccaaaaactagcatgtttcactgaatcagagtggtaagcacaccccgcctgtccgggactggggtgccttgttgtttacgaggaggtgcggcagcccccgcaactgggagctggtggaaagcttgggcggtagcggggtctttattgccccgggaggcgcagcgtgggaagtggctggcatcccagtaaggcacctgtctcccttgttcctgccgcacatcacctgcgatggccgtgtccctgcgtgctaaccacctttctgctttgcttaccccaatagcccaaagcagcttcaagacggtgaacagcagctccacatcgacgatgtgtgaactaacacgtaagtgcgctctcagcgggaggcccatgccgcgaggcgcacacactgtgcccagagccagctggtctctcagtgcaagggaaaaccagcctggattaatggctccagttctggaatcgcctctcaaacgctgcgtctccacataccaaaccaccagggagataggaaaagaagcttctagaaacagaggctggggaaatttactaatatctggtcttcaagtttgggacagagaggaaagccagatagaacaagatctctgatctctccaacttccttcttcctttttttttttttaaagaaacactcttttttcttttcttttctttacttttttttttttttagagacagagtctcactctgttgccgaggctggagtgcagtggcacgatcacagctcactgcagccttgaactcctggctcaagtgatccccctgcctcagccccccaagtagctgggactataggctcatgcaaccatgcctggctaattgtgttttgttgttgttttttaagagacgggttcttgctatgttgtacaggccggtcttgaatgcctggactcaaacgatcctcttgtctcagcctcccaagatgctagggctataggcgtgagccactgcacccagcctttctttttttattgtggtaaaatacatataacagaaaatggaccttcttaaccatttttaggtgtacagttcagtggcattaagcacattcacactgttatgcagccgtcaccatcattctccagaactttctcatcttcccaaactgaaactctgtccccattaaatactaattcgttatacccctccccaccagcatccacattcaactttctgtctcgacggatttgacgactctggggacctcatagaaggggaatcatgtagtatttgtctttttgtggctggcttgtttcatgagcttaacgtcttcaaggtccaagcacgtgagagcaggcatcagaatctgagtcaagactgaataatatcccatcgaatgaaagaccacgttttgtttctccactcagcctcccttcaccctttcaataaaccacgttgtttctcctttgattcccagctagggaggagtttcaaaatccaactcaagggctagacgtggagccataatgtgatcgacttcaacacacagaacttggctggtttgggaagtggaccaggcaggagggaggggctggccctccccgagcctatgttgtgttcaggcattctgtaggggtgggagtgatttgcagggcagcacagctccaacatgttgagatactgactccatagcatgggtggaccctgtaagcatctctttgaaggcagccgtccaaggacgggcgcctgagtcacggaagctttgctgggctggtagctggcaggaggcacaatttgcaggcccaagcacaccaccatccacaccagcacacaggtgccaggcacacacatgggacctcggaaaagccaagccacccacagagcagtgttaaccagtgggagaaccttccagaatgttttggcttaaaggtcaattattctcaccctgtcacttagtgcggagctggtgcttggccccctgccctaaggagttctctgtgtacagcagcccacgcccgttctttcccaggacacggccgctaaggtctcagaggcctttggttaccagcgtccttctacattctattttcaatgccacagtcttactctatctgttcataatttcaaggagagattctgaaccaaaaggcaggcccaggttatgttatgtattctaactcaggggtctccaaccactttgacaccaggggtgggttttgtgggagacaatttttccatagaccaggtggtaggggatggttttgggaggattcaagtgcatcccatttattgtgtactttatttccattattagtacatcataatatagaatagagtgaaataattctacaactcaccatcacgtagaatcagtgggagccctgagcttgttttcctgcaactagacggtcccatcttggggggaggggagacagcgacagatcatcaggcattagattctcataagagtgcaaaccctattgggaacagcacgtgcaagagagccaggttgtgcaaggcataaggagcacgcaacctagatccctcgcacgcgcagttcccaatagggtttgcacttctgtgagagtctaagctgatctgacaggaggcagaactcaggcagtaatgcgagggatggggagcaactgtcaataccagtgaagctttgctcactcacccgctactcacctcctgctttgcgacctggttcctaacaggctatggctagtggcccaggggttggggacccctgttctaaatcctttactttagaggagggagctccgtgctgcctcttacctgaacacaggataggatgggtacgtcttttgcttaatggtggtgggtgcttagttaataggagagaaggagggtgccccggtcacagtggatgcaggtatttcacagatttctaacaatcccgcctcctctccttggagggtgctccttgcttcattgtggttcatagggggaactttggagaaagagaaggtggtcctggtggaagctgatccatatttccttcaaccctgcagatttaaagaagtaccggcgctatgaagtaataatgaccgcctataacatcatcggcgagagcccagccagcgcgcccgtggaggtctttgtcggcgaggctggtaagctccgtgcacccccaaccccactgccagagagggccacagtggtggggacagccaggcacgctgcggccaagcccctcaggtgtccagcagcgttctttctccttgaacacattgctgtcggggctgaggtctccacgccactggcagggaaagatgggctcagctgagagctggaatttcctgacagcttcagtgaatggtcaagtcttgcttttgagacctaaagggtttgttcgatacctggggccatcatatttactgtggctttgctctacgaaagtggtattaagtcagtggtgatgtaggtgtgtgggaaatggaacctcgttatctggaggggcagatgtttgtatctgcatgggtccttcagtgggcttcggcagtggcctggtgacagcccattctctaggtctgggagagccatgtgggccattgtctccaccccttttagataagatgtgactgttgggtctgattcaagggaccttgccttctgtggggctcacagtgggaagcaacgtctatttttagatcagatcctgtccctatccctctccgggcccagcgtgccgcaggtaatgagagcaacgccattccttcggccaaggagaccacagaacctcaccctcctcgctggctggtgactttaaagagttccctgacttcacatagagcctgatgtttctgctcttttccgctggtgcagatttagaagggtgttgtttcaggcccggaataattagagtgtccctgaggacagaggctcggcctagcaggagctgctgcatagtggggagggtgagatgggggggcaggggcggctcggactgcgggggccagaggagggaaacacatcaggtgaccttttgcaattgggaagggttattgttatgaaccaatcaatagcaccaagggtcaagcccagcggattttttccggaatggtcaagcggtatttgcatacaaatgaggatgcgtggagagaggcatcaagagcatacggtatttctgcctctctttgcacgaaaatatgttcaaaggggtcactcagagccaccgaggtacggctcagctttccctcagggatggacctggctgtagaggagcccattgagggccatggtggggccaccaagggtgctgtcagagaggggtgccagggtgccgtcagtaaagggtgggtgccactgcggacggcggccatggcagattctgtgctctccagttgtattcgggtgactgggccccagttggcccccatggctgggggtgggtcagcctgtggcatcgggggagcacaggaaaggagggccgggaactacagtgtctgaactgcaagcagaaggtgtgggtgtcagagctctgcctgagggtctgcctgcgcctgggcataggacaccaggaaccagggggctcagggcacttgggcaggccctgagaccgaggcagacgtccagagaaaagagcttcagcaagcggtagggaagccaggggtggtgcgggaaactggggagtcgcgccagggccagccaagcggcaacaggactggatgcccagcaaacagctccagctctatgcccagcgcccagctccagctctatgcccagcgcccggctccagctctatgcccagcgcccagctccagctctatgcccagtgcccggctccagctctatgcccagtacccggctctagctctatgccctgtgcctggctccagctctatgcccagtgcccggctccagctctatgcccagcacccggctccagctctatgcccagcgcctggctccagctctatgcccagcgcctggctccagctctatgcccagcgcccagctccagctctatgcccagcacccggctccagctctatgccctgtgcctggctccagctctatgcccagtgcctggctccagctctatgtccagcacccggctccagctctatgcccagcgcccagctccagttctagggtctgcgctgttggtgtcttagttccttctcacactgctgtaaagggacggggtaatttataagaaaagacgtttacttggctcacaattctgcaggctgcgcaggaagcatggtggtctctgcttctggggcggcctcaggaagcttccaatcatggtggaaggcgaagggggagcaggcatcccacacggcacaaacaggagcaagagagcgcaagagggaggtgccacacatttaatgaccagatctcatgagaactaagccattcatgagaaacccacccccacatccccatcccctcccgccaggccccacctgcacgttggggattatagctcaacatgagacttgggcagggacacatccaggccatataagtctgtcatcgtggtaagatgcgtataacatggaaagcattctccgtgtgcagttcagcggcattcaggatggtgagcagccatcaccaacatccatcgctggagctgtctcttcttcccaaacagaaatcccatacctatgaagcaggcccccttttccctcttttcccatcctgggcagcctctcacttactctctgtcactgcaagttcacctctcgatacttggtacaaatggagtcgtgcagtgcttgtcttcctgtgtccagatccttgccctcggcgtgaggtttttgaggttcaaccgggttgtagcagatgtcggaattgccttccttttcatggctgagtaatatcccattgcatgcatttaccgcatctggtgtgtctgctcctccagggatggacactcgggggccttcccccttttagacttgtgagtgtgctgctgtgagtgtgggagagcgaagagcttttcagcagtgcagagctgagacagcccaggtgtggggaggcagttgcagaggctacaggtgagcccggcctctgaggttagcatcacggtgtgatgtggcttctcccttccccactgggcccccatctccctcccctcccaacatgtgcatccctgctccagccctcctttccagaggcctgccctcctgccccactcctcctcaacacacccacaccctccacgtgactcacctctgcccagaggcctgggctctgccacctgcaccctttgcagtcccacagaagggaaaggaaagcctacttgctgtgcccatgccaccaaggccttttccatgcacacacacaaactccacgtggccacactgcactgctcacagagctcgaaggcgggtgctgagagtcagcagagccggttcccacagcatcacacccacccagagtgccctgtgcagcccctccagtttaacttggctgaggcctgaagcaccctttatgcatcttttttttctttttttgagacagcgtcttgctctgtcacccaggctggagtgcaatggcatgatctcagctcactgcaatctccatctcccaggttcaagcaattctcctgcctcagcctcctgagtagctgggattacaggcgcccgccaccacgcccagctaattttttgtacttttagtagagacggggtttcaccgtgttagccaggatggtctcaatctcctgacctcacagtctgctcaccttggcctcccaaagtgccatttaggcttttatcccctgaggagcggctgccactgccccaggacaccctctctgtccccctccctctaggcggggctcagatttcccctctgtgcggtatcctgggtgctttgtgcacagctctgccttccccccagcagcggggctgccttctctctaatgctgctcctccccattagaccaaggctgcttcatcccaaacagctccttgccccaggggtattgccagaggggatcagaatacctttgtcattcgggcaaattgaggttcccaaacttccacagggcaggagagcagctggggaaaccctgcacccagggacgtgtcctggagacagggcctcccagatatgctgagatgaaggcaggtggaatcagtgtctcatagcagggctgcagggaaggctaatcagaagctcctcatcctgagggagaggagggagaaggaacctatggtctctgtccctgtaacagcagataacacagtcaccatctgccgcccaggcactcatgttctaagctggtctttccatggggctccttcctgaggctcctggcagtagggagggagaggcagagctggtgagggtgcacaggctggcagaggctgtgaggccactttagggccctggcagatggggagcagtgccaggagccggggttcacacaagggaatgtaaccgcccagcaggctcctcctgcctgcagcacagacaaaaccagttcactgagcccatggtattgcagtcaaaacagagtttaattagagcccagccacatgggggaactggagttatcactggtcagtctccctgagggctcagaggttagttttttccaggatagtttggtgggcgtgggggctagggagtgggtgctgctgattggctggggatgccatcacggggcgtggaaaacggtcctcatgtgctgagtccacctctgagcggggccacaggaccccctaagccgtgagtcgtgagtcatgagtccagatggggtcagtccattttcagaatgcaaaagtctgaaaagcatctcaaaagatcaattgtagtttctataatagtgatgttatctttagaagcaactgggaaagtcactaattttgtgacctctggtcacatgcctcctgagcagtgagggattacttacccagcttacaggctgggtgcggtggttcatgcctgtcatcccagcactttgggaggctgaggtgggtggatcgcgaagtcaggagttcaagaccagcctggccaacatggtgaaaccccatctctactaaaaatacaaaaaattagctgggcatggtggtgcatgcctgtaaccccagctactcgggaggcggaggcaggagaatcgcttgaaccggaacccgggaggcagaggttgcagtaagccaaaatcgcaccactgcactccagcctgggctacagagcaagactccgtctcaaaaaaaaaaaaaaaaaaagaaagtatgcttatattttagccgagttcaggcttctcccatactcctaatctctcagccttttattagctttacaaaggcagtttccacccccaaacgaggagggggattggctttagggaaggaccattatcagccttgctctaagttaaactaaaaagtaaattcctagacacggcccctgcatccaggtctctgctccaccccacccatcagatgtggcttggctcttgcacacccaaaacaactcacacatctcctgtgccaggcctggcagtgccaaccctgcaagtggacatctcagttgtttggcctcagcacactcctccgggttctgtgtttacactgcagagagttttctggaaggagaaagccagttcgccattccctttctagcctctgcttctcgcagcccaagtacctgcattgtaacaaccctaatctgctgaggagaggcactgctaacgtattgacttagagcaagtaggccttcagaagaggaaattaaattgggccagcttccgtcccctcggctggaagcttcagagcaccacaaactcgtgggcccgaaatgctcaaaggcttttatgaaaactaagactttgctgtggtcccataggtaagcgtgcaggtccaagcgtcggctctactgtttactgcctgtgtgaccacgggcaagtcacttaacccctctgagtctggccttgagaccttgtgctgctgtggggagacctgtgagtgaggagactcaggtactggcttcattgctgccactaaggcaccagtcctgctcataagatgagtgtccagaatgtacctggcccggggtcagcccccagtcagtatttggtgaatgagggggaccctgggtgagtgagtcggtttgtctggcctcatctgtaaaatgatgaaatgttcagaatagatgatctctgggtcccctgaagttcaaatacgtgatacttaaatctgtttaaactcagagaggaaggataatttttagatttttagctgagattgatgcacaagcccaggcactacaaattggtaaaaataatccatcggtaaggactccagtgtgcaggaggtaggacccaacgccaacaagcttaagctgaaagaatcattattaactcctgcactggaagagttgcagagcctgggacagcttcaggcatggctggatccagcgccccagcaagctgctccatgtggcctcttggatccactttcctcctagttggctccttccttggtcaggctcttcatcaaggtggccatacagccctgggcacagagagcttcccttttctgcagtggaagtccactggctgtcttcagcctgcctttagttgcatatctgtccccaaactagttgctgcagccaacgtcctgaggtgcccaaagccagggagatgtcatctctacctggaccacctgggccaactgtgaagcgagagggtccctagaggagatccagtgcgacagtcagaagaaggggactcgggcattcaccaccacagctgtcctgcagtgctgataggcagagtttgactaggtggccagaaatttttctggtggaggtatggacagtgtctatgggttcctcagcaggagagctcttcagatgacccagccagagttctgggcccagctccacattccacagcgttccgggcactgtgggaccacgctccagccttcaagacactcactattcatggatgggccctggtctcaggttaagcctgcactcctgcccagaccccaagcaggcatctcagcccctgcctgtatttccagagcccccaggcttccccctccttgagtatgtgccccctcatccataccaagctgtttccgcctgggatgactgctccctactcccgtccctgggaggacagacagtcctccctcccatgcagccctgcatccacgcgagcccttggatggggcagctgtcttctctttcccgggcaggattagctgtttcttcctctgctccagaacatgccacgtacacagctctttgcatatccacctgaggacaggtctttttctctctgagttccatgagggcagggacccctcttatccccagaacgttagcataaggccagaacatagaaaacattctgaagatgttagaggaagggtgggagggagagaaacacatttagacaggaaggaaggaaagaagggagggagggagggaggaggggaggggaggggagtaacaaacatagcccaggccaccggcccagaagcacaagtgactgagtgacccctgagctctaaggggggatggagcggctccagggcccagggagctcagggagggcctaaagcaaggcttcctgtccagaggtgcccggcccagctctcctgtttgctctgcaactactgtcctttcccaggagctctaaaacagttaaagctttaaaacaaaacgaaacaaaatagcaaagctggcctcacacaccaaacaaagcttgtggttttctgttcatttatgaatccacgctgaccgaaaactgattcagccccagatgtgtcgtggggacactaggggcagtcaagttctacccactttgccctgggggtcctggcacagacaagcatggccgccagcccagctcccaggaactgcaagagcaggacctcctctcctggagcagggccctccgacacccaccccggctgctgggacccctcgtgcacctttgttatccccagggtcgctctttagccagagttagtggcagctgccccaggacagagcctccaaataaaaagaggtgctgtgtccccacataggccgcctccttggagcctgtggcctcgtggttccctcgacccttagctcgtccccggagccggctcgccttccccacctgctgagccctgccactgatggtttaggtcactcggcggtcctgggggcttctggggcctacagctgggaagctgggttggggtgaatcaggaggaagggctgccgtcaatgagtagagccccccgctgctccagcttcctagggagagaccagaagcccccagcccacctcactaagccctcaaatgctgtgagcatgcctgctgtctgtccagtgagtctaggaggtgccttggaatctcctgggcccgtatagacagtgcgggtacaggcatggcccttctttggggaggaaggcgcccctcctagcctcctcctccacgggccttctccagttcttgccctgtgctttggggtctagtagtggccagacctgggattgccacccctggcatctgtagcctccttctgggggctgcaagtagtaggggctccagcatgtctacctaggaggggctcaagagccacactgtggttcggagtggggcttgggacccatcttgactgtgtttgcagtgtgggttgtgtgcatgttgggtgtgttatgtctgtgtgagggactgtgagagaggacaggtgggcttgctgctacatgaggcacgggggccaagtccagggatgaggcagggggcacctgagggagtggggagggctgggtcccatgtgggggtaaacctccatagttaacccacggcattattaccattattttccatcatccaatacatttgcacaagactatgggtccagcaccttgctattagaaatgaagctactctgaacactgttacaaatcttttccaacgtctccaatgcctgccttgggataaaacgctagaagcagaacttctggtccaatgacatgaacatttttcacctttgaaatacttcagctaattgacaccctgcagcggtgaccagatacagggctcaggttgcattcctctttcctcctgcttttaaatctttcctagtttattaggcaagaaggtatctcattattattttcctagatgggcttttaaatgactggtctgtgattaaatgcctgcagagctcatggctattttttgcatgggggtctgttacaaggtaaactgagacacaaaatgttagaagagtttattcgagcagacagcaattcatgaatcaggcagcaccagtccaaaggtggtttggggttctgggaagggaacacaaggggaacgtttttatggtgtgaatgtgggagctggacaaagaaaatacttgataagagtatgttgttgccttcttcagtctcaactgttagaaaattcctagttgtattggttttcatgctgctgataaagacatagccaagactgggtaatttataaagaaaaagaggttgaacggactcccagttccacgtggctggggaaggtgaaaggcacgtcttaaatggtggcaggcaagagagaatgagagccaaccccttataaaatcatcagctcttgtgagacgtattcactaccatgagaacagcatggggaaaaccactcccatgattcaattctctctcgctgggcctcttccgcaacatgtgagaattatgggagctacaattcaaggtgagatttgggtgggggcacagcccaaccatatcactagctgtatatctgcctttagttgcatatctgtcctcaagctagttgctacagccaacgtcctgaggtgccctcagtaagttgttggcggcttctgattggttgggcttaagttttatttttctttaatatgggcatttacaagaaatagcccaggttaagttttgtttaggtttgcagaaccagcaaggtcaaggttgtctccacggcttaatgggctttgctcaggggattctcaagcctggtctccattttattttaatgggtcttagtgttttgtgttgatttcttagagcttcttatatattagggatatcatgtttgatcatgtctatggcaaatactttgtctttaattttattgtgtttaagtggttgtgtgctcaaacctccatatctgaggcatctctccttcccattttgagaccaagtaaatattcacccagatattttttcataattttcatggttttatgttttccattaaactctttcatcaaaaaaaaaaagaaagaaagaaaaaaaaaactctttcatcctcctggaattaattctggagcctggcatgaagtgagcttctaaatggatcatttgtttccagagaagttttttcccccgaaaccatctattgatttttaattgctttgtggtgcgtcttaatcatggtttaaattcttacacacagtcaagtctgtctgaagacattccttcgttccacagacatctttactgttgccctagtacttctaaagctttcatttacatcagtttgttacacatttttttcatgtttaggagggcttgtcttattcctctttgttttctaaaatttctcagccattctatgaattttacaatcattttggcaagttcttaaaaaaaagcaaatgctcctgggattttgatggaaacgtattaaatagtaaagggatttggaaatcctcgccgtcttcctccttttcgtctattcatgcttgctcccgggagctggctgtccctctggcacggtgctgctgggctggcagcgctcctggtgcaggtcctgctgttgcttgtcaagtcattcctggcagttttattgcggcggttgctgtgagcctgggtattgtaatggctcgtccctgctctgcccaccgccaatcgcagctcaaggctgaggctcacatggttactcaggcatgttaaatattagtccagcaaaaagagcaacataggttttccccaaaaagcgagccaggacttgccttttttccacacccaatggggagtggctgcccagctcagatgagagccgagtgtccagcactgtggcctttagccccgcaactttcaccaaaaacagaagacagacagatacccatgctcagcatttaaaatcactcggccggccaggcatggtggctcatgcctgtaatcctagcactttgagaggccaaggcgggtggattacttgaggtcaggagttcgaaaccagcctggtgaaaccccatctctactaaaaatacaaaaattagctggatatcgcttgaacccaggaagcagaggttgtagtgagccgagattgtgccactgcactgcagccatggcaattgagtgagactccgtctcaaaaaataaataaaataaaatcagttggtggctttaggtggtgtttggttgttcctggtgtacatgtggctgtggaagacagaaaagtgtcttgaaaatatctgtttgctgtttttaagaatgaaaaaattgtcgtacaatatgggtcccacctttcttctaagtgctccaagtttttaattacagttggttggaatgagagaaaaaaaaaagcacagcttctagctgtttcagctcccgctagtgacaaataaagccagtcctagtgcctattaagtgaaattaaaaggcttcagtgacgccagtttgaaaacatgtgtttgtagggaagagtgaatggcacctgtttacagggtaattaacgtcgcaaccccgactccacaggctgcactgtctcatcatcgacgttcccagggctccctgggtaattattaacatatcacgcgataatgacattgtgcaaaccacaggccgcccctgtcatttctgcggccacagtctctccaactgatgccggtgggctgtgctgcgtacagggctgtctacacggtcctggatgatggataaacatctgccgaaagcctactgtgctggtcacagatggtcaccatcccctgggtgggaaccgttgctccgtttcacagatgagagtgatgagtcagctttatccggagtccgcagggggctccccgggcgctatcccaccctctgggctccagctcgtgttgtttcagacgttcccttcaggcacaaatgcactaagaagccctcgccaaggagtgcagagtggagagactgtgggatgcaggtgcctccgccgtgggggattctccaatgcgctgcacccggcccacagcaggctgtgcacaggcactgctgactgactgggagcttggcccaccccttccccatgccagggagtatttcagaattcacggcttccttcaggctctctgcagcatacgctatcccgggacagcctcttgccaaagggcgggtgataggagcagcttctcagagagctcccaggatggagctgtggtgcccctaggcagacacagcccccgagggaggatgggcttgacaccagcctcatcaatgctgggccggagggtggagggcggggaggctccttgcccacaggtgcgagcctagccaggcttctctgggcgggggctctcagggaagcctctggggcctgtgtccacccatcctctacacttctgctggggtgacccttgtgaaatgcaaatcccatcccctcactttctgtttccacccttcaggggatccctgttatgtatgcgggaaaaatcaagctcactcctgagactggccccagggactctgaggtcctgccaggccaaccccgcggcggtcacagtgggtgtcctcatggcccccaggccctcccccgccgcagtcacggtgggtgtcctcctggcccccaggccctcccccgccgcggtcacatgggtgtcctcctggcccccaggccagggttccctttcgtgctcaggcttcacacgcacagcccggcagatgcccaggagaccttggtggcgggctggtagtattactcatctgacgtccatcactgtagacaaaggttgtggagcatcgcgcggtgcccgctgctgcatttggaaaggctccctcacctctcaccatcctgagtttcactccttagccagcttctctgggatccctccaggtcgccacgctggcagccagtggaggcctttcttcagcacccacttgctcagcaacttgctggcaccgaagggagcgagagagccctgaggtacgggcctgcccttcagctgctcccccgaagcgtgagccagcccttcagctgctccgccagggagagggaggatcaccggcctgggcctttgcgaccttctctggggttgagtctgcaagggttagggtctcctgtgagtggcagagctcagggtggacagggggctgcaggtgggctctgcaccataggagaagctgggctatccccacagaggagggaagcgccatctccacaggtgtggccgggcagaccacccctcccagggccgcgcgtcacgcacaaaagtggggttcacatccaacccactgttgagagtgcaccagaacagcagatttgaaagggctttgacggcagtttccgaccccacccccaggcctctctcaaaccctcgccctgctcctcctctccagccacactctcttccgagagaactcttcccctctttgcctgtttctctgttgtttaacttctagatagggaaatctcaagcatacacagaaggagacagacaagtgcaggcgcatcacactcctcacagttggccttagtgtgcttcgtagatactgtgtcagttacagatggaaggtttggggcagccctgctgtcagtgccattttcccaacagcacgtgctcactttgcgtctctgtgacagcatcttttttgcagcagattttttgtttgtttctttgtttattgagacggagtctcactctgtcgcccaggctggatagcagtggcactatcttggctcactgcaagctccgcctcccgggttcacaccattctcctgcctcagcctcccaagtagctgggactacaggtgcccgccaccacgcccagctaattccttgtatttttagtagagacagggtttcactgtgttagccaggatggtctcgatctcctgaactcgtgatccacccgcctcggcctcctgaagtgctgggattacaggtgtgagccaccgtgcccagccagtaaagtatattctaattgaagtatgttccgtgttttttcagagaatgctttgcacattgaacagattatggtatcgtagaagcatagcttttatatgcactgggaagtcaaaacatgtacgtgactccctttttcaatgatctggaaccaaacccacaatatctccaagacccgcccgtgtcgagaacactcctgcactcgccaccagctcaaccacaaggcagcacggccagtctggcttcatccaaacatccacctcctcccctcccgtgtgatcctcaagcagctctcagacatcatatatagaggtttacaacatcatatcattttattcacaaatacttttaccatatatccctataataactctttaacatatgtattaggattctctagagggacagaaccaataggctatatataaatatataatatataaaaatatataatatagattatataagatacaaaaatatataatatatattataatatataatatataaaatacaaatgtatatataatataaatatattaaaatatatataatatataaatatattaatatatttatataatatatattaaaatatttatatattgtataaatatattaatatatttatatattaatatatatattgtatattaattgtataaatatacaatatattgtaattaattgtattaattacatataaaatacatataaaattacatataaaaatattaatatatttatacaatatataaatatattaatttatataatatatttatatatattaaaatatttatatatatatatatatatatatataaaggggagtttattaaatattaagttacatgagcacaaggaccaacaataggctgggatattgccactactggggatgaggaagctgttccttctggcaaaaaaggttcattagagtttacaagctcagtgtccccagcttcatcaaggtcctcccacacatccccattccaagttgcagagtcccattctttttcggtccatgccctcactttaatagtagacacctggcaaggctgtgcatgcaccttaacttgcaggtcagccactcacatggtaagagcttgtgtctgtttttccacaatttcagctcttcctctacaggagtgaagactctcactcaaggcaatcttagcagacttgagactcagtatctgcttctgaagctgggagacagaatccctgagttcatcattttctttcatcactttgtgcattgaacttaggagcaaccaaccagcttcattatgtttcttggttctccacacatggtcagaggtattatgtatagagtccctaaactccttgcctctcacgagcggtgaatcaggagcgtcaaatgcatttattttgcataactctctaaacaattcacgccaaggactatcagcattctccatactactagaagtagagtccttagcatttttggatctaatcatattaagcagccaactccggaaaccgcaaaaccaacagaagaactccatcctgaatattctgtctctctagaaccactcctggtaccaaaatctgtattagtcagggttccctagagggacagaactaataggagagagagcgagagagatatatatatgtatacacgtatgtgtatacatgtatagatatatgtatgcacgtatgtgtatacatgtatagatatatgtatgcacgtatgtgtatacatgtatacatatatgtatgcacgtatgtgtatacatgtatagatatatgtatgcacgtatgtgtatacatgtatgtgtatacatgtatacatatatgtatgcacatatgtgtatacatgtatacgtatatacatatatgtatacatgtatatatgtgtgtgtgtatatatatactcccatatatatgggagtttattaagtattaacttacaggatcataaggtcccacaataggctatctgcaagctcgaggagcaagcaaggagatccagtccgagcctcaaaactgaacaacttggagtctgatattcaaaggcaggaagcttccagtatgggagaaggatgtaggctgggaggctaggccagtctcactcatttcacgttttttctgcctgctttatattaagtggcagctgatgagatggtgcacaccacattaagggtgggtctgcttttcccagcccactgagtcaaatgttaatctcttttggcaacaccctcacagacacgcccaggattaatactttgaatccttcaatccaatcaagttgacactcagtattaaccatcacaatgtataactacaaagtcattcttacacctaagaaaattataataattgcttagtgtaatcggttagctagtcagcatttgaattcccctggaattttctgctctgacagcccacagttctatccttctagacttgtcagccctaacccatgccactgaaaccatgatgcaaatcaatgagctgctttagaaaaaaaaatttgtatttttaattgacatataataatcgtatacatttatggagcacaaagtaatgtttaccatgtggaatgattaaatcaggctaattagcatctgcatcacatcacattctatcatatttttgtggtgaaaacatttaaaacctactcttctagcaactctgaaatggtgcaccgtgatttcttatagtcacgcgatgcgctgcttgttgcagagtccagtgggtgctcgcgtccccggtcttgccctggcctttgatttgaggccgactccttgcctggtttccagaacactctgccctggctgctgcagctccgcttctctctggggtttcttggggctcagcttttccccgtccctcccccacgtcactctccatcctcagctgcctctggagccacagctcccaaatgagtcccctcccgcctgggagtctcttggggaacccaggcctgcaattcccactgtctgcctggcatctctgccgggcgcacccacaagttccttgacccaacttgtccaaaattgagtttctgtgtagtagccaagagcaagcacttagaagccagaatgcccaggtctggctcctggctctgtccccataaccctgggtaaattactccacctccctggggctcaatctccttgcctgcagggctgcagagaggaccagatccgcagagggccctggaagcagtgccgcaggagctctgcctggggatgaagccgtcgctgctcctccccagcctctcggcagcagcagccacggtggcaacaagcctgctaacatgtgcccttgggagggtgcctccacccaccccaaaatccatgacagaaaccccagcctcagcccaagtctctccaccacacccacgcattacatattgtcagaggctgcttttgccctaggaaagcagagttgaatagttacagtgaagcccttcagtccctcaaagcttaccacccttcatgtctggacttttactggaagtatcgttatgtccaagcctagagaagcagcgtggaccttagagcaaggcagattcaggtttgaatctagctcattatgggggatgtgacttaacccctcaaggcctcggcttgcttggtcccctggtcactgcaactggtggattccaggcccttgccaacaggtccgcctctgtcactcttcttcctgttgcagccccgccctcgctcagaccaccctctgcagcctgtgaccttgcaggagctcctccgggctgggtccccacaccctgtgcactccctagctacagccaaagccatctctctcatgtacagctttgactgtctcactctctgctttcaaaccttcccagagaaacctctgatctctaaagccattcagtcccctggacgtgcggtgccgtctctcccgggcctttgaacacacagcctcttccacctcagctgctggcccctccctgccccttgctctccacgccgtaactctcctctccactgttcaagtctctgcctggatgcacctggccaggggagccctcctaggcccaggcactgcccggggagccctgctgctcacccccacagtgctctgggctcattcccagcacagagcccaccctgagggctggaattgcctgctgacctgcccgtggcctgctctagaccatgcaccacgtgaggacaagtggctgatgccatcccaggcacacagatcctacctcatgagccagtgcttctcacggtacctagtggagaagcattcggagaggatttatctgatggatgttgactcttggctaacaagggctgcctctctccatcccctgactttttaggacaagaccagagatgctaaggccatagctaggaaagtcaggccctggaatgagaccgtctaggcttgaactccagccttgcttcctgttggagcatgctatttaacttttcatcttattaaacagaaataatgggagtggcctccaacgatctgctgtgcaatccacacgggcaaacatgaaacctcctctcccacctggggttagagcagcgaggagacccaggctggccaggacagagactggtggtactttgcccttgttaagagttcttggggccaggcatggtggctcatgcctgccatcccagcactttgggaggccgaggtgggaggattgcttgggctcaggatttgagaccagcctgagcaatgtagcaagacctcatctctgaaaaaaaaaagaaaaagaaaagaaagaaagaaagaaacaattagatgggtatagtgatgtatgcctttagttccagctacttgggaggctgaggtgggaggatcgcttgagcccagaaggttgaggctgcagtgagctgtgatggtgccactgcactccagtctgggaaacagagcaagaccccatctcagaaaaaaaaagttatttgaaaacattcttccacaaggagaaaaagaatggatgcttcgcggtcaaggcctaatagccagccgggctgggctcgtgtgaggctgtaaaaccccatccgcagcttctgtgatggtgtacaggggagcggaatgcctggtgctggcgtcaggctcactgtcctgcagctctttgctggcctggcctgttctccaccctcgtttgctcctgggtcttgtaaacagtgttcctttgaccttcccctcgaggaccagagatcacttgctgtctggcgcaggcgctcctgaccttcagatgtgggaggactgtaagaatctcagggagacccccacccactgcttgcggtggtctcctttgtcatagacgacagatgcttgccacacgcaagcagaggcagggcttaaaggttactctcatttctcaggtgagaaaaagcaaagtgcagatggtttcggagggtcctccaggaatgctcagctcatccgtgggaccaggacgcacaggcctgcccactgcatctaaggcagcgaggccctgtggaatcaaatcagcactgagacagagggctgcaggacgtggtcactgagggcgtgaagccagcctgtgccctcctggcctcacttgccccgtagggcctctcatgtcacgtcacctgcctctgtggaaatgtcctgtagctcctgtttcctgcagggtgtcacagaagcgccaccttctgctagcggcccaaacccatcacacacccccctcatttgcccctcacagagtggtcagaacctactgccagttcccactgcacccctgacagctgtagggttaaaggatggggacaaagtcacaagggtgttggctgggacacctgggccaggtgccttgaattctgccccagggctctttgcacttgacgcaccagctcccagtcaaggcctctgctctcattgcagccctcctgcacttccttcctctgcctcggagcaggatctgcaaacagctcagcggccaagcctagcccattacctgttcttgtaaataaagttttattggaacaccgccacacccgtgcatgttgttggaggctgcttttgccatagaaggtggagttgaatagttgcaacaaagcccttacatccctcaaagcttaacatccttactatctgggcctttacctaaagttgtgcgactcccaccttagagaagcagcttggaccttagggttaggcagatccaagttcatatcgagctcattctgaggcctctgacttaacccctcgaagcctcagctttctttttctttcttttttctttgcttttttttttttttcctttgagacagagtcttgctttgtcgcccaggctggagtgcagtggcgtgatctcggctcactgcaacctccgcctccctggttcctgccattctcctgcctcagcctccagagtagctgaaattacaggcacgcaccaccacgcctggctaatttttgtgtttttagtagagacgggggtttcaccatgttggccaggcttgtcttgacctcctgacttcaggtgatccaccctcctcggcctcccaaagtgctgggattacaggtgtgagccagcgtacccggcctcagttttctaaaaggagaatacagtctttctccaacaggttgaattttgtgtgtacaaactgcatataatgcagttaatgagttaggggctgtggattgcaccatggaggaacaccaccgcttgtgatgctgtcatgatctgtgaggacccggatcttcctgtgatggggactcactgtacgggccaggaagcacacacagtccgcaagccgcagagccggttggctcaagcgtcttttaactttgtttatcataacagtgggtgatgatggctattgagctgataagaaggtggaagcactatttcctgatgatgggaagcaaagatcattactggacgaaatcaaacgccagaattgtctagcagtattgaagtttcagagctaacctttaaaatggaaatatctgtaggacaaatatgtttgttatcgtgagtctgaagctctctggcctcatcctccttttcctatggaaacaactgcttttaaaacagtctttaaagctactcggtttgttagaattgcagctgccatgtcacagcagagcagactaaggccatcccctggggctatggaaggagagtgtcccctgtcccagctgccacacctgtgctgctctcagcccctcacctggagtgctctgcctttctctccacacatccctgtgctcagtcagaacttagagcacacagcaactcctcctcttctgtgttcttgaggcacctgtactcagcgaaccactcaaattaacccatgcacagttctagaattctgtcatcctcactgacacacctgccaataaaaaccccatctctactaaaaatacaaaaattagccgggtgtggtggcgggcacctgtaatcccagctactcaggaggctgaggcaggagaatagcttgaacccaggaggcagaggttgcagtgagccgagactgtgccattgcacttcagcctctgtgacagagtgatactccatccccccaccccacaaaaaaaggccaggagcatctcttagatttcctctgcgtacctgtagtgccccacccagagccaggtctgggtgtgtgtaaagacatgtggaccctgacaatggattatcacctgtacacccacaccatgaaatccaacattcatggcaagggctgcaccaaactccaggcggtcttggagacttcaaaatgtgcagaggcttggctgaggccggcaccttcctagaggagctggagctacagctgggatgtatcagtcagctgttaccacatagcaaatgatcccagtatagcaacctaaaacaacacacatctcctaccttggtttctgtgggccagaaatctgggaataacttaggtaggtcctctgcctcagggtctctgggacagtgtcaaccaggcctgtggtcttctctgaaagttcgaccggggaaggatgcatttccaagctcacccatgcagttgctagtgggattccattgttcgtggacttttggacttgagttccttgccatgaagggcctctccatggggcctctcacaacatggcagctggcttccttagcatgggctggccagaccacaagagcaggtgagcaggagagatggcacaggctcttgttgctgagtcacagcagtgccacattctagtccttagaagcaagccatgtattcagcccacattcaagggaaggagattctcagggcataagtaacaggaagtggatctgcaaacagctcaggggccaaatccagcccattacctgttcttgtaaataaagttttattggaacattgccatgcccatgcattacagattgttggaggctgcttttaccataggaaggcagagttgagtagttacaataaagtccttacgtccctcagctcatgtagggacctgaagctcctggtgggcagggcagatggcactcagacatctggggtgcactgggcaccatgtcctttgttcctagggctatgcacttgcccagacacggggctctgcatttcctgggttgcttgctcaggctctgctgctggctttcttgcacttctgccttgagtcattgctgtctatctccaactctcacttgtccccacctgagtagaagcagggtgatccctttaaacctcctgattcattgagaaggcctcccgagctgcagagtcacccagaatggagcctgtctccaggtccccctgctcaggggagcagattgcgagcaagatttgccaagaaggtaaatgagatcagagaattctatttcccatagttccttaggaaatcagaaagagaatctcaccagtttgctttgatgtcattaaagcaaactgaggaatatacaatttttaaaaaatcatataaagaaaattatttcattatattaaaacattaacattgattctcaaattatccattaaaaccttgctttacccaaacagtcagtcaatgggctacagaaactgaaagtagaaatctggcatggtctatcctggtccagtactgctctagccacagcagatgcctggcatggcacagggaggctccggtgacaggaggcgcctggcgtggcacagcgtggctctagtgacagcagacacccagcatggcacagggtggctttggcaacaacagatgactggcatggcacagggtggctttggcaacaacagattactggcatggcacagggaggctttggcaacagcagacacccagcatggcatggggtggctttggcaacagctgacgcctagcatggcacagggtggttctggcaagagtggacacctggcacggcacagagtggctctagcagtaggatgaccacctgtctggtgtgaacctaacatgcaccccgtgttcccacccttctactctttctccttccatctctatagtcagcagtgcccttgctccctggcccactgtcacgtctcaaatcttccctgttatttaaggaccagccagatgttctactttccaggaaacatccacatccctagctggacatgctctctgggccccgaccctgtccccacactccgcctggcaccgtgattattgtgatgcgtgtctctctctgatgaaacttgtctttcacatctggtgtccacctgtccctcagcccaaggcctagaccctggttaatattcaggaggattttggcagcgttaggctgggataacaaacaacctccaagggctggtcccaccagtagtgctggtccctcccgctgccgccctccgagtgccagcatcttctcttctgctacctgccattttcatcccaagactctggttgggggagcagcccccgtgtgactggccagcctcagggctgctagaagagaaggttccaggccatgtgactctccagaaagtgagttgtttggtcacgtggggccagaggggaaaatgtgcagtcctccctcagttggagcgaccgccagtcacagggccatgtcgctgtccccagatcaaatggatgaccttccgcctggcggacggtgaatgttttgaatgagtgggcggaggctgaatgaatgagcatcattctccctgcagagttaattcctacagctctgaaacttttccctcactctctgaagcctccactcctccaccaaatgccacgtagaaccgttttgttttgtttttttctcctgagatttgagtcacaccggtgcctgtccagctgcctcaacttgcagcagaggttcctaaaccctgaggtgagggggctgcagcccaggcctgccatgcagggctcaggttcaccttgggtctggtgggacatggagttagaaccatgagctgctggtgctctccacccaccagcaaattaagactaagtcagggcagccactgtgtcccagcggctgcttttgatccagctgaagctcgctggccacttagggacggcgagcacagggaggttgggcgaggcgacagaatgccgtccttgctgccgtttggggcttggctgcagcctccagcccaccccttcccgcagaggcaggaggccacgccataacccggctcaggccccagcgcccagccacgcaaggccatccaagcaaccagccagaattccagaacatttcagaaatgtcaggaattccacgatggctgtcaggtgagggtccctccagaagtcctgaaagcttgtctctcattgcctcagcaagatccctctcccaggccgcagaggccccctggcgagggtacaggacccatcacaccaaggacctgagtcactcagctctgcgatggcatcgtagccttagcgtgagaccccagagaaaaccccagctttgcacctttccctttaaatgccagttgcaggcaatctccctagcagcagacgccagcaattgccggtctaaaatgctttttaaaaataatttcatgtattttttttttaaaaaaaaaaagcttccaagctggtatgtatgtcatccttacaccgcaaatgctaaggtgggaaaacaaaaaacgaacgacaatcagatgctccgtgtctcccaaactgcacacgctttacggagaaggagagttgcaccggggcttgtcaatggcagagccttcctgaaagtcaggttctcctgtcagggtggagacccagcggctttcaggagcaaaaaagaagtctccaaaccgacacgctttgctcagcgttgacatatatttctctcttccctgctggtgtcaacaaaaaatgctttgttgcctgcagtaattttacggtccagaagtgccttgctgtagcattgctggtaggcacggcagtgcggctcagctgcctgagacagggtcatgggcctttgcccagctcgtctccaccccagagaaaggggcatgcgggcccctaatttatgggggttcacctggcgctcacagacccaccagttcctacaggcggatatccaagtccagagctgtcgtgggcgcgctgagttgggccatctttggaaagaaaccctggggctgtcgcggggggagggcgatgtctcaccgactaccagggtaatggccgcgctcaattttgcctttcacattttaattgtacaacagtaattttgcaatggagttgccgatggcaaacatgcaaaagacattaactttatttatgttttggattattaatgtggctgttaaaattcctccagttagttttgattgaattgtttttttgtgtgattctgctgtttaatggggcggtaaataagaatttctgataatgaggctgagcatctgtcacaacaacctggtgtgggctattaacatttccattaacggcagggtgggcagtgataatacggaaaccacacagttagaacaaaataaatagttggtgtcaggctgagtgggtgttaattactattttattctgcgctggggggagagagcagaaagtggggagggggtgatggggaaggggcgagtcctgaggtcagtctctcccaagaaggcctctccagagagccgggtgctgggccatctccctcggacagcgactgttttatcgtctccatcgatggtccgtaaagacactcagtcaaaaggctgcactcctgggccgcagccccggcggcaggcggagaggagtgctcggctggcctctgcctccgggagccaggccccctgcacagctgccctggagctccccagggcccagctcatggacagccgggagagccccagtgggaggagggagtagcagagaataggccgtcaagagaaagtgcgcagcgtggaattcaaagatagtgtgaagctggcatggggcagacaggacggaggcgttctggaacgcaggcgtgtgctcccaactgcctaaatggctgtgtggtgaggtgcggaggtgcggccacacccctaatggcggtgtggtaaggcgcggaggtgcggccgcaacatcctcatgtgtcctttggtttgcgtgtgccatgcagccctgcagacgcagacagcaccccagtgagctcctccccagggggagcgagggggctggaggggaagactggatcctcagaacgtgaagccagagctggcctcagagagcaaagtgcagccatgttctcaaacatcggagcttcctgtccctcttagaggggcaactctgtgtatctggacgaacttcatctagatcagggcttcatagccagggatgcctgaacctgtcatgggaacacagctatcttttctctaatctcaatcagtaatattagtgacaaaaaccacagcagtcaggagtcctgtgactccctcgccgatagagccgcagtgaccctgtcacatcccaggcattgctgggacctcaagttaacatcctcacccaccaatgctttgatctcacagcaaccatcagaccagcccctaagcctggtcaggtattaaccaagaagcacgtggattacgatctcatacctttggtttcaaatactctgctaactgtatctcggtataattatttttctgtgcaattctatatattttattgtatgcatttaagaacatcgtatgggaaggatttgtggtcttccctggcataaaagggctgagagctcttagggggacacagagccacggatcccaggacataactgtctaaggcctcctaagccagggcgacggcccagggaagaatctctcacatggttcccagcggaattagggcatgctcgagccccatgggcatgtgggcgagggtccgggccggctctgaatgaacgtctcagcttctctccgcattgctctttcctcagccccggccatggccccgcagaacgtgcaggtgaccccactcacggccagccagctggaggtcacgtgggacccaccacccccggagagccagaatgggaacatccaaggctacaaggcaaggccctcccgtgcggttgcctcccctggctcgcttgggcacccctcgttcacgtggtcctgcctactgcattgccagcagcagaccccgcaggcgctccacctggagagctggggcccaagcgtcggagcttggctagacctggcctgttaactgtggtcacagctgcttgtgggtgggaggcagcacaggggccaggctcactgcacacctggctgtgcccaccacaaaacaacccaggttgggggcccttgtttgtccactggcttctccccactctggacgcatggcctggctggggaacccttccgtttcctgggcccattctggagcccccagtacattggctgactataaaagaacatggggcgcctggaagagaccaggctccccatcccagctccccccttggtcacagttggacactgagtgagtcccttgattcggtcggtccagggtggggcccgccagtctcattcctcacaaggtcccagatgtgaggtccctgggaaccctgctttgagaaccgccacggtaacatgtgagaagcccattgtcactggagggtctagagatggggagaaaggaaggcagcaggccatgacaggagagcgtcgagtgaggaatcattatgtggggctgggttatccatggggcgggaagcacctctccacgtcccatccctgaggcctggcctccttagagagtacagggcccataagcatccggggtctttgccatgaaaacgcccccatccttctcctaaataaattcccctgtctattctgctgggacccaagtcgatcagtcatcagattctgggggctagcctcccctaatgactattggaccgattaaatgtccatttaaagatggtttttgcaggtgtgttatgaaaattaataccttcctccatggcagggctgttacagtgatgaatgagctaatggagagccccatgagcttggaggcatggcgctatttatgtatgtccaaaatatgttttctaatttccttaatgataaagacactgatcttggatattgatctcaagttagcaaggcctgggcgagcggaagatcttagacggtcaattcagtgagcagaagcccactacatcctgcaggtggaaatgaacgatgctcaccagtcagggcctgcccagcaagagcaaggcgggcgggtgtgcgaggcaggcgtgccagccctggggcgctccaggctgcctccccgaagcctccgtgctgccttttcacatgggcaagccgctctaacagcctggccctggtttagacccacagagccaaggtgggtcttctgattggtgttgtctttgggcagcctggctggcactggtcggaggtagcagtggtttccggccagctgtctagggaagcaattctggcaacctctttaaacctttgtgcttgggcgtcaagttcaactacaagcacataaaagctagacaagaggaaatggcaccccagaggaatgaggccttcccagcagccctgagcccaacatagttctcctgcctgttgtttttgattgctttaatctccaaagtatattgccatattgaggaaaacttagatgtcggctctgaataaaatgtgggaacacatcgtaggagttgggggtttgttgtctccatagctcggagcagggggtggacacggggcggcttcccttctctccagaagatgggggagagggagaggccaaaaatcaaaacaccaacagagctaggtctgcaaggaaaggcacatcatcggcagctgaagggcagcttcccttccgtcctcacaacttatcttcaacagcgctttgtttaacgaggcaatgctcatactctaggtgagcaacaggaaaatgttaaacatcgtctcccaaacaacattagcagccaggggtccccgtccatacacagtagcctcagcttctccctgattcctccaggagggagcctttccaccttcccacccagcacagctcgccccagaactcagctcaccccctcgctttgaccttacactcagtggcccccgcttactggaaggcttccccaggacccaccccaacctcttgctgttcctaacagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccggtaggaggaaggcgggtttcctttgggcaggcctccttggacacgtgttttgagagcgccagctcaggtcccctcacacagtggttcccggcccgcccaggcggaaggcaacaccttttgagtagctgggagtttctggatgggcaggactgggtttggctcatttgttctccctgtgcctggcctcagactggtacacagtggcgctaaataaatgttaggtgggttggagcaatgcatgctttttcccagagccctggagattcagaggggaggaagggctttgagtctgcagcaaggcctcgttcataactgacagcatccattccagttcctccaagaaatggaacttcccatcaggggcgcctgatggcatgtccagatccttgggggtaggctcctcgggcagtaaatccaggccacagcgacgggaattcccctgggtctcagggccacagaccacccctggagactgctcactacacacatgccacgggccagtcccgagggctcagacaggtgctgcgctgctgtggcctcatctccacgcacagggcgcagcgcctgttctcagtcgacccctcttccagcgcatctcagtttcctagcagcctggaggatgctgtgaagctgcttggccttgggctctgaggagctctccaaggccctctgtaggattctggaagtctgagagactgggagagtgaggtctgggaaccgtgggcagagacgcagggctcagggccttccgacattccatgggttcagctgacccacagacaatggactccgggaatcagggccccttggcatcaaactctcatgtgctgaccacaaccaggttgcaaggaccacttcctttggcttcatccagtgcccgcatctgagctggaaggatgtgggcagatctgtaggcagagatgagggtagagccatgttgagcactgccggcctggcaggtcacagctgtgggtcccagagactggagggagggcagagagggaggagggtgggtgccacttcacaggcacttctgagcagcgaggggcaccagggcgaggagagtaggtcccccacctaggctgtctggtaggggcagccccagtacacgcccaccttacacggcgcccgggcagagggggagctgccagcaggctccacatcaccccggccacacacctgaccttcagtagctctagatatttccaccagctccctccccgctccagacccagggggacactcagcctggagagtgtggtgggagatttcacgtgcaggagccaggggtgtcccccaaaacccccaggcctctgagggagaggcgaggaggggtcaagagaggcttcatccatcacagagctccgtctctccggcaaagagcaggactagagcttctggaatcctccagcagttgctagaaaatggagctccctgcgtttcattttctatttccatctattattcatttttatgcctttgccgttttgtctctcaagcccctttgtgtttaaacactgtcattttctccactcttctcaggagggtctgcgtgtctgattgatcctcggaagttctgaggtgatcaataaatcttttcattttatgacattcagacttttactgagttgaaaataacatcgaataacattttttattctatacggaggcacagacatgtatgtatatgatctatgtaggagcccctgtaaaagtcactttgtgttctattctcccagcccctggggcccccagctttctggcgttctcagaaataacctccaccacgctcaacgtgtcctggggcgagcctgcggcggccaacggcatcctgcagggctatcgggtggtgtacgagcccttggcccctgtacaaggtaagacccggggttggggagatgggagcgcgggccacaccagtgcccagccctctgcagtctacacagtgagccgcacctgaccgcttctgtgggccaggagccttctggcgcctgaagtggggggttttggaatctgagctggacggggctggagctgagtgcgaggggagcggggactcgcggggaaaggcctgtgaggaaaagctgagccaagaccagacctctgtgttctgagaccagaacggcactctccctctgaagccgtgtcatatatgcccttgatcctgtctctgtcacactcaagacattcctctcctattcctcccgagatgtttgtcctgtggtcgccgacagagaccacccagggttccacttgaagccacgcctcacaacacaggccttcggctaccctcagcatcctaggagggatgctggcatccccgtgtcttagcaccctggtgctcccctcgctcatccgtcccctcagcggacatctatgaagctcctgttctacatgctggaaaagccaagacatgctccagatgctggaatcgaggacctgggaaagccaggattttgactggcttgtttatcaggtccctggctttcctgcgtccaggcagttcctattccagggcagaggtaacacacaggtaattaaatcagcaaacaacagcccgagcgtgatcagtgctttggaggaaagagaggagggctaacacaagaggcttagggaagagaccggagtgacaagggcccggacacacaagaatcctggggaagatcttccgaagggaggatccgccaatctaggggcccacggtgggcagagcttgggtggtgctggtggctggagcttggtgagtggggtgcaggcactgcaggccacagcacacggggctatggcatatcccactggagagtgacacaggagcaggaggacctgacctccccaagaccaggatccctcgggcccaatcccccgtctcagtgtcacgatggaaagaagctatcgttcatctccacacttcctagatcaaccggaaacagcttccatagaagagcagggaaggtgttgccaacacagaggactttgaaagaggaaatgtcaggggcttgacagtgagtgacaggtgaaaacggaaggtggaatgcagatggctcggaggagaacgggtggcagagattctgtagaccagggagtgaggaggccggccggggctgtggcatcatcctacaggagagcggcgagaaggggaagggtgcgggggcaggggaggagggctcagatcaggggtgtgtattgaaggtggagctggtggggtactggcgtgaagtggaggaatgggggttgcgggcaggtggctctgccctgctgtgcatgtggctgctgctctgcacctgctgggtcagtgcacaccctgctcaggtatttgttcttgtttttgtttctgttttttttgagacggagtcttgctctgtctcccaggctgaagtgcagtggcacgatttctgctcactgcaagctccgcctcccgggttcgcaccattctcctgcctcagcctcccgagtagctgggactacaggcgcccaccaccacgcccagctaactttttgtatttttagtagagacagggtttcaccatgttagccaggatggtctcgatctcctaacctcgtgatccacctgcctcggcctcccaaagtgctgggattacaggcgtgagccaccgtgcccgacccctgcttaggtgttattccagtgccttctgtgtccctctctcctgccatccagacaccaatgtgtccaccaaagattccggtctgggaggcacgtctttcccaccacactggggtgaaatacaagtccagctgtctctgccttatggtccagggcaagtttccccctgtaatatacacagacagactgtaaaaattatagattatttaatgtctgcgaggaaaaaatacaacgagcacatcaaagaatatcggcgctccatttaaagccgtgataaaagtttcctttaaaaataagcacatttagatgaaacggagttgatttgatgaagaaaatttaagcactagttttttatttcactgaatctcagatgccattcactgtaagattcatcattattttatgaagtgctcagaaagaaaaaatgctcccaataaaccagagcccaatacttttgtatcatcaattctgagctgcatcccaaatcggagatgtgaaaatccgagaaagaaaaaaaaaatcacgtcttagacaatcgatggactttggtaaataacagtagaggtgagatgtgggcatggtttttgaaccagcagagagggcatgggagggacggggatttagtgtggccacttcgaggggcggccaggatctgttgtgaccttccgagtgcccagcacctgcctgggagccagggggcctggacgaggctgccttcgaggtcccacagcagaggcccagaagcaggcatgccatttgctcttgcttgtcctgcagggagaaacagtagagaattttggagacacacacgggttccatgagcctgtgttacaaatgccttttcaagggtcataaccaacgaggaccatttaaatgagaattgactgtgaaagcttcatagttctgattgacctgtgagtccttcctaatcaaaggcagctcaggttttcccattcttcctcaagtaagtgactggttctgctccccagtcttctgtgttaatggatttgcagaatctccgtggaaactccatggtgtgtgcctctgggcttctctcttgggctgctgctcttagtcttgtgagaaagtgcttcatgggctgggcgcaggggcctgtaatcccagcactttgggaggccgaggtgggcggatcacaaggtcaagagatcgagaccatcctggccaacatggtgaaaccccgtttctactgaaaatacaaaaattggctgggtgcagtggctcacacctgtaatcccagcactttgggaggacgaggcaagtggatcacgaggtcaggagttcaagaccagcctggccaagatggtgaaaccccatctctactaaaaatacaaaaaattagctgggcatggtggcacgcacctgtaatcccagctactccagaggctgaggcagaaaattgcttaatcctgggaggcggaggtggcagtgagccgagatcgcgccactgcactccagcttgggcgacagagcaagactccgtctcaaaaaaaaaaaaagaaaacaaaaattagctgggcatggtggcatgtgcctgtagtcccagttactcgggaggctgaggcaggagaatgggttgaacccgggaggtggaggctgcagtgagctgagatcgcaccactgcactccagcctggtgacagagcgagattctgtctcaaaaaaaaaaaaaccagtacttcattccaggcaaggccattccatgggtcattacccagtcagaagtgccgcacaggggcctcgatgtgttgggtcctcttctctctgcagtttcactcccctagaattgtttcttggcttctaccaaaccttccccctagcccagtctcccagacacaagaccctgcacatctggcttcccttgtgttttcagtgttgccgtttcttgttcgtttcatgacagtttttgcatcactgggaaactcaaagcattcggaagatttttagacaatcctttcagcatgtcccgcttacatgggcattctgtgttctcgctatacacaggcaccccccaggtataatcacagtgataggtgatgtttgttgagctcaagtcgggcactgtgctcagcacttaacatccgctatctccaaatcctcagaacggctctaccttgtggctgcagcttttcttctcctcccgcagacagagagattgggctcagagccacaaagacatttgcccaaggcctgcgttttgaaaataatgacgagggttgggatttgaacccaggtgttctgagtccagagccaaggcctaaactgctccatgatgggcagaaagcgtctggagcacttgtgtttctgaaagtaaatgtgaaggtgaacttcagagatggggcttgaggaggattcactaaagcgttttatattctagacaaaccgctggctgcacagccgagtagggggcctgtctctcccctggatggcaaaaggtggagtcactttagtcacaaccgttttcgcctcttttcacaaatagcaagaccgtccgtcaccagccttgtctcttttgtctgttgcgaagggctggttccttcatcctggattttcctggctttgcaaccgaggcaatgtgctctgagattagagcgagaggggagcagcactgtcttgctttgcagctccttccttggctctgcaggctgaggggcggccaggatctcagcagaaaaagctccatcaggcctccccgggtgtcaggaagaacaagccatgcagaccccccacgtttgggcttgctgggggcttgggcacgttccagacttcggattcctgcacatcagtcaagcagcggatccaggtgtggattgcccagcggtgctggtgacatgaggcgtccagcccccacccaatggccttatagagcttcctctagacatgacacctggctctgactaagccatggggcccccgccggggtctttcccgccacaacaccgtcagtctgcaggcaccatcatccgtggtccggctccagccgggatgagcctgagtctggctataggttccagatccctcctggcttctccctcgggcaggactcagcaaccctgccccccagtgccacccaggtggacctcatggctgcctggggaaggccctcctcaccacaaatgccagcagagcctcgggaccctggcgctcgcctgcctcccctgatggtattggccagaaccctggctcgccgagacactaaccccaggcctgtccgacaagccacatcccgtacccacatacgtcaaaagaagaacgtggaccaagagaggatggcagatcagactcactgagtcagcttatatctcatcgggggccagagcactggcatctgatgaagattcccaattggtgggtggtgaaggtggaggtggcagaggcggaggggcctatctctcccttctcctgagtccaggccttgggcggagtccccctacaccgactctgcgctgggccacgggattcgcttcagccagcgggacaatagctgtcatgaggcaagcagcttcaaaagcatttgcacgtgggaggcaccctggtcctcctgctgcccttggaacccaaccaccatgtgaacacacctgggctggcctgtggggtgacagtcacgcacggcccagcatgggagaggggccacctgggccagccaacccccagtgagactcaatgtgtgaccgcagacatgctgagtctagtgcaggccagcccggccaaaggactgccccgcggtacgggagctggtttggtggtggtggttttgagccactcggttttggagtggtttggttcacagccgtgcatgagagaggtacagcaggtgaggagtccatgttgattgtggagcacctattacttgatgcgttcttagacaatagtcagagttggggtcctgactatcggctgggcactcccactcatcccccctgccctgctccactcctcaccgtggtcctatgaggtaagcgctgccaacctcagagcagagggagaaactgaggactctgcagagaccacatgtcctgcccagcctcacacagggagcaagcagtgggcttcagaccactcccatccccgttcctgcattctctcttcctcccagctgactctgcagataccacaaccggccttggcaggaacgtggttcaggaagcactcatcctggcagctgctctctgcctgcaggcatttctgagtgtcttggcctcctgaggctggggaagggaggacgtgaactctctgttgaatgtgggaggatgccgggatagcttgaaaaggacgacaacgccacacgatggagtgtggccaagggcagggtggttgacagaaggcaacgactgggaaaaagcaaagcagcttcgtgcaccccgtggaggttacaccatccagccctcactgccctgcacctccacacccagactggccccgccccacggccgctgctcccactctcacccggaggggctgcactcccgtctgctcctccccgaggcccctaggagacaactgtgcctgcgtgggggactctgaaaaatccagactctaaccctttcactattgcatcaggattcccaacggggaaccacaaaagcggtaactggacctccacatgactttcaatattttgctcatggagtctgtgcgtgtcccagggaaacagttgcaaacgcagtgaaacatcaggcatccttgaagtatattgtgatgacaaaatattttaaaatatggtaaagatagttaaaaagtaaacagtgatctcacctggtaggggatctgtggggtcttctgacctctttccacacctcctcacccagaaccaggtctgtgcctgacatctgcaaactcttggctgggcattgaccagtcgggccaaggcaaatagagggtacagcatttacccggtatgggcagctcctctagtcactccactgtgaacacagtcgtggctcatcctgtgtgctgggcagagcccagggccatccccagccatccccgtcactctagggaacactcctcgaacccctgggacatcacattgtccagagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccacaccccccggagcaccctgccacccggagcaccaggccacccagagcaccaggccacctggagcaccaggccacccggagaaccacaccacccggagcaccaggccacccggagaaccacactacctggagaaccaggccacccggagcaccaggccacccggagaaccacgccacccggagaaccaggccacccggagcaccaggccacccggagcaccacaccacccggagcaccaggccacccggagcaccaggccactcggagaaccacaccacccggagcaccacaccacccggagcaccaggccacccggagcaccacaccacccggagcaccacaccacccggagcaccacaccacccggagcaccaggccacccggagaaccacaccacccggagcaccacgccacccggagcaccaggccacccggagaaccacaccacccggagcaccaggccacctggagcaccaggccacttgagcactcagccatgtgcttgggaatccgattttatggcagagctatttttacattttttaaaatgtttttaatggtggtggtttatgggattgtaccctgaggctttgtagtgctgggcatggtttaaaaattgattaaataaataaaattctgacacacctgaaatggggagaaggccaggctggctctgcctcctgtgggatagaatttacaaaatctgtacctgggtttgtttttgctccagggagaaggaaggcatttttaacaatgaaaaaaaaagttgctctctagaatcactttacattggacaggacccagtttgtgtgttgatgacagtcactatgtgcacaaactgccatcctcatcacctctctgagcaatggaaggtcagtgctcacacatgccccattcctctacaggaaaacccagttttggagggtcacccaaaagtagccaaaattggccccaggcacggtggctcatgtctgtaattccagcacgttgggaggccgaggtgggcagatcacttgaggtcaggagtttaagaccagccgggccaacatggtgaaactaaaaatacaaaaattagccaggcatggtggcatgcgcctgtaatcccagctactcatgaggctaaggcaggagaatcgcttgaactcaggaggtggaggttgcagtgagctgggatcgcaccactgcactccagcctggatgacagagcgagactccgtctcaaaaaaaaaaagccaaaattgctctgaaataattcggaagaaaataatttagctgaatatatgtttgataaaaggcataatatatgaaaacactgaaccagctagaagatatgttggagatttttaggataagagaaatttgctttgatggctttgaaagatggacccgttttgtagtaggaaggcgctttgttctgttctgaagtggagatgactggggtattccaggtgctgactagcagcgcacgaccctcccgcaccaaggcagccatttcttagggctgacagcaggagggcagggctgggcaggtggactcaggacggtgggtgccactcaccaagggcagctcttctcagggatgctccttggaaaatgagctctgccaatcggtccatcctggaagtaccacaccttgatatcctcctccaagagctgcctggtggagattaatctattgaaagttctgagaagtccagcagttgagaacttatctaactgtttttttttttaatgcatcattttcaaacttgtttaaccaaagaacttgatttttccttctggaaaatgctgcatatgtgtaattttcaatatttattctctcccctaaaatgtgaaatctccattttctatttctaggtaatccaaccagcaagacttttgcatgatcacttgtttataacatcccataggtttgaggacgtttgtctctatgttgccatcgtcctctgaatcgaggcatcaatacttgcagtgaaattaattaattttttaaatcctggcttcagagtccacagatgaagttcttatgactcatttgaggcctgtaggccgcaagttggccaacccaggcaggctgcagcctcctcgtggggtctaactagatggagtatcttcctacatcttgtatacgctccctgtgttaatctgttctcacactgctaataaagacatacttgagactgggtaatttataaaggaaagagatttaatggactcacagttccacatggctggggaggcctcacaatcatagtggaaggcaaaggagaagcaaagtcacatcttacatggtggcaggcaagagagcatgtgcggagaacctcccatttataaaaccatcagatctcatgagacgtattcactaccacgagaacagaatgggagaaacagccctcatgattcaattatctcccccaggccccaccttgacaagtggggattattacaattcaaggtgagatttgggtggggcacagccaaaccctatcactcccctccctcgtgactatgtcaggaagcttgcagtcaccttacaagtgacaccagactttgcacagctcagagccaagtgggaagggacattccctggagtgtccaacctggagaatggcaggaccgccccccttcccccgcccccgctcctccctcccctccccgctcctccttcatatcattcctgagacggcagcctcccccttttgtgttgtcagcctcagttgttttctttgtcagcacccacttaccaagcttaagctctaattacacttatctgtgctgaaaattggctattaccaccatataaactcctaatagtaagaaatacttccttagcaaactgcagggaccactttccttgttatcgcaacagaacagacagtggacagttgcttctccaggctgaacccccttgtttcctttgcttctggcggctgcaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggtaagtggaactccaggggcagacaatgtcaattgcaactttagcctcccgcctcctgcttcactgagctgagatccatctacatggtcaacaaggtgatgttggcggccaagagctggcatcaactcggggatgtctgggcaacatggacgtcttcaaaagcacgcgtcaacatggagtttgcaggtggacttgttacatccatgggcacattgttaaatattaagcatgtcaagttttagttgtttttttttttttttgagaaatcttaagaggaaaataactgaatttggcatttgaaataaatcagaaaattttaaagttttccaggtcatggggaagaagcatgtaccttcccacttatccaactgttctgccctttgtttaaagacaggaaggcgtgggctgcagaaccggcattcagggagtgctgcttagtcccgggcacagtgtggggtgccctgcacctgccagctctttcaggccctcttcaggtttttttgttgttgtttgttttttgagacagggtctcactctgtcacccaagctggagtgcagcagcatgatcatagctcactgcagcctcaacctcccccggctgaagcgatacccccaccccccaccccgcctcaccctcctgagtagctgggctacaggtgcaagccaccacacctggctacttttttttgtattttgtagagacaagtttttgcaatgttgcccaaactcctgggctcaagcgatccacctatctcagcctcccaaagtggctttcaggcgtgagccaccacgcccggccttgcctccctgttattaagatgaaaaaccctgggtgcgtgaggttaagtaacctgcccagacactctgcagcctcgaccggtctgaccccccactgtgaaatctcacggggtgggatgtgagccccgcagggctgatgcctcacctctcttttcttctttatcccgcaggatccccgggctcgcctagagatgtcctggtcaccaagtccgcctctgaactgacgctgcagtggactgagggacactctggcgacacacctaccacgggctatgtgatcgaggcccggccctcaggtagggtggcaggccccacaaacggggtctcagcccagcggacggcagtgcttctaagactgtgtcgggggcttccatcactttctctttcagcattttccccccacaaagctgggaccaagagggcggttttggtgaaagaagacatccatggctcactcagctcctcccagtcttcatagtcacaactgtgcggttcaccttaagggcatacgctttgggatgttttagccccaggacacttacttaggatgataatggttattcctagaaacaggtgaatgagaacttagggacactaaaaggcattttcaaactcatccatgaatgttttcagggactcatgtcagggttctaaatgtttgctgccgagatggaaaacgtcaggcttgtttctgataatacgaagattcttattaatagtgaaaccgacacatcgtttgcttcattttttaggcttccgaaaatgaggtctaagatccatttccagccttattcaccagaataatttttttcacccttccttccatttgcctttaataactaaggatgggcattattgggaaatgagtttctgatcgggtgcgtcggatatgactgcttggagctagtgggtatcacctaacacagaaagcacggaacagctccaatatgaccttcagatggttgcacagttaatcatgaacatctgagcatgaaaatatgtgatgtgtcagggacgctattcaggaagcaaaccatcaaaccccacctgccaatctggcaggaccacggtgctaggaactagtttagtctaatacttaaacaggctattagaccaagaggaaagaccccaaagctacatctgtcactgtgtcaggacactcgttccctcctcccccaccaaattgcttttgaaagattattagttacaagtgctttctagaaacttctttattttatttttttgagacagagtctctttctgtcacccagcctggagtgcagtggtgcaatctcagctccctgcaatctctgcctcccgggttcaagcaattctcctgcctcagcctcccgagtagctgggattacaggcacccgccatcacgcccggctaatttttatatttttagtagagagggggtttcaccatgttggccaggctggtctcaaactcctgacctcaagtgatctaccctcctcggcctcccaaagtgacaggattacaggcctgagccacggtgcccagccgccttctagaaacttctaaggagaaacctagtgcagaagcgtgaaaaagccaaaggcaacataaacatttctttggctcaataactcagaaatccagacgtgctcgcctgggggaccctgagagtatcttttgagcagggcgtctgtcctgttgtggaaacagagggtcctgagttggtaaaggatgtgagtttggcaggggcctcctgtggtcactgcctgtgaaagcccatggcccctcacacagccagctggccctttgctaatgactttgattcaagagcactttcagagactgacaggagctgagacgtgtgggttctggggccaaattgaggctttgtggaggccaagggggagggagctggtggcagggagcagcccagacttaagaaaccacttcagacactttcctccccatatccagggagagcaccgatttcttcctcaactcttccagcctgggtgacagagcaaggctccgtctcaaaaaaaaaaaaaaaagtttctagaaggcacttgtaactaataatctttcaaaagcaggttggtgggggaggagggtacgagtgtcctgacacagtgacagatataacaaataggatccaggcgttcacaaatagaattcaggagatccgtgagcttggatggggaaaatacacattttattttcactgacctctaactagaatttggcatttcctgtaattatggatgcaggcacattcgttatccagggctgccttagcaaagtcccacaaactaggcagcctccacaacagacatgggttgtctcacagttctggaggccggaagcccacagtcaaggtggcagcagggcaggctcctcctgaggctgtgagggaggatctgtttcctgtaacctctcccccacttctggtgattacaggccatcctgggtgatctggggctgacaggtgcttcacccatctctgccttcatcttcccatggtgatctccctgtatgtgtgtctgcatctcagttttatcttttatgaggacgccagtcatactagactggggacccactctactccggcaggacttcatcctaactaattacatctgcaactaccctatttccaaataagctcattgggaggtattgggggttcggacttcaacgtatgaatttgcagtggggggcagagacataattcaatgcataatattagctaagaaaccacataactcatagtaggccctgtgacacttccaggagtactttcgtatgacttccccgccattgcagatatttcacaatgctgtttagatgtgtccttacgttgaaatcacagtcatttgtagactctctgctggaccttgttggctaatgagtccatgaagcgtagacttttgagttgtgctgggataacggtggccacaggtcacctaaacccaactcttcatacgtcttccaaggaaccacgtcgctaaacaagttagtgcaaagaaaaccacccataatccatgcctccagcattacctggagacacgagttcccaggaacctgcaggtgcctccaggtgatcgtaggcattaccagttctgtgactccgttctcacattgccataaagaaatgtctgagactgagtaatttataaagaaaaaaagtttagttggctcacagttctgcaggctgtacaggaagcatggtggctttgcttctggggaggccccaggaaatcatggggagaccccaggaagcttccaatcatggcagaaagccaacagggagccggcacgccacatggctggggcaggaggaagagagtgagtggggaggtgccacacgtttttaaacaaccaggtctcatgagaactcactccctattgtaagaacagcaccaaaggggtggtcctaaaaccattcatgagaaacccactgctgtgatccaaacacctcccaccaggcccctcccccaacaccggggacgataattcaacctgagatttgggtggggacacagagccaaacaatatcaccagtagaattggtttccttttcaattttagtttatatatctacaaccattctgagaaagtgtccttgagccaacagatcgccacagggacccatggtgccgagagcagattaaaaagcctgtaatcccagcactttgggaggccgaggtgggcggatcacttgaggtcaggagtttaagaccagcctgaccaacatggtgaaacccagtctgtactacaaatagaaaaaaattagctgggtgtggtggcatgcacctatagtcccagctactcgggaagctgaggcaggagaattgcttgaacccagaaggcagaggttgcagtgagctgagatgacgccactgcactctagcctgggcaacagagtgagactctgtctcaaaaaaaaaaaaaaaaaaaaaaaaaaaaaaaaaaagacacccgcactagaaaactacagaagggcctggctacgaaacttcctcctccctgaacgcctgcctccctgactacagattaaggatcccagcagatgggtggctgtcacagggtcacagaaggaggcattctggatctcgaccgcatccctgcccatgtcccagttgtgagactgcagcacagttttgcaggatgttaccactgggggacactgggtaaaggatacacagacttgctctccgttgtttcttacaaccgcttgggactcttcaactacctcaaaatgatatgtttagcgtcaagtaatcattgaaaaagccacggtgtccgtcctccccagcctgctcggacaagcacaccaatgtgtctttgagcactcttgtgtgggagagcggcctgtgggatggggcggtaccagccagacacgggtgcctgggctcagcctcttaacgctgtgaacacatctcagcattttccaggcagcgataaggcattggttctcaggcttgccgagagagcccttgactttctcctcaggttctcatatgctgctccgccggctgcacgaagggaacaggacgcctgttggttactggtgcggcccagggagcctggcaggccgtgcggattagaagtaattggcgtgtcggcgagggcttcacactgggcccacgcctcagagtggcttgcctaacatggagaagcttctgaagtcagctgagtctgagctcagcagggttggggccagtgtgtggaaactgacccacaggggaccaagatgtgacaacagacttatcaagaagaccccagctttttcggcgagggctgaagatcctgcacttaattctgcttggctgctcaacattcaaaagcaggtcgccaacgatctcccctttcggatcatgaagggaacccaagcaggccgcgggacccgtgttctttcatgggaagttgagacgccccctcccttcaatgattaaggccagcagcagctcaggcaaatgaaacgctttatggattgtcaatatttaagcaccttgctggtacctgagggctttggatctcagctgtcatccattacaggcctcattacacaaaacattaaatgctgtatcatctcattttcccaccgaagctccctggcaagacgttctccaggtggggtgtggtttgctccaggtgcaatgaatgggccccgttttgtattgggaggggccacacaggggccctcaccgctgggtatctgggagacgggcactcggtgccaggcagcccctctggcccacgtggtcggctcggcctgatgtctctctatccagctgagtctctaccttgcccctgggagacaagacactcatcagctttgttgctgctttgcagagggtggccagcgggcctgggcagcccgggcagatggtagtggagcgtgctgccctcccatccccatccttccttacaccccccgcacattctactgcatagcccctgttgctgtggccatgtggagacgcagaactgagcagcagctaatgaaattagcaccaggctagaacacagatcccctcttattcctggagagggcgctccatgagtgtgagcccaaggacaccgccaccagcttccaccagcatggcctggcccacacgttcctttctctggctgtgcgtaagtttcctccaaattggtgttgcaaaactccctggaaggcactggaaactatgcactggacatatgcagatgatctatttacacagattattctaaggcattttactgggtagatcatgaagcctaatttacatatttacacaatagactggaatgacgctaaaggaactataaatatattttcctctccaaagcagccatgaaatacatatttagaatgtgcccaatgcaggcagatattgtattgcattttttttttttttcttaaataatgtgtgtagcccagagacgagggcaggtggctggaggacaggtcccgtgcctgatggggacaccccccagccggaggcctggactgctgtccactcgtagtcccctgggggctttccagttccctccccattgattttgttcaatttcagtctttggcaacgggagttttcaagtgagtaaggaagaaaatcagtatttctctgaaggtttgacatccatagaagttccaagtcagcaggttcagcaagagggggctgttgccatggctctgatggtgcccggtcccctcatgtgctgcttgtctttctcataagctgcttgtctttctcataagcgtgtttctgacagcttgtcagcccggcttcccaccccttcctgggatcagcctgcaacacgggctttcttcgtcatcttaacatgcaatgcattttgcctcctgccttgaatgaggatccgatggaaggtaactgtcttttttttaaatcagatgtatttagcctcatgtttaagcgccaccagcttcagtaaaatttctaacctggattggccattcatacaaaaagaaatggcagtatttaagaaataaacaactgacaggcttgcatttgctctgagctgcagactgacagtcaagcggttggttgtgtgagtgcgtggaaccagaaatctcaggcagtgaatgacggtttcattcagcatggagaccctgtttaattgtccatgaaatcaaacttttgtattggcatgacgtcggccctaatacctgcagcacgcagctccgttctgggcgttggagggataaattgagtgcagacccttcgacgtgctgcgctgggctccagctcaattcagaaaagaggtgatcatgtttctgggtgtattaggacattgtctgggaacagatgtgcctcctaccgcttgggcggggggagatgctggcaccagaagctaacagctgactcattctgtcggctggagacaagcatggatggatagcagaacctatttatacagaaaagatttcttttttcaaggatcttcaatattagccacttacttcccttgtttaagtggacaaatcacgccgtaaaaaatgaagatgcatagttcatattctttaaagaaaagccgcctcaatgggaagctgaactggctcttgctttttcccactcagccttccttctgaggtggacaggattggaggttgtggtgacagcgtggcttcttcaggaatattttgcaaagtctctttctcagtggcttcccactttcttagtggtatttctccaatggcgtttcagtaacaagagtccaggaaggtgctctttcgggcagccaggaatgaaagaccaagcacgatagacaggtgtgatttgcagtcacatcaccatgagggcacctccgccctccacagacatgaagtggcaggtccagcccagaggtggacattacccacaggaagttcaaaccctgggcctcagcaggggacttgatgcctgcatcagtcattttgggggatcagtgatctggggatgtggctttttaggggacatgactgtcctcttccagccgggcattgcttttctcttttctttttgaaaccgagtctcactctgttgcccaggctggagtgcagtggtgcaatctcggctcactgcaaccttcacctcccgggatcaagcgattctcctgcctcagtctcctgagtagctgggattacaggagcgtgccatcatacccagctaatttttgtatttttagtagagacggggtttcaccatgttgatcaggctggtcttgaactcgtgacctcgtgatctgtctacctcggtctcccaaagtgctgagattacaggcgggagccactgcacccggcccttgcttttcctacaacggcaacacagctcgttcactggggaagagaaaccaggctggctcttccggacatcccagagagctgaccctagcctgggtgattgacaagtggctgactgtgtgcccagaattgcctttaaaaaggatgaggccctgctgtcctctcgagtgttgactgagatggaaatccaggcactggggactgtccagaacatggaaaaattggttgcataaatctcatttttgctaatagttctgtaatgttattttccccctaatttgtagagatacttttctccatcattgatttattgagatatttaacagcataatacaaatgagaaaaacaatccacagttgagaaatagagtggacgccttaccagctgccaaatttttttcttacccactcgtgatcgtggtgtaaatattagtacgagataagtagcccggtgaattatagctagagtggaaaatatgctaatttgggaaaggcagaagtaagcagaataaaaatgggaacattttcttctgttaattcagaaggaaattatctcggtatgacattccccctcacccaacatttttgagtgtaaatggattgctaaataaatcgttctgcgttaagattctgtatcaatattttaaaatgttattatgaaaaatgcacacaattcctggagctatgacagagtgcttaaaataaaatgtggcctttaggtgatggtacaggaagggagaatcattttttttttcctcaggagcaggaaagcattacagaaacattaatgcaaaagacattcagagaatccactccggaggtgttcagaccttctcagaacagtctgaagaaatccttcactttcttagtcccttaatttcaatggctttaagcaacacccagtttataagagtctgtatttggtctttagtgtctattacaacataaaattgtctatctttttagaggaaaaatacaattcattcaatatataaagcccttaaaatagagacttgctcacagtaagcagtaaataaaatagtggtggttattatttattgaaagcctgctgtactaggccctgagaaagcccatgggatacaaagaggaatgcaggggttgggggtgggacagatgggtggatgggtggaaggaagaatggatggataatggatggatggatggatggaaggagggggacccagaaggaaggaaggaaggaaggaaggaaggaaggaaggaaggaagggtgggcaggcagatggatgggaggtggatgagtgggtggctggtgggtgagtggatggatagatgaatggaaggaaggaaggaagggtgggtgggtgggtggattgatgggtaggtagatgagtagatgtgtggatggatggacgaatggatagatggataggtggatgggtgagtgggtggatgaatggatgaatggatgggtggatggatgaatgaattgatgaaggaaggatgaatggatggatggatgaatgaatggatggatgcctggatggatagatggatggatggctagagggaagggaagggagggcaggggagggaaggggaggaaagggaagggaagggagggcacaggaggagagggaaggggagtggagggcagggggaaggaaggagggagggaaggaaggaaagaaggttggttacatggatgaatggaaggaaggaaggaaaaatggatggatggatagaaggaaggatgaatggatggataatgaatggatggatggatgattacttaggaagatggatcatggaaagatggacagaaggatggatggatagatgatagctggagggaaggaaggaagaatggaatggatggatggttacatggatggatgggtggatggatgatgctaagcctgatggtgtgaacagccaggtaaatgtgctgatgtgatttagaagcccattggtggaagcagtcatcccttcctggaacgtggggtggggtcaaggttgacctcaaaaagatgagtctgagggggcaaaaggactcttgattttcctccatcccctgtccacaggctgtgcgtaagtcattagaacagcaatctcatctgattccctgatggatggcacagggtctgatcaaagagtagaccgcatttgtggatgaataagggagtgaggcaggggaggagggggcaacagttctccaggtccagaggaggcctgaacagagtaaatgcacaagccttccctgaccattcttaagccaaactcacatacgacaatataaaccacatacaaccagcataaactacatacagccagcaatctgtgtgtgaacctcagcatcctaggagaaagaaggtaggcttaggctctggcttgccattctgacattattagtggtgatgagtgtcttggtgagaaatggctgtaaatgagaatatttagaaataatggccaggcatagtggctcatgcctataattccagcactttgagaggccaaggcaggcagatggcttgagctcggcagttcgagcccagcctgggcaacacagggagaccctgtcactacaaaaaaaaaaaaaaattaacaacttagccaggcgtggtggcgcatgcctgtagacccagctatccaggagactgaggcaggaggataacttgagtccagtagtttgaggctgcagtgagctatgattgcaccactgcactccagcctgtgtggacagaggagggcccggtctcaaaaaaaaaaaagaaaggaagaagaaagaaagagcaagagagaaagcaatcagagagggagggagggagggaagatcagtattatactacctttctgccggtggagagatttgtacctttaaaatctcattcacgtctattcctcattaacctgtgactgtaaggacttagtcggtgcacattctaaatcctctgcaaatacagacagatacaatagcaattttctgcctatttactgttgggctaatccatctgagtgtacctggtgattccgggtgggtgataaggttggtttccggagcagtctcagtgcccataaagtagtcagcacgggtacacacatatccaaatgggttttccctcaccagattccctgctttgtaaaagatctcatagctgcacctagaaaagcaaatacagttcatgaaggattgctacttcaaatgaacattttggcctctgagcctactttttttttttttttttttttaaccaaacagcctccttagaattgaatttatacaaacacacgtacagcacttactatgtgtgaggcactgtcctaagcactttataaatattaacttacttaatcctcaaagcaaatctatgatgaagatgcctttgttatcaccattctacagacaagggtcagagaggttccgttctttgtctaaagccacacagctaattgaattggtggggccaggctttgcaaagaggctgtctagctccaggctccagcacccctttcagccctgatgctatagtgtcataagtttttttctttctttttttttttccttttttctttttttcttttcttttcttttctttcttttttttttttttttgttataatgtgaagtcataaaaattgcaaagttctttgtttgttttttgagatagagtctcactctgttacccaggctgtagtgcaatggcacaatctcagctcagctcactgcaacctcaacctcccaggctcaagcaatcctcctgcttcagcctcttgagtagtagtagggaccacaggtgcatgccaccatgcctggctaatttttaaaattgtgcatatatatgtttccctgtgttgcccaggctggtctccagctctgggctcaagcagtcctgtaaccgcagcctctcaaagtactgggataacaggcatgagccaccatgcctggctcatcgtgattctttacaacaaatctcactgatcacatttcttttgctctgtggctggagagatgcctcagaacccaagtcatgtgcctctaacatcctctctatgtctgattttaattttaaatttattaatggctttaattttgagtttattcatgttttcttatatgtgaggtttataataaatcatacatacatatatttactgtggggagatatgcataacctaacgtttcccactatgaccatttcaagtgtccagttcagtagcattgagcacgttgttctacaatcatcacaccattcatctccagaacgctcttcgacttgcgaaactgagactccgtccccattcagcactcactccgcatccagtgcccctgatgcctcatccagggctgctgcaagccgacccaccaggcaggtgcatggggctcgcatctgggacttcgcacttctaacctctgctctcgcctccccatccctcttgcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcaggtaggccctcccagggaggtctgtcttcttctggaggactagagggagaaatggggtcgagggggacccagggaggtctgtcttctcctgaagggtgggagggagaaatggggtcgagggggacccagggaggtctgtcttctcctgaaggatgggagggagaaatggggtcgagggggaccctgggaggtctgtcttctcctgaaggacgggagagagaaatgaagtcaagcgggacgaaagggacacacatctgctgctgtaggtgtctccagcttagttgaggttctgcccagggaacatgtgggtggggagagcagtgccagtctccgggtgcctccccagtgccacccatcctcctgggctgctccctgcttccctctggcaggaccccaggccccagagcctcccccagcaccaccagcaaggccccttatgggctttgtgtccacgctgtgcaccggcaattcctaatgtgtttcctcatagttttaaaaatcagagacacatggaagtgtcagaggtgtgagcatgagccacgtggtgtcccctccgcaacaaaatcattcgcaaggaaagcagagccccgatcccctgtgttagctgacgcatccttgccgaggagcatgtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctgggcatttcttcacgtgcacaccttcgctgtgaggtaccgcaggctccagaggccaccctgggtccaggtccaggtctgctctcaggggagtggcagagaaggccagggcagggcttcctccccgagagcacccgtgttagatgacagacatgtctgcagtcagcagtcatggcaggggttatgacacacagggtgggggctgtgacctcgcctgggaatcaggaaggtgcccaaagcctaccacaggggaagggaaacctgcaggaggcagaaggtggcggagaaaaagtcctggtcactgaagagccgtgggtgggggagctggagagggagggccggcaaagctggtccctggttgtggccccccagccccccatgtgcctgtgagggactcaaccctggccgcaccttagggttgcttgagaaagttaaacacacaccctcgctggcccctcaccccagacagtgacttccgtggctccaggcgtgactttctttaccccgcgatgattctatcgtgcagaccggctgcaagccagggcgctggggggttcagagagggatgggctgtgtttgaggagaggggatctcagcagcatgaagggcagggaggcctcggcgttggggcagcagagcctcagccagaagccccaggtagggccagctctgttggtcctcttcctgggattaggaagaagctgttcctctcctctgcgttagagctgcttgagctactgactgcacttgttgaaattgaacttaaccttcgtcctttatgtgctatgagtttggaggaacgaccctgtgctcgtctgtgggtgagcgtgggccctaagcctggtaccctggcctgggaacatccttgaattccggggttgctctgtgagaggggctgtgaggaagggacccagaggaccacctgattttattttttttgagatggagtctcactctgttgcccaggctggagtgcagtggcgtgatcttagctcactgcaacctccgtctcccgggttcaagggattctcctgcctcagctcgcaagcagctgagattacaagcatgtgccaccacgcccggctaatttttgtatttttagtagatacagggtttcaccctgttggccaggctggtctcgaactcctgacctcaagtgatccgcctgccttggcctcccaaagtgctgggattataggagtgagtcacggcgcccagctgaccacttgattttttaatgagtaagatttagaaaaagcacagatttctcatttccctaattttaattatgaatattttaaatgtaccccaaagtatagagaatgaggaaccctcagcacccctcatcctaattcagagatccaagatttactgcctgagttttatctgtggaaaattggtacagagcaattacacatgcacagaaagccggttcctcatgcggaacgtgcactttgaccccacttcccagggcctgtggttcaggcctctctgaaactccatcagacgcagagctggccttgccatgagctggaccgcactgagctcatcagtccttcagggaagccagcaaccatcacctgctggcgtcaggaccgggccaggcccgcagccagggtgtcctgccccgtatgagagtcctccaggacagcccggccttcctttcctaccaggtgctggggtcaggcccactccgggccagttgcccggtggtgtaagtgtggcatgcgtcagacttgccgcatggagtaccaaatgcgcagcccacaaacctacttctgtcttttggatttaaagcaccgtcacctcctaaggagccctgtgaacctgcattagccaaagccgattccctgttcttcttcccggtgtgcacacatcccctattcgtgagatataggatagaagcttcgggtggctgtgtttggaagggttctggctgccgtgagccaatgcctgggctttgcctgtgagaggctttctgttctggggggcttccagtgccacagaacctactccccttccaggcccatggaaggccctgaatgggacgccgggaccacccagcacccatcaagatacaatttcccgcttttctgttctgagcgagcagaacgagacagaaggaagaagagcgtccttcaaagccgcctttacatgcatttttttctattgatttctcaaaaacacatctaaagacagggccagtcgttcagcttggttttgctagaggcagaaaataaataaaacacagccccaggctttaggggtctgtggcctgtggaggggccaacaggtagagaagcaaatacacacagtgcgtgtttgcggcgggggcttccatagacgtgcagacggcaggtcctggggtgcttcgtgggctcagggttcaccccgtggctgttgggaaccactgaggattttaggggggacaactgatttctatcggaggaagacctctcttgggtgatgtaaaggatggatctgagcaagacaggaggaggcgtaacaggtggaatgtgagtgctgtgcgcaggcaggaggtggtgacggagaaggcaggggacctggagctgttttggggggtgtcccagcaccaggagagagaaggacgtctaggcgctttgttccatcctcactttaacccacacaacgtttttgtttgctgccttgcttgttttgtggagacagggtcttgttctgtcacccaggctggagtgcagtgctgtgatcgtggctcactacagcctcgacctcctgggctcaagtgatcctcccgcctcagcctcctgagtagctgggactacaggtgtgccaccataccttgttttgtagagaaaggggtcttgctatgttgcccaggctggtcttgaactcctgggcttaagccatcctcccacctcagccttccacagtgctgggacttcaggcacacgcctctgtgcctggctgtttttttgttttgttttgttttgtttgttttttgtttttttagagatgggatctcactacattgcactggatcaggcagtgtttttaaacagatgaaattaagagaaagcaagcaggaagggcggttttgatgggcaaggtcagggcaaggacaaagatactgaagtctccagggcagggggcagcttggaggacagaggagccctgagcctgatcccacagaaaaggtggcaaatgggggctgttgaattcccaaagcctgctgaggaccatgggagcctcctgagcttgtcccatgggaaaagtccacccgcccggctggacattggtttcatctcacctgtaactgggagttatctaccccagccttccctgccaaccacctgactcgcgggaggtgactgcagctggagcgtctgccccatgtcattgtgtgtccgtgtcttttccacagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggtgcaggtccagccccttcctcgcgtgtcccacgatgccactcagccaaaacatagcgttcgttctctcgtggatctgccgggcccgtgtctgcttttccatttcatttgcttgtaggtgctgagagaaatgcaataggttttctttctgggggcagccaggcacagtgcagcaaacgctctatgcctcgggacccagatgctgaccctgcctgccctcagattaactatgtgtcttggataagggcgtatgagtcatccagcctcagagatccccactctgtacctttgttcaaatgcaattgctttttttttttttacagtctcactctgtcacccaggttggagtgcactggcacaatctcggctcacagcaacctctgtctcctgcattcaagtgattctcctgcctcagcctcctgagtagctgggattacaggcgcctgccactacgcccggctaatttttgtatttttagtagaggcggggtttcaccatgttggccaggctggtctcgaaatcctgacctcaggtgatctgcccgcctcagcctcccaaagtgttgggattacagacgtgagccacggtgcccaacctaatcacattttttaatagtattagaaagtgaggtgtgtctgggaatggtggcttatgcctgtaatcctagtgattttggaggctaaggctgaggatcacctgagcctaggagatccaggttgcagtaagccatgatcacaccactgtactccagcctggacaacaaagcgagatcctgtctcttttttttttttaatttgagatggagtttcactcttgttgccatggtgcagtctaggcttactgcaacctccacctcctgggttcaagcaattcgcctgcctcagcctccccagtagctaggattacaggcatgcatctccacgcccggctaattttgtatttttaatatggatggggtttctccatgttggtcaggctggtctcgaacacctcacctcaggtgatccacctgcctcagcctcccaaagtactgggattacaggtgtgagccaccgcgccctgccgagatcctgtctcttacaaaaaaaaaaagtatagagcattaaacaggtggcatattgtactatgcaatattataaacacagtgacctggggcactgctcagacgttgatgttttgctgtggctcagagactgtcacagaagcatctccatggcatagctcttctcacccactgcagcttgaaccttgcctgtgtccgtggtctagctctgagccgtctgagggccaggtcactactgtgtttccagcagaaactccacaccaggcatagagcaagcattcagtcaataagcatttattgccgaatgacccactatcattagagaaaggagcaaatgaacgtagggtaaagccagccacagagagcacagaccttgtgactccatttacatgaaggccaggaacacccacagtgaatggaagtttccagaaggcagaatcctgcttgcctgttggtggagaggtataaacagggaagatgcatgagagcacctcacaggtgctaaatgtgctctgtctctctacgtggacggtagttacattcacaatcataaagcatcattctggacacttaagattagcatagcttgtgcatttgattatcgtcaattttaaaaacctcataattatcaatgagaccacttctctggataaccagaatgtaactgactgctagaccgcagcctgttttttgttttttaaatagacgggtttcaccatgttggccaggctggtctcgaactccagggctacggtgatcctcccacctcagcctcccaaagtgctgggattacaggagtgagccacgcacggcgcccggcctatggcctgttttgatcctacggagcatccaccagagctgtagctgagcccaggaatgtggtcacttctgtgatatcaccacaaccgctgggccagacctcttcctgagctcagctcatttgttggaggttttcccatcaactgggtcttctctttttggaaaggcagatccctgatgagctgttcttaaaaagaggagctggctacattagccccctgagccaaggagccaggcagagtaggttcctgaccccgaccacaagtcctaccatccttgtgccaaaggggttaaaaaaaccagtcacctaaaatgcctccttatttgcttctataatgttaagcaattcatccttcaaagaaaggatttatttttttctgtataaattcacttctaacaagtgttcgtaaatcagattttattcctgagggatttacagtgtatgaatggcgtgtcattttcctgagttaatgctattacagaatcctgtgtctggtgcatagaaaaatctccctgcttttcactgtcctcctccatctggaaaacagacttgaaaaggcagatcggacctgcagcttccgatgctcagccgcaccctggagtgttaatttaacatcataattgaagccgggaaaaaataacacttatctaccagaatgtctcccgtcctgcccaggagacattgcagaacttaaacctctgttgtgatggcctcactcgacacccctccctgcgtgcactccttatcctcccatcctcgtctgaattcctttctgatcttggtttccacctgctcacctcccatcatcccaaatcccctctcccaggcaagcccatctttcattttctgctctgtgttcttccgttaaacacagagcattaaggtttaaagcacgtcaaaggggggccaggtcccagcagagaggagcctcttggggtttagaaatgccaacgcacttagcaaatacctgccaagcccctggtatgtgtgtaggcgctgtcctgggggctggcgggacactggggagtgtgatggacttaagtctgtacctcaaagagcaaatatgtacatgggcctgagaaacagaggtcactttatgtggtcagggaggtcgcctctggtctcagggcgtttgagctgtgatctgcaggaaggggagagaaacccgggaaatactgggagaaggagcttccagcaagagggagagccccagggggagaaacccgtgttagggaggggctgagggctggaagatgacgcgggggtttgcagggtggacagaccaggccaagcttgggggcagtttggaggccttggtctttcctgcagaatgagccgggaaaacccagtgcaattattttttatgttgttcggtttttcagaactttatttttattcatttgatctgttaatatattttagaatgtgttttgctatgtatttgtaaatttactcttttttgaagtgtgcggttcagtggtgaacgcacaggtacgtgcagtcatgaccacagtcagttctagaacgttcgtgtcacctcaaaaggaagctctgtaccctttctttagccgtcacactcccacacatttatctttacttcctgttttgttaaatgagtgtgagtttttattttgaaatttattaaatatttaatttcccggaatttttagaagtgtatgcattcttggccaggtgcagtggctcacgcttgccatcccagcactttgagaggccgaggtggaaggatcacttgagcccaggaactcgaaaccagcctgggcaacgtagcgagaccccatctctaccaaaacaaacaaacaaaaaatcaaaaaaagtttatgcattctgagtctattttcataaaacactggcaagaatactggtattttgggatcagacagaacaaatatgaaaatgctaatattgtcactttgctccaacactgtgatcagtacctagctcttctccccagctcagccctaagcacagctgaagcaggtatcctcagctctgggctctgcgtgcagcaggactcaggagctgccccgctggccagctctggcttggcgtggctgcggtggccacaccagtaacacgtctgttctcactctcctgctgggctttaggaaaggggatctccaccatggaggagtctgtgaccctggacaacggaggatttgctgccctggagctcagcagccgccacctcaatgtcaagagcaccttctccaagaagaacgggaccaggtaggcaggcagtgctgtgctgcgcccacctggggatctgagctgccagggctggggtggcagcccacgcccactggcacctcctgcatcccgccctgtggttccaggaagcaaaacccaacccaccgccaagtgcgctcccaaaccaccaggggcagccctgagtctaggagggacggggtcggcagagcggctggaaatattttcaggacatctccggagatttagaaagagggtctcaggtgtgtgggaagggcctggaacacccaggggctgccaggctggccttctgtgtcaatcgcatgcaccttggatctgggcgttcctagttcatggaggtgtcacctgggctgccacaggcccgaccaggtgtcctcgcaagcaagcctggtgcttgttgctgatttcattgctctgtgtattccaaagttttcctgtgccgatacacattgccattccatacacggattgagtgcaggcgagaaggattttcatcaccatagcctccttagcttataatccttttcctaaatccagcaggaagcagggtttcccaaacaagagaggggttgacctgggtttgcctttttgatgtgcagagcgccatcctctgatttgagtacccttgaccaaggagaagggccaggaatggggaggggtcttgagcgtctggaaggaaaaacccaaacacctgaggacgcttcgtctggagaacagacagctccgggctttcccagggtgccccagcatcggggtggaggaggcttctctccctcagccagactcaccttggattagactcagctgcaagggtgtggaaatcacacatcatccagacccagacagaccccagggtttcctcttccctttactgtttacaaagctgcaggggccagcagtgtttggagattccctgggccgcccccgccctccactgaatttgggaatcttagatcactcgggtggcgccgaggcacgggtgggccttctcccagccactgacgctctgccagccccacaggtgccagtccaaagcaccgcaggccgccaccccacgaggccttcccaagggctggaggtggatgctggtggtgacatctggtcacacctttcatttcatttgtctactgggaggcaagtttttcctgccgtgtaatagaaacatgaaaaagcaaccacatgtagtttcaaggccaggaggaacttgtcacagagaattttaagatattacatgccctgcttccttgctgcaactctgtcttctgagttctgagaagagacacagccttgaagcacattgcccaagaatagacagtcgttcagtttgttaagtccatctgcttcctaggaaagagaaacatcatttgatggtgaggttggaggttctcagcccacaaagacccaaggacaaaataaaattaagatggaaaagaaaatggacccttcccttaggtttttaaataagccatcaccttttcagtcctagcaataggaccctgtattcatctgtcctcacgctgctaataaagacatacccaagactgggtagtttatacaggaaagaggtttaatggactcacagttccacatggctggggagacctcacaatcatggcggaaggcaaggaggagcaaagtcacgtcttacgtggtggcaggcaaagagagagtttgtgtagggaaactcccctttataaaaccatcagatcgtgtgagacttattcactctcacgagaacagcacgggaaagacctgcccccatgattcaagtacctcccaccaggtccctcccacgtcacatgggaatgatgggagccacaactcaagatgagatttgggtggggacacagccaaaccatatcagaccccacatgtgattgaaggaaaggattctctgctgagaggggaagggtctgggcagggacacctgagattggtcctgtagcatcatccccaaaatatcttagaaatacgggcacagttgatttatgtctcccccgtgcacgtttgtgcttccaatttctttttggggaagacaccattttagctccttagataaaaagatttacccaaatgtttagataagaaatggcatctttcccaaagtaaattacctttgagatagagaaagaaaggcccttgagccttcactgggcctttccaggagaaactgaggcacaccctgggggagacaacacccacgacacaaaaccagaggtctccatcccctccagccttcccagcagagtctccacccaaggcctggtttcctggcctgtagcctctccttgatcacccagtgttacttctcccattgagggatgagaagacacttcctctgtagctgccactcagttctgcactcactcctcgcagcatgagggagggcttgctgggttgctgggggtcctggacatggtccctttgagcacacagctgcctgtctgactgcccacaggctgctctcactatcgagtccctgcacacccttcggaggactaaggagcactcagtcctgcctgatgtgaaaattcagcaatgttgtactcagagtttttccccaagttctgagttctccatctgaaaaacagaagctgggcttttactcagctcagatagtcaccaggaagtggggagctgaagagggtactcattttctatcgctgcatggcaaatgatcacaagttcagcagcttaaaccaacacccatttagcaccacgcggtctccctggggcaggagtctgggcacagctcagctgggtcctctgctcagggccttgcatgggtgtaatccaggtgtagatgggctgtgttctcatctggaggctcaactgggcaagaatcttcttccaagctcattcagcctgctggcagcatgcatttccttgtggccgcatgactgagggccccagcctcttcttggccctcctctggaggccgccctcatgtcctggaggccgctcatggtcccctgccatggggtcctctccaggggctgttcacaacatactgttggcttctgtgaggccagcaagagcatctctgtctccagtccgccaagatagggtctcctaatgtcatgtgatcatgggcgtgatgggagtagctgtccttcacccattccatttaatgtaaccgagtcttcagtctgccatgttccactggttagaagcacgtcacaggcccttcccacattcaaaggatgggatgatgggggtgggggcagtgatggagccatcttagaattccaccagccagagaggacgaatgctcccccaccagacagggagaccaggcctggtgcaaacttccccaattccctctcatctgtaggagacaattcccactccttagcatggcagatcagactgttcctcatgactccatcctcatctctctccactgcactcccctgcctgcatctggcaagcacctaagctccccggcctcctatctgtcccgacctcagggtgctgtttgtacgtgagtgtctcactgcccctcctggcacagaccagctcttcctccatgcctgcaggcctagcacagtctccacaactgacaggcacaggtacacagaggctgttgactcaccaggtagccagtgctcagaattttttgcatcagttgccaaagtgatgtcaaaggctgtgggtttcctcttagtccaacgcaataaaggccaaatgccaggttaggagtcctccggggaagggcgtcttttgcccagagggtaattgcagcatgggtcctcatcctaggtccccaccccggcctagccccggcggcctgcactactcagacgaggacatctgcaacaagtacaacggcgccgtgctgaccgagagcgtgagcctcaaggagaagtcggcagatgcatcagaatctgaggtcagtgtcggtgcctacttccgggcagtgaccatcagcccctacttctgcagtgagacttctgccccctcaggctgtcttgtcctatttgagtctcataacatccccacaggcagagccaaggacaaagggcttcattatgcagatgagaaaagagccgaaattcaaccccacggcctgctctgggccccgcagagctcacatagcctcgagcagtctagacattccaaggctgattcatggaggagcaggttgtgactcctaagtcctgggatctgctttaggcccagcagagctcacacagcttcgagcagtctagatgctccaaggctgattgatggaagcgcaggttccgactcctaagtcccagagactgcagtgagagataggcaaggctggtgccctctgtgagaggtttcttgcagagcagagtgtgggtgttgcctgggtgccagcaggctgagtgtcagatggtcgctttcacgtgctccatctcatgtagtcccggggtaactgggcctagaccacctcttacagatggagccggcagggctcagggaagatcagtaactttcccagtgtggactcctgcctcggaggcccattctctctccatttcactttcatagataaacataggctgccataaaaattggtggtctgtagaccccagttagggtggcagcgggtctgatcctgcagggcggatagaaaatgtgacccctttaccagataggagcttcctgctcacccctggacattcgtttccccctacaccctgccagcctcccaccctgcccaggaagcttctgtcctagctccctcccttgcgctgaagaagagggatttgctcacagcagttccaggtcatgtatcgggctcagggtgaatccagacttgggatgtgttcctctcctcaccaagcagctggaccagggagatggcttccccgagggagtgtcagcctccacgcgctccctccaggaccccagggcctacccgcctcaggcctcccctgcgcctgggtgtgcagcagttgagacatggagtgtttttcctgtgccaggtcctgtgcggcgtgacccaaagggactttaaccagcaaggcagccacgagggggctctaagcagggggctcaacacaccttccctacaggtgcaccatctccgtttctcatacttaccagcaaaagcagcagaagcagcaattggagaggttgccccttgggtcctgaacttttttcttttggatatgccaggcctggagaggggtgaaaatcaccaaccattggctgtacacataggcctgccccgcctcctggcactcaggttctaaatcaatatttaatctaaaataagtctcaccttcattttaacctgaattcaggccttattgagccccggggctctatcgaatggcttcttttcaactgtgggttgtagatgaactcccggcgggaagggccagcaggtgggtgtggtgaggccgattctgctttgctttgcgtgttctgtttacagaggatgccgggtttgctgtccgcaccatagccttgggcttggcagaaacagcaggcagcaaagcagatgctcggaaagggacatttgtctaaaactcaggggctgtcaagtgaaatcctgcaaaactacctgcctttttgtgataaagaaaaagcttatcagaagctcgctgcatgtacgaaagcagcaggttgtgcggagcaggcagccttcgagcaggacagtctggtcagcaaagaggctcatctcacagcgccggcctcgggcctgtccctgctgccgctgccgggccgctgctctttcgagtatccaggcaccgtgggggtgtcatagctgtgggtggttcctgtgtgctgagcgctcgctgctgtgtgtttccagcactcactgtgggcctggcccagggtgaacgtgcactcctctgctgcccaccccagccccatgaggtggggccagtctccttattggtcagaggctgaggttgtccagcaggcggctgttgaagctgacacccagccagacccccgtgtctccagagctcagtgtaccccttccctccccattggtctcctccagccccacaccagaggaaggggagggaggcatccagggatggtgtgtcctagagcaggcgggcaggattggatctgtgaactctgaatatttgttcctaaaagcattttcaacatgggctaatggaacgcatttggtctgtttctccccccaacatatgtggcgtgtttggagatttaacatcggcaaatgtttatggaagattattgagcacacccgtgaactgagctaagcatatacattcacgtatgcatgcacacatgaacacatatgtacatgtacacacatgtgcacggacacatacacacctgaatacatgcacacacctgcatacacacatgcatacctaaatagaacacacaacacacacacctaaatacacacacacgcacacatatctatacatacacacatgcacacacatatacatatacacctgaatacatgcacacacacgtttacctaaatacaacatacacctaaatacacatatgcacacatatgtacacatacacacatgcacacacgtatacctatacacctgaatacatgcacacatgcatacacacgtgcttacctaaatacacacaacatatacacacctaaatacacatatgcacacatacgtacacatacacacatgcaaacacatacatatacctatacacctgaatacatgcacacacatgcatacttaaatacacacaaacatgcacatacctaaatacacacacatgtacacatacctgtgcacatgtacaaataactacacacctgaatacatgcacacacatacatgcacacatgtacacacacgcacacgcacatacccaaatatgtacatgcaaaaatttgcatgtgcacacatacatcatatactcatacatatacctacatacctaaacacatgcacacaggcacatggctcacacatactacatgcatgtacgcatgcatatatacacgtgcatgcatacctaaatacaagtacaagcacacatgcataccaccatgcacacatacacatatgtacatacatgcacaacacatacatacctaaatacacacatacacatatgtacatacatgcacaacacatacatacctaaatacacacatgcacacatgcctgcacatatgcatatacacctaaatacaaacacatacacagaggtggcctcagggagggaggtgagtgtggggagggagggaggtgagtgtggggataggggaagaagggtggagggcaggacatggaacccacactaaatggaattctgcacagagggtgttatcatccttatgtaacaggcagaaagccgagactgagagtttttgaatgtcttccctgagacacgcactgatgagctggactggagaggcagacctcagcatctaactggaaatcccaccttcccaccagtcctgctctcagagctgagtctcaggcagcgtggctgaggtggcaaggggcctgggaaccaggccacactgctcccacatggcaagccctgtgctggaggaaagcgttcctgcaaatgcacctcatggttcctagtgccttttgggtgacaggctgcttctggaggctgatgaaaggtgcagacatgctctccacctacatacaggcagaatttcacctaggatttgggggcccaaggcaccccggaagtctcttacagaccccaccagctagcatcccatagagtcccagctaagaatccccacacctggaccatcctgtgctccccaggtttttgagtggataaagcgtagcctcccttgtctgtagagctctttgctaggtaaccttgctgcatcctgcttttgaagcttatgaatttgggggatttgaaggcactccatattcatgggatcccaacagagggaaccggggacttagatcgttttggaagtgccagctcacatggtaacattcactttgaaccactgtttgaaacagctggattaagacctaactcacatgtcatacaattcactcatttgaagtacacaattcagtgggtttcagtacattcacagagttgtgcagccatcaccacagtcaattttagaacatttccatcagcccccaaaacaccctgtaccgattagcagtcactcctcaatctccccaaaccacccacatacacctgcagccaaccccagctcttggcaaccagtaagctactttctacctctctaggtgtgcctatgtggacatttcatctaaataaatcgtacagtatgatgtcttttgtgactggcttctttcccttagcatgatgattgcaacgcatttgaaccacttttacgaagtaatcaatttgtgtgtttcatcagttctctttcacattgtttgttttaaaatctgacttcagaacttctccctttataggaaacaaacatgttgtattttgcccatgtggtttcttggaacagaagtgtaatttttttttttttagatggagttttgctctgtcgctcaggctggagtgcagtggcatgatctcagctccctctaacctccgcctcctgggttcaagcaattctcatgcctcggcttcccaagtagctgggattacaggcacctgacactatgcccagctgatttttggtatttttattagagacagggttttgccatattggccaggctggtctcgaactcctgacctcaagtgatccgcccacctcggcctcccaaaatgctgggattacaggcatgagccactgtgcccggccaggaagtgtatttttctgtgtagggtctaacggaacacaggccaaatgtcacaaggggatttggaaaggctgccatcttgacaattatgtccctcctagtccccaaccccactctagtcagaatcttctttttaaaaaatgctttattgagttataattcatatatcatataatttgcccatttagaatatacgattcaatggtttttagtattttcagtttttgcaatcatccccacaattttggaactttttcatcgctctaaaaagaaaccccataactctaccagtcacctcccattcccttctccctccaaaccctggcagccactttctgtctctatagatttgcctatcctgagcatttcatataacagactcatgcaatatgtggttttgtgattggcttatttcattcagcataatgttttcagagttcatcagggtcactgatatatgttgtagcacatatcagtacttcatttctatattatatggggggaaattccattgtatggatataccacatttaaaaatgcattcatcagttgatgaacatttgagtttgttgtgtctgggatccccaagagcactcccaagttcagtgattcactagaaggactcacagaattcagcacacaacatcctcatgactaagatttattacagcaaaagaatacagagcaaaatcacaaagggaaaatgtgcacagagcaaagtccagaggagaccagattcacgcttctaagagtcttctcctatagaggcacacagaacacacttagtcctccaccagagagctgtgaggacacataggaattgttgtctaccacggctttaccatagccttgcacttatagcaaactgcaactgcattgtaggtactgctgattagaaactcactgcccagggtttttatcggaagctggtcacataggcatcctctgccaagcatgtaccaaaactccagactccagaaagaaagcaggtgtttggcataaaccatattatttgtacagtttagacactgcagtcttataatttagggaaaacattttatcaatgaaaggaactttttaccagtcaagttcccagatgccaaccaagggtaatctttgaaagcaggtctttttaaggctagtggtctcagacctgctctgttaactttcttccacaccagattgtttctactttttggttactgtgaacaatattccctttatctggttgagtttggtgagtgtttttattatcgaaaggtttggagttttgtcagatggtttctctgtgtctgtctggatgttttttgtcctttgttctatttatatggtacattacattaactaatgtttggatgttaaaccaaccttgcattcctgcaataaatgcccattgttcatagtgtataatcctttctcttttttttattatacgttaagttttagggtacatgtgcacaacgtgcaggtttgttacatatatatacatgtgccatgttggtgtgctgcacccattaacttgtcatttaacattaggtatatctcctaatgctatccctcccacctccccccaccccacaacaggccccagtgtgtgatgttccccttcctgtgtccatgtgtgctcattgttcaattcccacctatgagtgagaacatgcggtgtttggttttttgtccttgcgatagtttgctgagaatgatggtttccagcttcatccatgaccctacaaaggacatgaattcatcattttttatggctgcatagtattccatggtgtatatgtgccacattttcttaatccagtctatcattgttggacatttgggttggttccaagtctttgctattgtaaatagtgccgcaataaacatacgtgtgtataatcctttctatatgttgctggattcagttttcaatattgctgagcatttttgtatctatacttataagggatataggtctgtagtttacttgtcttatttatctttgtgtgatttttatgtagggtaatattggccttattgaatgatttgggaagtatttcttccacaactggtattaattctttaaatgtttgatagatttcatcagtgaagtcctctggtctcgggcttttgtgtgtgggaaattgttaattactagttctatctgtttattggctatagatttattccgtttccccccccctctttttttttttgttaagtcagtgtcactcatttgtgtctttctaaggatttttaatgctacctcattaatctaatttattaagatacagttgcttatagttgtgtacagttgtttataatccttcatttctgtaaaggcagtggtaattaatatcaataattcattcctgattttaataatttgagtcctctctcctatttctggttaaagttttgtcaattttgttcatctttgcaaagaaccaacttgtagtttgattgattttctctattatttttctactttctatttcatttatttctactctaatctttatgactttcttctgcttaatttggagttaatttgctcgtcttctttcaatttcctaagttggaagtttatgttgttgatttgagatctttctttttttgtaaatacaggactttatggctaaaaattcccctctaagcactgtgttagctgaatctcataagttttaatatgttgtgtttttgttttcactcatctcaaaatatttttttaattttctgtgtaatttcttctttgacacattcgttatttaggagtgtgttttacatttcctcatatttgtgaatttcccacattttcttctgttatttatttctaattatatcctattttggtcagagaaaccataatttatatattttcagtcctttaaaattcattgggtcttattttaaggcctggcctatggtctatactggagaatgtttcctatccacttgagaagaatgtgttattctgctgttttggggtggagtgttctgtatgtgtctgtaggtctagctgatttatcatgttgtttccatcttctgtatgtatgatcttcttcccagttctgccatttgtcagtgcattgaaatctctatttgtattgaattgtctgtgtctcccttcaaatctattcatttaatttcatgtattttgaggctctgttaggtgcatgtgtgtttatagttatatcttcttgatatatttaccattttatcagatatttgctttctaataaagatatgtctcgtatctttattccctattttccactatcagcttctttttgttaaatgaattttccaaatatatcattttgatttccttgtttttgcttttgctctatatttttggatatttttgttagtgtcttactctagtattattatctacctcagatttatagtacattttcataacttatgggaactttactcctatagctgtatttcttccttttctttttgtgctattactatacatattttaccggtagattaatgatttttatcaaatttgggaaactttaagtcattattactttgagtgtttttgtttttgtttttgtttttgtttttttgcttttttctctttctcctctcattctgatattcttattatacgtatgttggtgctgttagtgctgtcttatatttatcaaaggctctgtccatttttaaaagtcttttcttcagactgcgtaatctctatcaatctatctttaagtgaactgattctttcttctgccagctcaagtctactattgagcctatctaatgaattttaaatttcagttattgtatttttcaactcaagaacttcccatttgtgtttttaaaataatttctatcactttattgatattcttcaattgtcatcatacctttaattttttaaacatggtctcctttagttctttgaacataattataatagctacctttgaagtctttgcctgcttagtccaatgtttgggcaccctcagaagctaccttctttttttttttttttcctgtgtatgcattatactttcctgggtttttttgaaaacagatcatttttggtcatatattgcagcaactctgaataatgatattcatgcctcattgagggttattgttgcttgcttgtttgttcagtgatttggctagattcattcagtgaagtccatttcccctgcactgtgtgtgctctcatgttgctcctcagtcttgggcaatgcatagagtcttgctgcctaccagggatgactgtggttttagctgggctccctttgcctgtccccattaagattctggatggtttaccatgattggcgtcatacccagcagttaacctccactacgtgctagctctggttttctcagcaatgccttagtgcatagattgctcctcactttctgatccagttgaagtccagcctttctgcagttgccagatgctgtcagtctttgaagcttgctctgacactaagaggcctcttcttagcttcagaagtctcttttcctggttctgtctttcaaactgctagctggttttaccgcttccattgttgctgacatggaactaccagcttcctcttcattcctcacctccaaagcctccacagttttcaacaatgtccttaggtatgctctgttccaaataaagtcattttcctcagtcagagctggaagctctctgttcttacagaataactctccactctgcgcaggacctctgtgtcactgcatcaaagtggaggtgaggacaatagccttcttcttccatagtgacacacccgctacacaagtggggcactgggttgagagggcagtccctggacttttgggcctgctcctcccagcgtgggacttcttcctacaaacaagctggggtgggagcactcggggcccagtattcttggcgtaccatacctggtacaggctcccagcttacaagcaaaggctggatgcgggacaggagccccagtactcttggccatctctgcctagaatagagcttcttcaacatggagttgggttgggggaaaggggaagctggataagagatgccagaactttcctctccaagttaaattcctaaaccagcagccctgccttgttgccacatctgcccagggtggaatttctgtcacactgagctgggggaattggatagggagagcaggtcatggctcaagcaccacagactctcactatcgagtgagatttagcgcagatcttgtatcaatctatctttctccatttgctatctactctgagcaccatttccaaatactttttttttttttttttttttttgagagggagtcttgctctgtcacccgggctggagtgcagtggtgcgatctcagctcactgcaacctctgccttctcagttcaaacaattctcccacctcagcctcccaagtagctgtgatcacaggtgtgcgccaccacacccagctaatttttgtatttttagtagagacggggtttcgccatgttggccaggctggtctcgaactcctgacctcaagtgatccgcctgcctggtcctgtcagaaggctgggattacaggcgtgagccactgcacccagccttcagagattttagatggttatttataaaatacttttcaccagttaaatcattgttccgctggggagagggtctgctgacctcctcacattgccattccagaaatatcctggccttcatggctagtaactctgatattcagaggggactgggaagaaatgtgggctttggcctggtgccttaactccaagtttacagaaacggaatccagtcccagaactgcagaaaaggctgttagagaagaaagcattgcagggaaagcagaccgagggttgctcagcaatggaataaacccaaaagctgtagcattggttttcaaataggactatcaaaaaagtggcttggatttcgacgagggtttaagacgtttatcctctctactggagacagcttgtagatttgagtacaatataaaccgaaatgttgggaataaagagtaatgtacgtcctcggccctggcttcaagccagtgttttgacacagcatttttgttggtgaaagccgtggacagaggcaggcttctgctcaccgtcttctccagggcccaggggataaggagtgagaagccctttgtggtctctgctagaaaaactctcctgagaagcgaagatttcactaagaaaacagtgaggccatccttttatcccccaggacatttttaaaccactctcagaactattgctaaagtgaaaattctgcagatccgttcccaggtgctcaggagccttcctgatcggaggtgctcctctgaattatgtcctaagtgtcacacgacgcatgctgtggctatttctgtttttctgtttagaaacaagagggtttgtcacggttttatcacatggctgcttctgaatgatatctgccgttcaaatcacatgttaaagattgttttcgaaatccaaagaaactgttttcaaaatccctcctgctcccaccagcttagaccaaccccatcgtacccaattaattccttaataatatttgagtctttcatcttgccaacgtaatacccaaagtgttgagattatctttattagctgctttccaggcgtctgtgcacctttagaaactctcgcagtcggtctgatactgcatccaatcactttctgtccttctacagtttcccgggaaaccgacacacgttgctacttcacatcacacaggaaacttaccaaaaacagactctgcagcatttccattttgtcaataattctaactcactaaaatacatccccattaaaaaataataatgtcatataaataataaacagagcaggcagcaggaggaagaatgacattttaagattgtgctttctcaaagaggcaatgacaggggctgagcaggagccaggaaacccagcttttagcttcagctctgcctgacatttattggtcatgtggctctgggtgtattctcacttctcctccctaaatagcaagaaggaaaagcctcttggagcctcgtgtctctgcttctttctgtacaatggttatgttctgtccgattagctgttattatagaatcacctggctgggtctgtgggcactggccactcagaactcacggcctcccagctttcctccccagaacaaagcactcttcccttccagctgcattgtgaaaaatcccaaggcaagactctgattggctgagctgaagccacatgcccagctattagccaatcacggttttctgagaggcaagctagcctatccatgtggtggggaagaactgcttccttcaaagaaggggttgaggcctagacacaaacaacaggaatcactgcgagttggacgaccaagcactcccaatttgtgtctcccgccaggcccccttcttggcacccacatgtgtcacagacccttctcttgagactacaggacttttagatctttggctgaggaaacatcaggatacatagcaacatatatacaagccgtgaaggaaatggtataaacacgcagatgggtgtgggccatgtgctacactcattctctaagcagttctggacatgctcttggaaatgtggactccagtgagagctcagcagtcccttccgaaccacccctaggccccacccagtgtgaaccctgcttccctacagcctggcagctgcaggaggaggggtgggcaggggtgtacacagggcagagagatgcccaaagggtcaccgagtgggtgcaagacagactaactgaattcgtagcatgccctcccactgaaattgctgatttccccaccatgcagagacgctttccatataagactcacccatataaatagcgtttctctatcttttctacaactggggttgaaggtatctcctccctgctactaaaaggactttatttctgccacctttggctgagaaaccaggctggttttggccccggtctggccccggccagtatgaccctaagaaggtcacttgcatttgtggatgttgattgtttcagacccaagacgaggaaattgaatccagtcaccacttctctcgtttttccccactaggatcccttgtggtagggaagttgaatggggaagacccccgggacctgggaatatagtcaaaagagggtgaaagtcttgaacctcatatttgaccttcagatgataatgaaccctaaccccagtttgtgaaacctagcactaaatttctgtcattcgttcctaaatattctgtgaatttctcgtgagaaaagtgattccttcactatatttcaatacatgtgattttccctaagtttcaggaagtttagattccaagttggtctctaaagaagtaacaaacccaattcaggggctaatcatggagattcctttggcttccttcagatgatctttgttctcttttcttccgttttagtttacgcagagcttaaccttgtaagccacctcaaggcccctagaaaacagatgaagaataaatcttaaacaggccaggtgcaggggctcacacctgtaatctcggcactttgggaggccgaggtgggcaaatcagctgaggtcaggagttcgagaccagcctggccaacacggtgaaaccccatctctactaaaaatacaaaaattagccaggtgtggtggcgggcacctgtaatcccagataggaggctgaggcacgagaatagcttgaacccaggaggcagaggttacagtgagccaagatcgtaccactgcactctagcctgggctacaagagtgaaactctgtctcaaaaataaataaataaatcttaaacagccacaaatacagatccctgatctcttagctgaaacccttgaggctagatatatttaagaatccagtgtttctcaagtttgggagtacatcatatattagggaactgctccagtagggccgggccagcgcttggcgaccaaacacattggtcttcttgtagcagaatatgagaatattcacactgaatagccctacatcagctcacctaggggtaagctgccaggttagctcaagtcagctcagccttcgccaccaaatgagttataaaaaaaccttttgagtttcagagcgttgtgggttttggaatttggaatggagggttgtacacctgttgcgcggatcctagagagaagcctggaactaggaggaagttacaggatctgcggaggtgggtgaacccgaggggttggggagctcaggtgcaggctcccacccagcctctctcgctgagccttgcttctttattcataaagtgggaattgtaacatctgcatcataggatcctcagccagttgcagagatcatgcccgggcattaatctggtatgtaatcggtgttcccgaaaaaggagccactgccacgtttatcatcgtcacccgatgaaggagaagctggctgctctggggtctctgtgtgtgtgggaagatgtgttcatcgtcacctgatggagaagctggctgctccggggtctctgtgtgtgtgggaagatgtgttcatcgtcacctgatggagaagctggctgctccggggcctctgtgtgtgtgggaagatgtgttcatcgtcacctgatggagaagctggctgctccagggcctcggtgtgtgtgggaagatgtgttcatcgtcacctgatggagaagctggctgctccggggcctcggtgtgtgtgggaagatgtgttcatcgtcacctgatggagaagctggctgctccggggcctcggtgtgtgtgggaagttgtgttcatcgtcacctgatggagaagctggctgctccggggtctctgtgtgtgtgggaagatgtgttcatcgtcacctgatggagaagctggctgctccggggtctctgtgtgtgggaagatgtgttcatcgtcacctgatggagaagctggctgctccggggcctctgtgtgtgtgggaagatgtgttcatcgtcacctgatggagaagctggctgctccggggtctctgggtgtgtgggaagatgtgttcatcgtcacctgatagggaagctggctgctccagggtctctgcgtgtgtgggaggatgtgttcatcgtcacctgatggagaagctggctgctccggggtctctgtgtgtgtgggaagatgtgttcatcgtcacctgatggagaagctggctgctccggggtctctgcatgtgtgggaggatgtgttcatcgtcacctgatggagaagctggctgctccggggtctcggtgtgtgtgggaagatgtgtcttacgtctgcaattctcctaaatgcagaggagccacagatggattcagctgttctgtgtattgtaccataagccaaacagtttatacttaatgttcggagaagtcccaaatctgtgactcgctgttagtttcatgtaaatattccagtttgaggtagattttcagcctgtgtccccaaatcccaggaacctctggctccctgctacgcctccatggggtttctgcacagcctggaggctgaccactctcacagggctccgggacagatccaagtccctaggtgccggacggtgtcggctcatggatcagagcttcctgcccgggtgctgatgtgggtaattcactctgactctcagatgagggagcagctggcaggaacatcactcaccgcacccagggacgcttttgttttcctgggtctcagtgtggacctcctgcaaaattaggggagctggcaactctcccatcccctgcccacccccgcctccagctgcaaggacgcagctcacacaccctggggaaaccggattggcagttttccttctagagtgtttacttctgaaagagctgctgtggctggcaatggggcccacatctggggccacagccgtctgtcttaacacccacaaggcgcagctcctagcctggccgctgatgggaatcctcagagagcctgtaaaagaatgcacattccccggcctccgacagacccacagagtcaggatagctggagccactcccaggaatctgctgcctcgatacacagctgatgatcctcagatggcatttcaaggccgctcactcttttaccccctccccagttcccttgataccctctggggagaggaaaaggtcaggtctgcctgacccctgtgagagacgggggccctgggaagcgtcttagcgttagttccgcagcagcgccttggtctctgtgccaccaggtggatcccctaggagcctgggaagctgttaggacgcacaggtgagggtcccaggatgcttccatgcatcgggaggatgtggcacttatcagcaaaaccgagaaacctccaccttcttaggggaaaaaaaaatcaatttcaccctctgctttctcctttttttttttttttttttttttttttttgagatggagtctggctctgtcacccaggctggagtgcagtggcgagatctcggctcactgcaacctcaagaatcccttgaacccgggttcaagggattctcctgcctcagcctcccaagtagctggtattacaggcacccaccaccatgcccagctaatttttgtatttttagcagagacaggtttcaccgtgttggacaggctggtctcgaactcctgacctcaggtgatctgccgacctcaggtgatccgctcgcctcagccacccaaagtccactttctcctttaacggtccttccaatgacttcacatcaaaccgaaagaccataaaatagaggtttgctttcagaaaatgaacctagaaaacatgcagggtccatgttcttaatggaagctgctgatttattttataaaaaggaaaaaaaaaagcctcaaagggactgatcttcaaacatcagtgggaggcctcaggccacttttccgtgtgtttgaggggccaggccattcagtacctggccggggagacatattagacaccctggcttattcaggcagcttcatttctccgtcccctccccaccctcggaggtctctgtggatgtgatgtcacacgatcacttgcaaggggaggatgcaccccccaatcctctcccctcatcacctcccccatcccctcccttctacttaatcacaccccaccccctcccctcccctctacctcatcacctccaccccctctcctcccctcccttctacctcatcaccccctacccctcccctcccctctacctaatcacctccccaccccctcccctcccttctacctcatcacccccaccccctctcctcccctcccctctacctcatcaccccccaccccctcccctcccttctacctcatcacccaccacccccttccctccccgccacctcatcaccccccacacccaccctcccctctacctcatcacctccccacccctcacctccacctcatcaccccccaccccctcccctcccctcccttctacctcatcaccccccaccccttccctcccctccacctcatcacccccacacccaccctccctgctacctcatcacccccccaccccctccttcccctctacctcatcaccttgcccacccgcttccctgtacctggtcacctccagaatccttttgttttggtctgtagcagcccacatcttagtctcaggcaagccaaagacccagatcttccccacccctggggctcttctatgttctgccctgtaggggcaggcagagtcccctggggcctgtgtggggaggctgcgtagacctctgctgggtggggaggccacctagatctttgctggggtgggaaggctgtgtagacctctcctgagtggggaggccgcgtagacctctcttgagtgagggagtccgcgtagatctctcctgagtggggaggccacgtagacctctcctgagtggggaggccgcgtagacgcctcctgagtggggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtgggggaggccgcgtagacctctcctgagtgggggaggccgcgtagacctctcctgagtggggaggccgcgtagacctctcctgagtgagggtggccgcgtagaactctcctgagtgggggaggccgcgtagacctctcctgagtgggggaggccgcgtagacctctcctgagtggggaggccgcgtagacctctcctgagtggggaggccgcgtagacctctcctgagtggggaggccgtgtagacctctcctgagtgagggaggccgcgtagatctctcctgagtgaggaggccgtgtagatctctcctgagtgagggaggccgtgtggacctctcctggggtaaggaaggccgcgtggacctctcctggggtaaggaaggccgcgtggacctctcctgagtgagggaggccgcgtggacctctcctgagtgagggaggccgcgtggacctctcctgagtgagggaggccgcgtggacctctcctgagtgagggaggccgcgtggacctctcctgagtggggaggccgcgtggacctctcctgagtgagggaagccgtgtggacctctcctggggtaaggaaggccgtgtagacctctcctgagtgagggaggctgcgtagatctctcctgagtggggaggcggtgtggacctctcctggggtaaggaaggccgtgtagacctctcctgagtgagggaggccgtgtagacctctcctggggtgaggagaccatgtagattgctcctgagtggggaggctgcatagacctctcctgggtggaggcccagctcttctcggaaacctggtacagagtgaggggctggatgcagctgagaaaatgcagtgtcggtcacacctggatcagggagggggacctgggggctgcctgctctcctgtgtggagggtgggagggcctggcattgggttggggtggggagagggctggagaccgcgacacacgcccctggggaggtgcccccaccgccaggcctcctgcccagcacgctccgggccctgcgccctgccctgcactcacaccttctctcccgctccccgcaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaa

SEQ ID NO: 1210 - DNA, 139315 bp, Homo sapiens
gggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatggtaggtccagggttcgcgccttcgggagccttgctgcctcccaggttggcctttccaatgcaaacaatttggattgttgtcgcttttaacttaattttcaaaccactttcttttgcagttgagggaaacaaaacaaaattgtttttcagtcactgagcacttatatggccaatttcagcctggagtggatttttacagcctaattatgaacctgtactgagtttccctcataactctgccgtgggcagtgctggggagaggcagcagaggctggggcggggccgagctgtggatgtcagctgtggacgctcctcttggcaggggctccacacacttcgtgtagtgcccccttatctggcaacacatcccaggaccccagggaatgcctgaaactgcagataaaaggagactactatagtttaaaaaatccacagtggacctcatgccttacttccctcggtactgccccgtctcactgtttgcattgtgggaggtaattagaggttatagaaagccccgtgctggatggcccagggtccccagctccctgagtttctggacctgaatcacaaggacgccttgccagctttgttttcatggaactctaaatcatcggtaaatatgttttcccactctgcagatgtcaaacacataaaggttagcgcctttacattttcattattaaacagactgtaatgaatacatcagggagagaaatgcggatctctcccgccacaacacccaccctggggatcggagtggctgaagaagtgaaacacctgtaggttttcttaagcatctttgctgagtaactaaatgagcccgaaagtcctcttaactgctgagtggaaagcactctctccacgttgctgagagagtgccacccctgatcctcgcctcgcctcacggagagacgggaaccctgcagaaggctttgtccatccttccctgacacaaggtctcaggctagagggagatccaggagggaatgggaatgtgggtgttgtttccttgcaaaactatctcctgctccagtgtattccaggtttcccagatgaaagtaaaaatgggcctattagaaactgtgtgtaacagcaggcccactgcaactgttccctcctgaagcaggcgctggtgagtcctggaatgccgctgcttcctctcccacagcgctcctgtagacatgccttcctcctctgctttccagcataatccccataaacagcctgggagagggctcaggggagcaacgctgcttaagtctgaagtcagcgtttgcgtatctgtgacttagtcctagttgggagcctgtggcctcctacagacatttatttcaccccaaaataggcgtcataacacacattcagaatttaaaatactgttcccagcttcatagccagggacagacgtcagcggcccagaacgacgaacatacatccttttattttgatattgattgtttcatgcccattgcctcttacctgggaatcggtcagttattaattccaacaagaagctctcatactggccacacacttacttgcctgttcgtttaagtaaatgtattttatgagggccacaaccctattattcagcagttccaccacacctagctgctttttcagttattggtgccccgaaccacacacaagaattattatatgcatttgtgcacaccaactcttaattatctaggatgatgcaggagagaggtggcatgcctacgagagaaatgattgaggatacacatgttatttcatcagaaattgtaacctccgttagagttgggaggaacttcaggccgcctcatctaccacctgctttgcagatgtcaaacccagtaagggaatccgagctcagatgagggaaatccttcctctcaacctgatgtttgctctcagagtcatttagtgactggtctacttgtgtcctggtaggctggttacactcacactattcctggcatagttcgtgaaccctgcttttgagtcttggaaagcagacgggcagggtttaaagggaagtgtttgctcaagatccttagggagccacactaccagtgacattccaaaagtcatcagtccaaaactttagggggttctaaacccacgacagtgtagcctgtggtagttactgcagccagctgaccctcggaatcctgtgtaacctgtcacgcacccaaggaacactgtcttgagatctgaatccctgtggtttttcccttcagccccaggcccaccagtgaggctcgtgttccccgaagtgagactcacctccgtgcggatagtgtggcaacctccggaggagcccaacggcatcatcctgggtaagggagcggcggtggccgggcgtggtggctcaggcctgtcatcccagcaccttgggagaccgaggcaggtggtttgcttgagcccaggagttcaagaccagcctgggcaacattgtgagaccccatctctccaaagaaaaaattcagactattagccgggcatgatggcatgcacctgttggtcccagctacttgggaggctaaggtgggaggatcgcttgagcccaggaggttgaggctgcagtgagccaagattgcatcactgcactccagcctgagagagagtgcaagaccctatccccaaaataagaaaaaaaaaggagtgatggtatttaaaaggagagaaataacaatcaagttgatgtcttccgtgtttgttagatgtttatgaggttaaacaaaaggctgtctccagcagcctagcatttcctgaaccgagatgatcatgggcctcttgactgttttctgagctacgtactaaaggtttttcttatggaatgaaattcacatttttttaacgtggaatttcttccattcgtttgcggctcatggcgataccgtttgtaaccgaccttcccttcctctctgaaatatcaggctatgttgatgtgtgtttgagaaacaacaggctagtttttcagagaagatgcagacctagccttggttcccatgttcctggaaacatctttctgctgcagcacttgcacccaatccttgtaagaagccgctgagatgaagcgcatgccctgggtcccggggaacgcgtttacttctgacttttcagcattacagccagcataccaactctggtaacacagatgaaaagcctgaatttttccgttccccaaagcaacaaattctattttaaaacatcccagttccttgactcattcaccctttcacagagacaaagtaaggactttccctgtgcaggtgtcgtatgtacagtggggggtgaggaatgaatgaggtgtgcctgtcctcaagttgcccacagtcccgtaagggagacacatgttgagagtacagtgagataagccatctgaaagaggtttcattcagtgcctcacacacagctccttctgggtggggtctctgtgggtggaagtctccttttgagagggatctggagataggtggcttctaaagccttggaagaagggaagggggctgtccactcagccaagaccgaatgctttcagcctttgggagcactgacagctccaaggctggggatggaggctgggccgggtcttgagctactgtgagctccctgctgtgtcctggagaatgtggccctgagacctggacgttttaaactggcctgttagaggcaagtgcagcagccacagaacattgccccagccccaggttagctctcgggatattgccataccagacaccccgattcggctagcctgtgttctaggtgatttacggtaaagttataaacccagacttacaaacaggtggtaaaattcaccacttttgcctgcatttgatcttaggattctaagacttggtttgaagaaagagtttcacatcactaaaaaaaagtttggaggcctgtgttgaacggcagcaggaattcatccaaggtctttgagtgggaaagctgcgcaatcagatttgccttgtaggtaatcactccggcagcctgagaagggtggacggaaagtcagatatttattgagcccttgcttccctgagagggggcctggagcttcctaagtcttctgcacaaggaggctgtgacctattttcgctttgcctctttctttatgtgatttctggagttgctagacagaagtgtttggctttgagtacggcatttctcaatcaggtgacctttggaattgcgggttcctgctactaaaatctcagttgagcagccaccttggaggtgagcatttcagggcctggcccggcggagagggagctatgagccacatctggtgcctgcgcagtgagcccagtcttggggtaggaaatggtctgcccagcagacagctgtggcgaggagatttgcaggagccccacccaggcaggccctaacctcagcacagcacccaggcatcagccttttctggaacaagcagggctaatatctgattacccgggagctgtccccagcatgctgtgaaacaagaaacattgacagagtcacaggagtccacaacaacagtgttccccgtgaagaagcaggctcgccccagccccacctccaccctggcagggcccctggctcccactgccggcctcggtagaccctcccggcaagtcctcactctatggtcacctccgtccactcactgtcagcttaccgggctgccaaggatcagttctggagtgcggaggcgtgggagcggtgcaggagcaaagcatgtgcttcatctgtgcttctctcttgccacagacggacgcgtgctcagattccagtactgtgactttgacccagggcgtccttgcacacgtggggaggctctggcctcagccggctctaggccccgccctctgcctgacacccacttcagggcatctgccctttctgaggactcacgccgatgtcctctgtagccccgggtcctcactgccccgctccctgcacgtgtctacctggtgaggcttctcctcagcacgcccgccggagtgaggcccgctgtccactgagcccatcagctggttttatcatctgtcgtttactttccagactgtctctgacatttctttttccgatgacaagagcactataaaatgataattgaggccacaatgaaatcccatttcacattcgccagatttggcaccataagtagctgtgataatgccaagtttacatgaggatctggagaaacaagacccctacacccttgccaggagcgggagtttgtgcgtccactttggggagtgctcaccaggaaaggtgagcgcattcacactgcaccccagacgctctgcacttccaggccttcgccctagagaaattcttgcctgtgtgcacaaggagaaacgtacaaggatgttcattacagattcactgaaatagcaagaaagaaagcagctgtcgtctgcacaagtcagatggcacgaaccttggggctgcctgcttttcctttcccctgtgttttcaacactgcatcacggacaagtaggccggcagcctgggtaacgttttggactcagatctcagcctatgcttattagctgagtgaatttatgcgtgtttcttagcattcccatgcctcagtttccccatccctcaaaggggaagcacattcgtgcctccctcactggttagagttgcacttagaacagtgcctgccacatagtgagtgctgagtaaacgttagcttccgtatcagatcgaatatttcatcgtttccctggcaccagaggaggctggaggctccctggacttgagagctcctcctagaccattgggggctcagcctggtcctagtattcccgttgcatgcagcagtggtgtgctgccttgatttgtcctccataactctggttgctgaagcagaggcttcttgccgacaagagaaagaaaacttagaaggctgcttgggttacagagtgttcctaaagtgcgtcgggaggtatggatcttgatttgtggtcactgaaagccactgaagcccaagtgaggagaaggataatcacttaaatactttgagccctccaaccgtgctgaacgctgctgaatcacacagcaccgtgtctacctgcgaggcagacaacgtcactgccgagcctcctctgtcatgcagcattggcttgtaattgtaatgcatgttgtccgggtaacctgtcacccatgggtcattacagccggcacaccacacggcggaggctgcaggaagacaggaagacaattcctgcaaattcagatgggtgttcacaggggagaaagcaaaacatcttttcgtctgactcactttacatccagagaccttgaatcaatgttcccactctggcagcttggccttctgagtacataaacacctctgccgcccgagcttttgtaatctatatcaaaacatgttcttgcatttccaaaagagattaacagcgtgaaccacagcaggcacctagaggagaaaacacttgcttatttgcgtaaatattttactgtggagtgcttttagcatttagaacttttctttggggggatggggttggaaccccctgagtacagacgtccctccctcacccaccagctgacaccacatggccttgactggtattacgctaacgtgatgatgcgtgagctcttcagacccacttgggcctgccctggccagacacgcgggatcccgccctgccagcaggagggcctaacatttacctttaagcttattacgaagggtgtgcgggaactctgcggagaatcaggagctccagcaagtatgatccctgttggcagattcagcgttttgatccccagcccttggatggataagctgcaaaacccacaggccacggcatctaggctcggccagcgtgggcgtcctggggcgattcagtggcttgcgggttctctgacccacttgcccaccaacagcagctgcagagagatcggcagcacgtgccccagatggtcgtgctttggagtcatgagcgctggggtcccagtgatgctcactgaacagcaactctcagacaatgccttttgtttcccagggaagtgcacaatttattaaaggtttgcaactagctgggcacggtggcacacacctgtaatcccagctactcagggggctgaggcatgagaatggcttgaacccgggaggcggaggttgcagtgagccaagatcgtgccactgcactccagcctgggtgacagagcgagactctatctcaaaggctttgcagccacctaaaacgtccggatagaagtctccaaattgctctgtgtatagctgtgcggcgtcagtcttcaggctgacctggagctgagatgcctacaaggcttccagtatccagcctcagctccttagtgccaccttcttgtgtctcgagcagtggacggttctggaacttgtctcaggcccgtggcgcagtccctttctggattctgattgtctaaatgtgcagtgccacctccgtcttccaggtgtattcagaaacccactcaggcctctcacttgatgtttttaatcttccatttggatcaatgtgtctcgtacttggccttgctccttttaatgctcatattatcataattcacccatacccttaaaaacagggctcctcgtaagccgcattttactgctgctattgattcggcctgttcattcctccctcgcacacgccgccgtcttctggccttgcgtcgctgaagtgcagcgcactgatgtttctgatctcgctgtaaccgtaattacataactagccttttccacagaaacgctcttatctctgaacaccatctatcattattctctaaaaatgcaaggactgctactcagctgctcctttgtgccatttatgtacagaaaaaaagctgtcttctattgtccatcgagtctaggactttttaaacgtgtcaaggtgagctataggcattcatctttatgttcagcagaccgtggtgtggcgaccagctgatattatctttattttagggcaaataataggaaggtacaaatagaacacacaggccaaggagttttcttccagtgcctagggaaccagatcagagagagaagaagaacccagatttctgcaattagcagggatgccgtcgtgctttgcaatctgcatacattgtctcactggggctttgccaggcctgcatcctaaaggtcaggggaggggagggcgaccccactgcaaactccccccttcctacttgggtccagcggcactgccacgcagtgcactattaaacagtcattaaaattcatgcttctaaagggaaaacatgcttttgttatgttgtgcagaaatcgcagaatgaaaaactcatactgagtgtggaaatccgggtttgttgagtactcatatgcgtagaaaaatgattaccaaaggccaggcatggtggctcatgcctgtaatcccagcactttgggaggctgagaagggtggatccacgtgaggtcaggagttcgagaccagcctggccaacatggtgaaaccccgtttctactaaaaatacaaaaattagctgggcatgttggcacacacctgtaatcccacctacttgggaggctgaggcaggagaagcatttgaacctgggaggcagaggttgcagtatagccgagatcataccattacactccagcctgggcaacaatagtgaaactctgtctcaaaaaaaaaaaagagagagaaagaaagaagaaggaaggagggaaggaaaagaaaagaaaagaaaattgatgactaaaaaaagtcccaagacagctacagttatctctgagtggcagcatggtcctcctgcagaccagcataccatcaccccagcttccaggccatcacctgggactctgcccaggggctttctgtggctgccggagcctgctaggttttgaggactgggccatacattcaaggggtgcccccaacagcccttagccaaccgctgagaggcagtgggcgcacactgcagctccccccgtgtcatgtgttggggacgaggctaacaggttctccaccggcccccacagtgggaggagcccagccccacggcccctgccttgatgcacacacgttcatcagcttcttctccgtgtcacttctctacccaccccccatttcctggagtgacctcccaaatcgccacttgcactccagtcctggcctcaaggtctgttcgtggggcacccaccctagggccaaaggtgatttcatgggtttttttttcctgctttttttgggtggcttttatacaaaagaagcatctatctatctgtatgtataaacaactatatatgtgtgtatatatgtacgtgtgtgtgtatatgtgtgtgtgtatatgtgtgtgtgtgtatgtatatatgtgtgtgtatatgtgtgtgtatatgtatatatgtgtgtgtatatgtgtgtgtatatatgtgtgtgtgtatatgtatatatgtgtgtgtatgtgtgtgtgtatatatgtgtgtgtatatgtatatatgtgtgtatatgtgtgtgtgtatgtgtgtgtatatgtatatatgtgtgtgtatatgtgtgtgtgtatatgtatatatgtgtgtgtatatgtgtgtgtgtatatgtgtgtgtgtatatgtgtgtgtgtgtatgtgtgtgtgtgtatgtgtgtgtgtgtgtatgtgtgtgtgtgtgtatgtgtgtgtgtgtgtgtgtgtataatcttgaaaagctgaagccccaggagcgctatgggactgaggggctgagagctttagcaccgcatcagagggcctcgccctgcgctgtctgggctgtcttggagctgggtggagccctcgggactcaggcagggagagtccatcgatgggaacgatctggtaatggggcagggccccaggcctccctgaacaacaagaccccactgttctcccatgagcctattcattgtgcacctctgggccagctctgcaaacggtgattcctgccaggcccacactctggaagtgtgacctccagagtgccttgtccccctgtcaccacctccctgggagcacacaggttcccttcctcgtgctctggctgctgcagacagtggcgctgctcctgcaggccttctctgccgccccgctccaccccagcctgcacctcacaggctgctcgtccccctctcagatcagtggctttgcctctggcccccgctgcatagcgctctccctgggcccacctcagctgacctctttcctgatgttactccccaaggctcttcccgaggactctctttctttggcactttctggaacaattcagcctccccagatgggagccctcacatgctggaggcgtggctctggagctgggcccaagtgggacccccggccccacgatgaggggctgtttcttgatgttttgcagtttcccccactctgtgtcggtcaccttcagaatgtcctgctgagtgactttctctgaattgttttctgtttttttctcccttttctttaatcatcagaatcccatcatactgcagcaggggggagctgaggccaacagcagggtatcctgggaagagctggggctcgatgccgagggaccccagccctgccctgtttactgtgtgctcgtgggcacccagcccctccttgcctgcaaatgtgaaatggaaacaggaatatctgcctggggaatgtcatgaagtcttaatatggtagctatgaagtgcctggaatatagaggcccctaataagctgtgtctccattttaaaaaatgattaatagaggccagacacagtggctcatacctgcaatcccagcactttgagaggctgaggcagaaggatcgcttgagccgaggagttcaagaccagcctgtgcaacatagtgagaccccatctctattttaaatttttaaaaaaatgattaataccaagagatgagaactgagagtcaggcagagattagaatttgcctgagggctgggtcaggagccaggtctcccggctccctgctgtctagtcaggagcttctgagagagaggcaaggaccacacacgaaaaacaatccacaaacccgaggcagtgtatcctccaaggcaagtgaggtgaggcccacgtggggcagtgaaggggcaagtgcataaccacatgatggaagcctgtgtagtctgcggcatggccaaaggcagggctcaccttggaggacagaagagtcaggtggggccattgatagaaaggagggtctgtaagcaaacctcagacagcttggcaagaagaaaccagttcccacataatccccaaatcctgtgatccacaaggagtgcctttgaacaacatcttcatttcatctcaggattattacctctagcaatggaataatctgggcagagataaaacatggtgaaacagtaaagattaaacaataatgaaaacacgtctgtaaccatgccctgctcctgaaagtaaataatacctcattaattcagacatagtcactgaaaggcaatttggattttgagcgagaagtcttaatcacacacaactctccaacatattaagtaatgaatcaagggaactcaggtaggctggtgggatccataggaaaggcatgttcctggccatcggggatgctggggaaggccctcgttagtcgtctgtcggggccaggcctccaagcatcttccacacagggctttctctttctcttttagggataggcatgtttttgttgttgtttttgagacagagtctcgctcagtcgcccaggctggagtgcagtggcgtgatcttggctcactgcaacctccgcctcccgggttcaagtgattctcctgcctcagcctcccgagcagttggcattacaggcacctgccaccatgcctggctaatttttgtatttttagtagaggcggggtttcaccatcttggccagggtggtcttgaactcctgaccttttgatccacctgcctcggcctcccaaagtgctgggatcataggtgtgagccactgcgccctgccgggataggcatgttttttcacacggtgaagaagaaatctttttagccacttgtgcaaaatcagtgagatgatcccacctcgacagtgtggagggagcaggctgaaccctacgcatacatacatgagtctgtttttaatgcaaacttgatttttgctgccttagcgaaagattcgtatctcttcatctctaggaacgatattcagatgcctgaacttaacactgggttacacatcattcttggtggttttggttttgcgtttttgttttttgttttgttttctgtttttgctggagacagagtcttgctctgtcacccaggctggagtgcagtgacgtgatctcggctcaccgcagcctccgcctcccgggttcaagcgattctcctgcctcagcctcctgagtagctgggattacaagcgcccgccatcacgcccggctaatttttgtatttttagtagagacagggtttcaccattttggtcaggctggcctcgaactcctgaccttgtgatccgcccacctcggcctcccaaagtgctgagattacagccatgagccactgtgccctgctaaagttttgtatttttagcagagacagggtttcaccatgttggccaggctggtctcaaagtcttgacctcaagtgatccaccctccttggcctcccaaaatgctgggattacaggcgtgagccactgtgcctggctgctttgcactctttacctggcacatttgcatgatttttgagccatgtgaatgttacacagctcaagaaatcataacaatattgaatgtctttagacaaaaggcagcttaagcctagaaggtctccaagatgaacatcgattatgtggccagagatgctttttccaggcagaacacagccgcccagagacctcagaattagggtcattctcccagccccgaggaagcaggacattgttggggaatttacattttaagggggaactccgacccagggagtcctgttctgaggcacacgctgtaggtagttaactcaatcaggcattgcaaagttgggggtgtcactcctcagggctgggctaggggcttggccatgtctgttctgggcccctgtgctgcttccggtgggcattcagcaccctgtcctggagctgcaggggcctaaggcaccacgcccatatcagtgcctgtggacaggtccggggaataaggttccatggaggctgtgaggaatgataactctgtggtcataccggccaccacagggtgaggaactgctagggaaggggtcttgccagctggaggagggaggagaagtcgtgactgcaattgttttataataatattaaagccaggagcaaccaggcatggctgtgccagccaggtcattaccaccgtgagcccccagagccctcctggcaccccgtgaggtgtcctgccatatccttgcaccatgtagtccagcaaactgaggctgggagaggctgcatggctcatccacggtcacacagtgaatgattggcagagcgggattccagcccagaggtgcacccccaaaggtgtgtccttcctttgaagggcccgctagcttctattggagaggatgcttctgcgcagtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatcttggagcttcacagcctcgtcctcatccttgtcttgtatgcttcctgacaggcctgcggcgagggtctggcatgggaagcgttgcagggatgcagcagggtccctggatgtgcctagcagtgtagccgctgtggtcacgctctcctcaccgtcagagtgcggggcggccaggagccccgaagcctcagactgagcttccattgtgtgtgcacggctgactccctactctcactgtgcaagggtcggggaaacgggaggcctgtgggaagagctggccctctccctactctcactacacaggggtgtgggggaaggggaggcgtgggggaaggggaggccgggggaaagagctggccgccgtctctaggctgccctcggtcagtcagtgactgggaaggaacaggagtctagcagggacacccttgccagagacctgaggccagcagggccacatccaggaagtctcagaactcccggtccccattgtggggaagacagcccgtccactggaggcagggcagcggctgcgacagccactctgggggcctaagttcagggtcctgcagacacctgcgcctagaggtggctgcgtcatggacagggcagggcgtgtgtccctgtctgtgtggcggtgatgacggtgctgatggtgagcggtgatgcctggggcctgatgtgaggatgcccttgaggtctgatctccgtgtaattgtcctcccacctcccagatggcgggctggggaggggtttgttaaatgcgtggatgagtgacaaggcgcaggagctgggaggatgcctgtgagctcggtcgttcatgaaccagagacctgagagcaggaagagctgagagagggaggggttcacccggaacagaggctgagggcagggggcaagcagcgtggggtcgcccggcagctcctccccacagagggtgagccaccagtgcagaggccactccacgaagaggcagcactgatgagaccggagcgcggctctgttccccccgtgcgtcctcccttgtttaactccagcagttgattttttttggaagccacagcgccccgtcatttctggttttaatcagcgcaggagctcagccgctggaccacacgttgtctgtgagccaggcagggtgcggactggagctgcagagttaacaaggttcctccagatgccagcgggggaggcctggggcggccagtggagaggagtgatcgttaataaggaacgtctggtcaaccccaagcccctcccagcggaggaactgagcaagccaggagccctccctcaactgggcagcacagggggattctgtaagcagagctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctctggggagcagggagggactgggtccctgtggcatgctcgcctcgtgcccgcatcctaaggaaagatgaacccgtgttcacaccttgttctggtgaaggatggagcaggaaacaagcttcacagggaaatccacgtggggccccaccattcatcacagccatgagaccaccctttcagtgcacaggcagtgacctccagagacggggaagagacagatggccttccaggggtcagcacagggtgtgggcacagggcttccctgtgccgtgggtgactggctcagcagctgtctcccatgtcacctgcctgcagggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagaggtaagaccttgggggacccgggggtactgcagatgttgtgggcacagcttcctcaatcaggccctctggggtctgcggggtacctgggaggcttcggccttcccttcggagaaagagaagggatgtgagcatttacaaagcacccattgcacctgacatggagctggacacactatcaaacagcattgcattcacaccttcagcctcacacctgctctctcagacacgtgagcactgcgttcacaccttcagcctcacacctgctctctccgacacgtgagcattgcattcacaccttctgcctcacacctgctctctcagacatgtgagcatttcgtgacacactttcagcctcacacctgctctctcagacatgtgagcattgcatgacacactttcagcctcacagctgctctctcagacatgtgagcattgcattcacaccttctgcctcacacctgctctctcagacatgtgagcatttcgtgacacactttcagcctcacacctgctctcagacatgtgagcattgcataacacactttcagcctcacacctgctctctcagacacctgagcattgcattcacaccttcagcctcacacctgctctcttagatatgtgagacggtctcaggtttaaggaaagcaacattgctcgcagaggctgagtacctggggcaaggctgcagagtcaccacatttgaggttgagctccccgaaagcagcccccagtctctgatgttaaacccacgtcctccgtagagcaggtgctcagtaagtaagttttccaaataactgccttcccaatgagaactgccgggcgagcagggctctgctccacgcacggagacaggtgctccatgcactgcacttggcctatccttcctgcagcccacggagcagcatggcattagctctgatttttaccaaagatgagacagaggaaactgagagagttttattaatttgcccagacacacaactgcagagctgagatttggactcccctctgacaccacgaggccgactcttcccatgaaagtctatagtgggcgcccttctcagtgggctccgcgcatgtcctcgggccttgcagcgtccagggttggtgccacaggaccctcacctcagcagccccagctcccactccaggtcctgatgtcatggccagacccagggaccctgtgggaatgaggacgggagggagcttgcaggcaccactgcagggatacttggagcacacagttctggccacgctcctatttttgtttttttatttttgaaacaagtcttgctctgttgcccaggctggagtgcagttatgtgatcataggtcaccgcagcctggaatgcctgggctcaagcaatgctcccacctcagcctccccagtagcggggactacaggcacacaccacccagctaattatgttctgaagagacagagtcttgctatgatacccatcttggccgcccaaagtgctggggttacaggcatgagccactgtgcccagctaatattttaatttttgtagagatgggggtcttactacgttgcccaggctggtctccagctcctgggctcaagcgatcctcctgcctcagcctcccaaagctctgggattgcaggtgtgagcccctgcctttggtcctcccatagcattcagtgaaagcacatcccctctgtgaccattaccactatcattattattgttattagctggagggacggaagccctcagtcgccacagacacccgaggtgcttctgcaatgtaaagcacatggaagggatgccctgtgaaaggagcgcccctatccccctgctgccaccctgggtatcagcactcagggctgtcggcttctcaggaagatggtaatggctcccaagcaaacgttttgacttctttctctaatgtatttgtgtggttttatggttcatttatcttaaacattgactgtgcccctcccgcgagccaggcacgtgtgcaggtgcatcacagacacggtctcacagcaggtcctcttatttccccgtgtcctgccccacagccccgccccacagtcccgccccacactatgccacctgattatccggaccagagatttcggagattttccattggggcccccatcctccatcctcgtggctcagggagagggaatccaagagacttgctagttaccactaagtccaagagagcctttgaaacgggatacgctgggccacctcccctccggagaccaggtgaaatcacaagggccagaacgtgtgcttacggaggcaagtgctgatgaagtgagacgggagccctcctcccacacccgccactgggggccgacaatcaattgcagctttacacacgccacgcattctaatcagaatcaataatcttcatgataaacaattaaacaattattccttccgccgcggaacttctctgctgaaatcgatggggtgcagaggcacagcggcggcagatgatgggcactccaggccgggcctggccccaggcaccccgcgtcccgcatccaagctactgcacacaccagaggcagtgacagcccagaggtgccctcacctacagcagcactgagtagatgccgtagatgctttaggccctgggtgactgcaagaaggaggaaattcagcgttaaaggtggactgagcacaacatcagaaaaagagagaccaaagggaccacagggcttggaacagcccccaagaccctgcgaccccagctgtcatcacagacacagtgcctggtggtctggcagcccagggactcctgtgtggctttgttcctgtctgttggtctctatgagtagtgcatccgaagtcagccttaagatagctgctcagctgggtgtagtggctcacgcctgtaatcccagctctttgggaggccgaggcaggcggatcacgaggtcaagagatcaagaccatcctggccaacatggtgaaaccctgtctctactaaaaatacaaaaattagctgggcgtggtggtgcacacctgtagtcccagctactcaggaagctgaggcaggagaatcccttgaacccaggagacagaggttgtagtgagctgagatcacgccactgcactccaacctggtgacagagtgagactctgtctcaaaaacaaaacaaaacaaaacaaaacaaaaaaacagagcctctcatctccctgacccaaggaagggactggcttcagactgtccaaggcatgcaggcagctctcatgggcaagcagtcagccctgtacagcagcgtagcctcctggggatgttccttgggaagggcagcctctcacatgtccctggtctgtcctcatttggttgcagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacaggtactgagagagcaggagcacctccccggggaacggggccctggccgcctccagccagctcctgtccagatagtggggaggctgtgtgggccaagcaggtgcacccctgagagcacaggccccctttctttttgacactccccatgctgggaatcccagaactcctgggtcctggagctacttccaagggcccacccccagccgcttcccggagtctgctcttccaggtgtgcagggctggtttggtcaccccaggacccagggattggcgaggcaggggtgatggggggcaggctggacatgtgggctggagtcctagcccctcccaaggctggcaatggggaggggaccatgtggaggagggctgggctggcctcgggtgtccagggctggagggacgttgcgtccccttgcgttctcgaaagcagcagggagatggatggcaccacgagtactgtgcttccttagtgatggctggggaagatgggagggcatgcctaggacacgactagaatccgtccactcactcagttgtttactggacctctgggctcagcatgggagagggttgcattgacaatagcagcggcgttctgtgggtcccccagggtcctcacaactgcggtttacagacccacccactctttacagacaaggaaactgccacagtcacacagatgggcatcccagggcttagaagccaccccaggagtccacaccctcaccacatgccctgaccaggccctcctggggcctgtctggttcgcaggccctgcctgggcagggccacccgggacacccgccttgtgcttctcattggcccagagtttggtcacttgttactgagctcacactccaggctgtggagcgggggtcttggagtgagtccctccatgtcgcagggctctggagcctgcaccaatgactaagagggtagaggggccaagacggttgtctccaggctggccgagcttcctctgtctctcagatggtcacataggtcagctctgcgtccctgcagtcacccagtaaggggagaccatgatcccactctacagaggaaggccaaggtcagaaaagtcggtcatttgctcatatcccccacccagcctccgtggcgcccagccatcctcgtcttcgaggctgcccgtctcagcccttcctgactgaacctgaatgtagggagggaggcaggtcccaggtgaagcccctggcagctcctcagaacaccaccctggccccactctgccctgggggcaaagttcaggctttggagtgagggctgattggagtgtgggtgtaactggtcctagatgtgacaacagggggtttcaaagagaagagaaacctccaaaacccccatccctggcttgaggaccaggcccatgacagaggcgaagcacttgcccagggaggggtggccgaccgggcgtctcagtacagagctgtgaagctggaactgtgcaggctcagcctggcttctgccacttgccgttgagtgatctggggcaagtgacgggctctcaggtgtctccagctccctggcctttgagttgcgaggcttggaggtgataaggccctttggacggtcatggccatggatgccagtatcgcctttgccaccccacacagtgtccccaggaggcacagctgggtgtcaaatgcaaatcctgaccagagtccctgagcagtccaaggagggtcacacggaccatcgggaacccatgctgcggctcccaggcccccattggagaccacagaccagcaaggaagccagcgccccagtgcacagctccagctctctgtggccccagaggacccaccctggcacagtcaccctctgcagtctcatggtccaagcagccctctgctcttctgaaaatcgaggtggaatggtccctgcgcacggggcttgtttccagcaaggccagagccattgcctggcttcccctcttacagggcacaacatctggtgaggtccgtatgctggcgggttggaatttagaaaagctgttccgtccccacaactgtggttatgcccctcatgttaggaaaacgaggctgcagcagctccggcttgatgtcccctctgaggtgttttccctggtgatctagtcactcagcttccagacagttaaagctctgacaggacttcaccaccaccaccgccatcctcgtcgccatcattatttccggaatcccctcatcctgtctagcacctgtcattttcaacaccacttccatgtgtcatttcatacgatctttgtaacaaccatgtggacatgcagcccagacttctcactattcccagtttacacacgcagacattgaggcagagatatcttaagtaacgcatatgcaggtgccttgacgtctctaaatggaagggatatttcctgaggtttttgtagttgtcacattccgtgagccagaggtcaaggctccatagacacagtccacgtcctacagttaatttacaagggtctgcgacgtatgaaaacccagtgtgtgtgcatctgaacaccaaactttccacagtcagtctccccttagtagctgcgtggccttggaaaagtccaacccttggctgcctgctaggactctgtcctctcatctgtgaaaggcagggctggagcggggatcctgctgttccctccagctctgtgagtccaaggtttgcctcattgctgaccgccacggaactggcagccaagaaataaggcaatcggaagagtcagactgtccgccaggttcctgccagcatctcacttgccctttgagctacagcaacagaactcgaggggcacagctctctcccctccagaggaaggcactcctagtggcagataccatcctcccagagccctggaattctcctggcacagccccgagggtcaggggagtatggccaggtgcgcccagcctgacttaataaagtacacaggatgcttagcttaattggcagtgtgctcacatatataaataacctcaccctttgtgtaaccatctaaaagaaggaaaaaaaatatccagccactattcctgaaggcttctgaagccaaacagactaatcgtgtgtccgggacttcatgctggcaaggagaggtccatgtttcaggacagacagtttaatttggtataggagagaccaatgtcaatttcctaatgggccagaactaggacaaatgcttcctctgcctatcaatagagaacatgtcacaggagaatcccaggaaagtgatattttgtacactgccacagtataatctcccttcctgtttaataatcctgacagctacattttactttcaccagttgtgtgacatctgtgagtatccagaaaacattaagagtttaaatgtctcaatttggtgactgtgactacgtccagggaatatgggtcgagacccccagggagaggggttgggtctgagacgtgttcaggtgttgccagtgtctggttggtggttgaagttgtgagacggggtagccacccacagaaatgcagtagagaggaagaagagaagggctctgagcccagtgtgacttggaggttctggatgtcactttaggacagagcagtggctgtgcgggctcagggggtggctgtgcatctggctgtgatgggctcagctcctcctctgagctctgtcgtgggataggtgcgggggttccaaacagaagacagaaaggcgcagagggaatgagcatggaaaacagcagggattcaacgaatgtcagcaccacggccctagctccttttgactgatttcttttttttttttttctttttccgtataatgtaattttttaaaaatatcattatttaaggatcagatgggctgggcatggtggctcatgcctgtaatcccagcactttgggaggccgaggcgggtggatcacctgaggtcaggagatcgagcccatcctggccgatatggtgaaaccctgtctctactaaaaatacaaaaattagccaggcatggtggcatgtgcctgtaatcccagctactcaggaggttgaggcaggagaattgcttgaacctgagcggcggagattgcagtgagctgagatcataccactgaactccagcctgggcaacagagtgagactccatctcagaagaaaaaaagaatcagatgaacttggccaaggatatgatacatgagcttgatattctttgtgatacaatagtgaggtctaagtgtttgtgtttgtttggttggttgttttatttgtttttgtctgtcacctgggctggagtgcagtagctccgtcatcgttcactgcagcctccaactcctgggctcaagataccatcctgtctcagcctcccgggtagctaagactacaggcatatgctatcgtgcctggctaatgtttaatttttttttttttagaaatggggtctcactatgttgcccaagctggtctcaaactcctggcctcaagtgatcctctcacctcagcctcccacagtactgggattacaggcatgagctaacatgcccggccaatagtgaattcttaagaaacatttttagtgccttccagataagtaaataaagacagcagtgaatcgctttaaaaagatgctcagcactcatccattttataatagaaccaaaatgaaggaatggagctcctcctatttaaaagactctgcatttagctctgaggcaggaacgtggaacttaagctatgtccttccccgacgcccattccagaacactttggctgtggaggtcaagtttgtgtatgtgattagccgtccgaggcagtacgagtacaaactggctttctaaatatatcggttattgatttggggtaagcaagagttctgatagcaagttcagagagtgagggtcctgtattacccaaattatttatttcctgagtttgggatgattagaagaaagagattagatggcagatgttatctcaaaaatatccctaaatctatccagcttctgagtttgtatgtggagatttgggaggtgaggcatggggaatgagcaaaggcccggggagtcaccaggcagcatcagtggcttcctggggacaagtgagggctccggggtgggggagccagagaaagctttcgggaagacaagaaagagcacatcacatttattcattgcctgctgtgtgccacgatccacccgactccatgaggatgcgtgatgggatgtcattttcacgacagccctggaagccccggtgctgctatctccatgtccatagccgaatacagcaaggctctgagacactgacttgctccagtgagtagtggcagagccagcattggaattctgcttagcccactccaaagcagaggtttgggctggcttggaagtgtgaacagagtgcagaattgggaggagttagaagggttacaggagggtgttcttgcatcctgtgtgcatttgtccctttatcatggagtcaccaaaatccatgctctgccacaggagggagcatggcaggagcaacgggggtggggggcttgaggatcaaacatttggtctaggaggtagaccagtcatccacaggagcagcgctgcagggaggtgaggcaggttggggtgagtgcacagaggatgctaccgtctctagtactgcagagccaggagaggggttgatagcactgccctctgcctgcctcatttgggcagtggggctgctgctcccatcggctgcctgctggagctgctttctgcctggttttgggggcactggcgtggcttccaccgagagggttaactcccccagatccgcattttgtgttccctgcagctcacagagacacttaatcaatccttgttgaatgaagtgagtccggcaaaacacaggcctcacgctaagaaccctgctctctgtcctcctttgcacccaaacccatttgtctgggagccaggctgatttgtccagccacctgacacgcacttatggcacaccacgtgtgcccggctcagtgccagacccaggcaggacagtggagaaagaggggtttcaaggagcttgcagtgtggctccaaacccccaaatcatagcaaagtgtgaagtactaaacagtggagtgctgagtataattacagttcaatgccagaggccagtgagaaaacaaatacatcaataagtaagcataatcgcaaataaataaataagtaaacaaatcatttctgcaacacctactgtgtgccagatacaacactggtatttacgtgtcctcataggcaaccccccaccccagcctgagaaacttcgcagatggggaatagcatccttattcaatccttccacccatagatctgagcacctcctgggtgttcttggctcttgggatacagcaggaaaggaggccgactcggtccctgtccttgtggatgttgagtcttgtaaagacagatagtcgtcaaggaaatgtcacccatcatgatgcagaagatgaagggaaggaacagggcacgggggacagcaggcagggccatctgagcagatacttgcagatccataggaacagctgatccttagtgagcttgccccacaccacacacctgactctgctgagtgtctcacctgagtttaagcctcacctcagtttcacgatgcctgtgctattagcccaggtaaggaaactgaggcaaagtatgctgtccaaggttaactgggaggtagaagccaggcagtttgactttggggtccacattcctgatgcccactctgctgcctcctggtacaggagccagtggggctatggtgggtggcgcagggggaggaggcagggaggtcgtgggagaagacacatggttatcacccagatgaggcaaagtaactcctaggatgccaggaacagaggggaaattgtttgttttaacttagcaaaggctgtctaccagaactctggagcaaaggtcatttttatggtcggacttcagaagcatctccattaaagctgggaccaaggccagctgtctcctgtggctgtttttccagttgtggacgctgagtgcagagggtctgagatgtgcctgcggtcagggactgggaagtaccaagaccagaccaggttctggagggctgcagtggaaaagcaggccttgaggtgtgagctggtagagaaacagtgtcacctggtcttaagcaggacggggacctgaaagcaggaatagaatctaatcatggtttccaaaaatggttatcagttttctaaaaagcagaatccttcctttaaaccaagtatgacccaggccgaatgcataaacctgatgggcatggagctcttgttggctgatgggggctgtgtgggcctctggacttcagagacttcagagtcctgggggtccacagggctccatttgaaagccactggtttacagattccattgggagtgaggacagaagactggttttcaggtgatgagggcttcggtttagagtgatagttgagacttttagacatgggtaacagaggttaagagtcctgaggcaccccgagttttctggtctggaaactgaggaggatggagccctcatctatgaagagccgctgcccgccagggaggagaacagagcagtttcctcacttgctcattcggaagtcgaatgaagggtatctgagaggaaccagccagtgactgggttgcagggcgggtccctgaccggctggggcttcaccaagatcccagcattgtctgcacggaagagtttggctgaagtcttagtctcaggcatggcatggggcttggcacaggagacccattgcatgtggagtagctggacggacggacggaaggaaggaaggaagaatgaaggaggggaaggaagaaagggaagggaaaaggaaggagggacgggaggtggaagggagagaagggaagaaggaaggaaagtgggaagggaggaagaagggagagaaggaatgaggggagggagggaggaatgaagaaaaggagggaaggaaggcaagagaaaaggagggaagggaggtggaagggagagaaggaaggagggaaggaagggaggaagaggggagagaaggcagcaaggagcggggagggagggaggaaggaaggtgggtgggcagatggaagcgggcccgaagtgctaacagcagaaggcacctcaggaaaacatgagtcccgttaaaatctccgtcgacgggctgggggtatttttcacttggatgcttgacagggatgtggtcttttgtaaagtgacatgtgaatattgccatttactagtcttgtagcagtgggcctcagttttatcatccttgaaatgggaataatgatgcctcctctcccagagctcgtgtgagttcaaaggggttgcacttgccaagcgcctggcaccgtgtcagccccagtgaatggtaggggtgcggggctggcgggtctctgcctgcagccggccaggaagtggaccttagagaatgctgcaaggctgggtctggcccagtaaagagctccaggaggacggagcgtgagaatcaggcaggaactcattttatacttcggatcagcacaagggcccggggaattagctcttcctgaggacttctctggatcccttggagagcagtgatgtgccgactagagtgcaggggtggctccagtgaggggttggcactgcctccccgaggagccctgagcagaatcttccccctggccaggacgccctgcactccctgccctctgtgcagctcctttctccctgaggatttcaaccgtccaggtgttcaaaggcttctcccaggacaggtccagggtctccttcaagcccctgctcattgcacctaggaagtgattgggtccgacccaagaacagcctccttgctaagctgtctcgggcccacacaggagcccagagctctcagggcaggggagggatttgcccctcttcccagggcttcaccaggaatgcctgagggcaggacagggtggcagggccccggcagtcacggtctcttccacattgcagactgaggcccttcacctcctacaagctgcgcctgaaagccaccaacgacattggggacagtgacttcagttcagagacagaggcggtgaccacgctgcaggatggtgagcaacccggggcccagaccgcgttcctggccgctgcccctggagcccgagatacttaggccacactttcgtcttgagccagaaaggggccaccagggagtggtggaaagcagtagaattccattagtgacagacagctcggagggtttccgcacagcctgtggtcataaatcaaggtttcaagggcttccaaatggaatggaagtttctttgattggcttctaaagcccctactatccattagcatcccagaaattgaataattgatagggtcattaaaaataaatgtcagcgggtagctgggttttaagagattttccccatttttctcattcacgagccactctttgacaacagcgcaggtaagtgatgggaagcgaggtctcctcagagctccaggtggcgttttcagccgctccgtcctacctcggcggcgtcaggcctgaagatggattgttattctgtgtggcccaggcctgtggcgagcccaggaggcagctctatcagccgcgtccagcggtgatcacaggacgggtgggatggaaaagagtggatggtgggtaatagctcagctcccaggctggaaacccagtacttagttcacccagcagcgtttcatcatcattcccgcaacctatccccaaagcactgtcttttccatttaacgctccagtggaagaattttccaataaaccaatttccagctggctcaccctgtgacctcacatctccacttctgctctctcgatgacctggaagtgtggtttctcccacataggcctcccttggcctcagggaccagcagagggtttgagcaaaccattcccggcttctcagcaactcacagaggctgttttgctgcaaaccctgcactcccagcagagcagaacctgcaagagcctccaacaggccccagctgtgctcccaggaaaagcacacttgcccctggaaaagcactggctggcttctgtggctcctgcctctcatccagctcttttctgagcacaaatcctgggagtttattggagctttggggaaagccagtgagaaagagaggagccgtcccgggtatatggggtggtccagggccctagtgagccctgctgggccctgaggagccgggctgagccccaggagctcactgtccaagggtcccacatcgttagattcaaccaactgtggattgaaatgttcagaaaaaaagttaaaaatacaaattaaagatatacagtgtaacaactgtgtatttgtttggagagtgttatgaccttgtacaatttctagattactcatgagagctcctacaattataacattgtaacattgttatgtaacagtattacaaattataacgttgtaggaggactgatgagtaacctagaaatgatttaaagtatgcgggaggatgtgtgcaggttacacctagaaatgatttaaagtattcaggaggatgtgtgcaggttacatgcaaatactgcaccactttattgttagcaaacctggaggcaaaagctacttgtaactggaaaagcctttccggttaatctacttaaagtggggaccaatttcacactaaaccacaagggaaaggctttgcaggaactaaattacaaaacaaaaactatataaatgcattcattttaacgttacctttaacacagttgaggtaatgtttgcaactaagcactaaatcttagaataaagaacaaaaccccacacaagctgatgtcattgtcgtaatctctctgacagattgtgtgaaagcaaagtgcaacagcctcctttgacctccagggcagcatccaaaaggaccatttttgaaaaaaatattgaagggcctcttcagactccagaggcctttcttaccctttgatattcagattgggctttgatgcacctatcttgtcatcgccttccctgggatgtgcagtttctctttgcaatggagttgcattgtatttgtgttgtattgtcttacactatctagagattgacaggcacagactctctccaggggttggggaaccctcggcaagatagggagagtcctctgagtatgtggacggtttactgatgaacagtttctttttatagtgatttctatttccctgcacaacctcacaactcaaggacattgagaactccctgtaatggcaccgctgtatcaccagggctgtcaggaagctggctagagggcccaccattaagctggaaccacaggaggttaagggggttggagggagacccatccctaaaacagaacggggaaggtggaggtgtgactgatgcaggcactgccagggctgaggagggggtgtctggcaggtccagaggaaaatcacagagccggtgaccccgggacccaatcttgggttctaagtggagaggcatctgctagatgcacaagtgtgcctgtgggaagaacatcgtcattccgttcagtgaatatggactggatacagaatgcgtgtcacacttctgctgggcccccgggatcttacagctgggaggcataagagttcagctcaatatgccaagacaggaccacacagatttggagggagcagaggaggcagggaagaggggcacagaagacctcttggatgtggcagatgacaagaagtttagtttggctagagtgcagggcatggccataggcagaggtcaaaccagccttgtccctccagagagcagagcagaaccatggcagactccccttcacttcaccctgctgtcccagccagctgcaacctcaccagaaatcaatctcctttcctgacagccttttagtgtttcaaaccaagtgacctggcatgatcatgtgtcctattcaggaaaagtagctctcacctaggtatcttaaaaaaaagagaaaaagataagttcccctgctctcccagaagacctgagccctgcagggagggtctcgagccagagagctccaggacagcctcactggaggggtggctctcggaatgtccaccacagggagagcccagtctgggtctgtttctcggggccattgttaaggttggctccctcctatcccgaggacaggctttgaaggagaagctctgggaagccccgaggaagggcaggagaaggggacccctggagaaggaaggaggcagggctcaccagcctccccatactcactgagggtggccctgggaagggcggcagaacataacaaccaccctgacccccgctttcctctcctgtgtgtttcagttccaggagagcccccgggatctgtctcagcgacgccacacaccacgtcctctgtcctgatacagtggcaggtaagagcgcggggaatcacgcgcgttttgtcaaatgtgttctcatttccctgcgcattcagccacaacggctgacatggactgcaagctgagccctgagctaagcgtttgagagtagaaccaaggagacacaccctcagactcaaaaacgcgagggggaaatggtgtcaattatcatctcggtgtaatttccaaaacattagaagcaggactgtgatgcacgtagagaatgaacttgactccccttattcaggagggaccggcaggatggggaggccagtctgagagcgttggaggaactgggtatgtcttggcatttcaccgaggacgttggagcaaggcttctgtgtatacacaaattggttatcgccctacaaggcagtaaaactgcaaccgctggagttagcttttctagagaagtcatctgcaaccagacaaaatatctaccggattgtacatattttcccaaagtctgggggtgggtggtggtggtggtggtggttgttgttgttgttattattattattattattattattattattattattattattattttgggacagagtctcactctgtcaccaggctggagtgcagtggcacaatctaggctccctgcaacctctgcctcccgtgttcaagcgattctcctgcctcagcctcccaagtagctgggattacaggcgcatgcccctacacccaactaacttttgtatttttagtagagatggggtttcaccatgttgaccaggctgatcttgaactcctgacctcaggtgatccacccacctcagcctcccaaagtgctgggattacagacatgagccactgtgcccagccaagtctaggcctttaatctccaatgtgcagtgagttaaatgaaggcatattcttccagataatcacacactccttgttgggcctgctcagcaatgctccagtaaggcattgaaggacacgctgccgtctctttcccttagtttcaattttgggcaatgcttactgacaagtacattgatgacaaatataacagagggacaaaactgcccaaggaagggctgcaggccccagggagatcccagctgaagagtggggcggggagctgtgcggaggactcagcccagggcctgtgtagcccggatccggggcagacagatgttgagtttccccagggctagagcttggcctggcagcagacacaacagatggacaggcagggggccaagcacgagggcagagtcaaagtttctggcccacagggaggttcctgaggccagaatgggggctgctgtgccagggagctgggaacatagtgggatggggccagcatggggtgggtacggcatgaggacaggtcagcctgggagtgcctgctgggagctggggtcaggagggcagtctggtgggcacgagattcttccttggggctgaagctgtcctcaaggacaatggcagggtgcccgatgcagcaggtgggaatgatggttcgggaagtcaggagaaaatcaagaggggaacagtggtctagacatggccttggagggcgaggggatgtcccggccacatgccctccgccggtgcaggggaggcaggaaggggtcctgtggaaagtgggggctgcgggaaatggaagggatgctgggaaacacagccaaggccaccagtaggtgtcccagacagagcatctcccagggccctgcagaagggccactccaagggacagtggcttcactttgcagcacggaggatgaggtccaggaccaggctaggacaggaggtgccagagatgcctgctgggccgggagagagacgtgctgagtgagcagcgccagccgcagccttcctgggcatggtcttgaggtgcgtagtgctagagatgccagagaggaacccggtgagcagagccaggctgggctgtgggtggggccagccagggggagcttgggaggggctccgctttcaccctcttgctgtatgatcctatgaaatatgaccatgtttgaggtatgaaagtggcaatttatgtgattcaacctgatatcacttgctactgccacttatctgagggatggagagtaggcgtttaacaagctgggttctgtgaagagtgtgtcatctccttcaagtgtccatggaggtgtgcggggctgcgtctcggctgcctttctcttgctaagggatccagcttctctgggtaggataggaacctttccaggcaatgaaagaatgtcccagtgtctcctggtggaactggaagagcacttctgtggcactcagccctactgagtttaccagagcataggggggccagagtgggaaccacgaaaacagcctgggccccacctctgcccctgggaagccacagcccctgatctgtctgggagccactggaaaagtgacgaaggacccacccgcaacttgccatcgggtgactgtggccctgagaggcccctctgactccaggttcctcctttgtaagaacagaaggtcacaaaggtgagctcaggtctcacacaacatctccagtctttgggggccgctagacccccagacccgagcttcagccctgactcccgtgagggtctccggtgggaggttagagacattcaaaatggaaatgcaaagtcccaagtgctcgtttcccagcctgcaccaacacagtcaatcacaagaacattggcactttgtaccatgctgaatcctaccagaaaattcacattttctttgtagacgtggcggcagcctgccaataccttacctaggtaagctcctttcctataaaggcagtgagcatcagggctgggatgcgtcacctcctccaaacaatggttgtgaaggcatcacttgctgtcagccccagtggacggtgcagggctcgagctccccttggtgctgctggacagctcagggacgtgcctagtgccacctggaggagctgggctggtgtgtgcatcagccgtccccctccagagcccaacagaacaaactaattgcaagaagaccagagcaggaggtggtcaatacaacgtcctgtagaaataaatgcttgtcaactgccaggcaattgaagtataattaaaattatgagtaatttactgcattagaacaaacagaacaaagaaaaagaaactaggtttaaatatagatttgcattccaaataaaatgtttcacctgtaaaccttttgtgttttttgttttgttttgttttgtttttttagtaattactttaaaaatgcaaacacagggccagcactttgggaggctgaggcgggtggatcacctgaggtcaggagttcaagaccagcctggccaacatggtgaaattctgtctctactaaaaatacaaaaattagccgggcgtggtgatgggcgcctgtaatcccagctactcgggaggctcaggcaggagaactgcttaaacccgggaggtggaggttgcagtgagccaagatggcaccattgcactccagcctgggcaacaacagcaaaaccttgtctcaaaacaaacaaacaaacaaacacgggctgtaatttcaaggcttatagacccatttaaatgcctcccttagtagactgtcaggcttgattattcttagtaggacagtcaatccttgcctttcatgggatccagttctgtttgaaagctaaggagtagaactccttctgtcttccagggtggagtgcagtggtacgatctcggctcactgcaacctctgcctcccgagttcaggtgattcttctgcctcagccttctaagtagctgggattacaggcctgcaccaccatacctggctaatttttgtattttcagtagagacaggatttcatcatgttggccaggctggtctcaaacccctgacctcaggtgatccacccaccttggtctcccaaagtgctgggattacaggaatgagccaccatgcccagccttgtgttttcttttaaagacagggtctttccctgtcacccaggttggagtgcagtggcgcaatcatagctcattgtagcctccaactcctgggctcaagcaatcctcccacctcagcctccccagtgtctaggactacaggtgtgcaccacgatgcttggctacttcttcaaaaaatttcatagagatggagtctcactgtatttcccaggctggtcttaaactcctggactcaagcgatcctccttccttgacctcccaaagtgctgggattacaggtatgagccactgcccagcctgtaagtgggttttgagactgttttctagcaaagaaaaaaatcccaagcaattgatcacaccatacgggaggctctcagtgtaaaaggcaccttcccagaggagggttacatctgcctgggcaaaggcagggaggcatcccgccgcttcagaacacatcttggggctgtttctttttctcttcacttgtgccacccacagaggaccaacacctgcatggagtgctgagttccagaggggactgaggcaggccacagaatgtgaagagctttcattaagcgcagtgggctctttaaggcattgataggaagacagcagaaggaacgaaactaactctggccagaggggcacctgaatgcacttggcaggactgccaggcccctgcagtgaaaggctggagaagcgcgtggcccccggcacagcctgaggaaaggctcacgggtgacgtcactggtgtttgatgttgtgtctcacgggtattgcgtgttgagcctcctgtgctctcagaaccatcaggaccaaactccggagagaatccctgttctactctccacaaagcagaaggcacaggatggaaagtgaaagctcagatggtttcactgagcttccggcccgggggaccacggtggccggatcagatttggatttgggcacctgctctgcctgaactcgcaggagacagtggcacgtggttgagcctccctcagcccagctccctgtctctagaactaggagagttaggccctgccctgctgctcccctacctcagcagagagagctgggtgggaggttccacagaggccagcaacggcagagggtccgaggtcaccgttcaggcagctggaaggagagaggctttccctgcaggtcctgcctcctcctacccccaggccttccctccactcaactctgtggctccaaggtgcccaccctcctgggtcttccccagaccattgacttcttcctgcctcccctacctggtgataaaacccaggcacactcctaccaggtcatttgcatttaaacaggctcttttgctgtggcacgcctgtaatcccagcactttggtaggctgaggcgggcagatcacgaggtcgagattgagaccatcgtggccaacatggtgaaaccccgtctctaccaaaaatacaaaaattagccgggcgtggtggcgggcacctatagtcccagctactcaggctgaggtaggagaattgcttgaacccgagaggctacagtgagcaacccaggaggttgcagtgagccaagatcacaccactgcactccagcctggcgacagagcaagactccgtcttgaaaaaaacaaaaacaacaacagcaacaaaaaaacgggcttttgaaaaatgaagaacctccaggaggctgctggcgaatttctgaggcgtggcaggcacagggaaggtgttttgaggcaggactcccagttcccttcaagcttctctccacacagatggccaagccagggtgcagtgacacacagatgaggtcatgttgaactccggcaagtcccactccaccccagggctctgactgagcatccgccatggctgaggcctggcccaggtgctctgggcatttaaacatgaacaagacccgaacatggcctgcccctgggcatatgcagagtcagagacatgcgaagggctggggacacgggtctgtggtgcaaagcgaaccttttgtttccagtcatataatactctggaggccatctggccagacttctgcctgtcttgggcacagggttgagcctgggagtttgagcagtcagcccaagcttgtactgcaaggtggctgcaaggccacgacccaaatctagagcctgaccttgacctcatgggttccatggagccgccctgctgatgcctccgagcacctccggagttggagagcctctttcacagattacagacaggttaatcccaaagtccaggaatggaaaatatggttgaacccagttcagaaccctgtgcaggcaggcccgggcatctctgtgaagccaccggaccctttgtaagtgacgctcccactgggaagatgacacctgctagcagagtggcctctgccagctgctgccttcaaggaagccaccctctgggggcacggccgcctggaccccctccccaggcctggaagactcctgccaggagcggatgcattttgactcttcagtgatttctggtgcaaacagcatcagttagcctgttggccaaatgtggccccagcccggtggctgacggacactgtgtctgttgggcaaggcggattggccatttcttatagctctaaatcatctcattcgcctaggctagaaatatctgtgagtccaggatcagtaatcttcggccccttcccctccatcttccagccccagaggctgggaaaccacacttgggcccagggagaacatttttattttcccaacctcctaacttcctgcttagttgatagttttggtgaattgaatccagccttcgtcacgccacctgagcttccctcctcccccagaagtaaattgcactctctgtaatcctgtcttgtctgtgcatctgcagagctggctgaaggcctctgcagtcttccttctgaggtaccagttcctcgagctgctgcaggtctattctggggcgagagggaggctttgaaggtgacctcagggcgaggttgcttggctggtacttacagagcccctgctgtaagcttttgatctgtctgctcgcctcttcgtcatgctgatagtcagtccagagcccagaaatggaagctgaggtctctcatcttcactgcccagactccagccactcccaccccaccaccagtgtgaacagcaaggacaggactcccagcaggaccgcctgggaccatctgggtggaccaggagccttgggcaaaacaatccggctctctgggtgcgcaggcatgtgctgggtgagagccattagcggggacctgttgctgtgtggttgtcaggggcccaggagaggaaagtcagaagcccccagggtcttggaagtcactgccatctctcattcagcaaagggctcctgtcagtgcatttttgcaagactggttgttaccgggagtagcagtaacccaggaatccaccaagcccatccatggctccggtggattggaggaagctccgttctggccagtctccttctggggagcccacccaagtggggaatgacccggcacttgggctagtcctggctcaggcactgggaactgtacctgtagcctggctgctgctcctagacccacccagacctgcccctgcccttcatgcccctcgctcccgtctagtggggctacaccaggcactgtgcccgccttgcagagggccagcccttctcccctcatcaaaagccgcctcctcctccaagggcagctcaaacgccattccctgcagttatcctccagttcttcctggcagtgagctcgccgtctctgaggcttcagagccgccttcctcactcagtctctggcacccggtgcactatagctcaggagatctcctagatgcaatgagacggcaaggctggaatatattccccaaggggcggagctcagtgtttgcgtgcattcctccagtaacatgccctgagctcttggtgagtcagtgtgaggagacaggtgcagcttttcaaggagccacagcaccaggccttcctggtggctctggcactgccctccctccctgcgggagggcccctgggcacagagctctcctgcctcccttagagccacctctttgcagtggcccgagtcacacaggacagatgcgctgtattctttagggtcagcagaatgaccatggaaagcaaacggccatggagaacacttccttggggctcagtacagaaaccactctgtctcctctttctgaaatccagatggcctgcggagaattgcctctcttcagtctcacataccgacttttccaacttttccatccattgtatttcttctaagaaggttaagtaaaccttctatttcattgtggctaacagttgtgtttgaagaaggatgccttacagaataagggttttaatttcagtctcagctgtggcccatgagataaccagggctagagtttgaaagagcagactgcaggatcacctaagcccagtagttcgagaccagcctgggcaacatggtgagacgtcatctctacagaaaatttaaaaattagcctggtgtggtggtgcaggtctgtagtcccagctactcgggaggctgaggcaggaggatcgcttgagcccaggaggtcgaggctgcagtgagctctgatcgcacccctgcactccagcctgggtgacagggtgagatcctgtctcaaaaaaaaagaacagaacagactacctggaacccccttgtgtggtgatgtgagtggatgtgcaagtgtgtgtgtgttatgcacacacaggatttccaccacgcccccacatctctggtggtgctttcatcacgacactgtcgggagccagattgcagttgcatataatactgaccggtgcccactcctagcacaagggactaatttttaaagactaagagtaaaacaactgaaaacctaaaagctgctctgaatgtgattctatagactccacagggaggaaaccgaacatgaaccccatcaacacccccagtttttaggagactgtctgacatgcccagccctaagggatggggtgcagagcaggactggcggcccggcatgggggagctggagaaagagcaaatgagcagcccaggacacctgtgagtgactgttgccggcgtcccaaacactgctttgtcgtcaaaatcatagaaaaggaaaagagcatttagtaaaatcagcaggcactgtagcctcccctacctgttcccctatccagcctcgactgtgcctgtaattctcactccttccttttctgccagctttcagcttcccaaactcatagctccctggtcaggtttggattttattgttttcctggcaagttgagtagtgctgggaactccttgagccggtgaaggggtgcctgctggagaaaggggtcagtggccacagggtgtggacggatggggtggccacgtgccccagggaccctgccgtgccttgctgatcgtctgccgccgcctcgggtacaccgcaccctggagagaccctcatctgtgctggctcactttctgctttgtttctctagctctattactggaggcgctttgaaaagcttttccatctgtagattgtcccgatggaaggcaagcagcgccggggagggagcgggtatccagagaaaacctgggatgcccagttacatctgaattccagaagaatcattttcagattctgatttagctgggtgtcttgtttttttatagctttaaaaaaagcaaaaaaatcaagagagcctcatttgacattgaagtcccgggctctggttcggcggttctggcctggtagctgagcatgctccagccccgtgaaggcggccagccagggccagagtagagaggctggagcagagccggcaccaaggtcccctcatccactggtggtggccagtgaagggtaaagagagaaaaggaaaagccagcagaaaaaaagtccctcccagataatagcccaactccaccgtccatttgagaatttggagctagatgccgggcagtgccatttccccatctctggtctgtggtgggcagcgggagtcctcggacctggggctgcaagcccgcaggatggatacgtgacccttgtaactttctgcaaaattgaagagggctgtggggcattgacaagcacaccgtggggggaacacaggggactcagacgcgcccccacccccagacgacagctctctcagcccctgggtttgctcactggggtccgacacccctgggccaggagcggagctgtgtccaggctggagtagtgtctaagggtgtgggtttgcagggcctctaagacacggatcgcaaagacccagcaaggccactcagttgttcccgttatgcttttccgcgtctgaggggggattatatcccgtcgtgctgttcctgaattgggagcatcacaggggtgtcagaaagtcctcagagagggacagctgctggcagccctgcatggcagtggcctgggggctgcttgagctaatgtggtagcaggcctcattttggaaaacctcctgagtctgccgggtacacacggtgcccctctggcatgtgcgtgtcgcatgctgcatgcgtgagtgttgaacgcgtgagtgttgttcctcgttgctaccacagtgcaagcccccctcactatccaagccattctgtcggagagcctggggagcaaagaacaccgcttcctccacgtttgggttttgcctcgtgagtagcaagagtccaaagaaaaagcgatttctctaaacatccaacccctcctggtgcctgggttcagatagtgaggaccagagagagtttggattgcaaggatgtgttatttaccgggggcagcaaaacaagttactacgcattaggtggttggaaagggcagagccttattctctcacagctctgggggccaaaagtccaaactcaaggtgtcggcagggtcctgctgcctctgagggctccagggaggatccttcctgcctcttccagcttccggtggccgatgacaactcttggcgtttttcacttatggacgcgttactccagtctctgtccctgtcttcatcgggtgttccccctgtgtgtcctgtgtccaaacttccctcttctcataatttccctccactcatcaaattaggaccctcccctaatccagtatgaccttgtcaaaaccaattgcacgtgcaaagaccctgtttccaaataaggtcaggttcacaggcaacagggcttagacttgagcgtgtcttttagggggacacagttcaacccacagcaaaggggctctcgtgcagcaaagctgtggctccgcccagggagcaggatggtgctgcggtgtgggtgcctcacagtgagcccgacaccggaagttctgtgcacatccgtcctctgacgaggcttcgtggcctcgtcttcagccatcttctggtcacagcttagaaggttcctgttccttatccctcatctgagtatcccaagaagagaccagatgctcggaggctcagcacccagatgagtgcagaagtcactgaggctttccagggcatccgcctggagtgggaggacccttctcagtctcagatttgtctcctgcgtggaaacatcctccccaaatgtacttataaacagaaaccgactgaaggaaaaggcaagccttgcgctgggtctcgagtggtgaacagccacatcctaaagtggacaggtcttgaggtctcataaccctgtgtttagattccagcaagacctgaaactccacttccttatctgcctgtgctccctattccatgggagtctaatgtgtgtctaatgagcgcctagccatggcttggtaagaactgcagggtgagagctggatggcaagggtgtattgtttgcctggggcagctgaagcagatcaccggaccgcaagatgataggccaggccagccatcatgcgaggggccatggggattccagcctgaggactgagtccggcacagtggggtggcctggcatggggaggcatcagtgaggggtacagtacggcagccacagcctggatggccaggggagtgagggagggtggggtcagctggtgggtgcttcagagcaggccgcctctcgaggttccaccctgctctgggctcaccacacagcacccagcctcctcgccgtctgtgtctgtccccagcctcctgccccagcctgggggctcatttgaggatttgagctggacaggggtcaaaatgctgatgtccccacacacatgcacatgaaaactgggattctgagagtatctccacagcttggtgctgtgccctgggagctgcctgggttcgtcttgatgaatctgacacctgtcgctggaacccacgactttcttctgtgcagctggctagttaaacaggggtggaggtgagccctgctgcaggccagctgggttgactcccatggtgtggctgagtcggtgtgatgtctttgcagcctccgagggacgaaagcctgaatggccttcttcagggatacaggatctactacagggagctggagtatgaagccgggtcaggcactgaggccaagacgctcaaaaaccctatagctttacatgctgagctcacaggtgagactgtcccctctgtcctggtacagggagggaggttcccaggggacccttggtatctgctcagtgcacatcatggtgggaaacgctgtggaagaggctgagagaagaggcagccctgccctcaggaacagggagcaggcgggtttacccaccaggggcacacagggtgcaggtgtgcggcaggtgggtgcagctgcggaggcagaggggccttgtctaccacagactgtgttaaggggagagcagttgccaggcctccagtgactgcactctaccggcgtcagtggggaagggctttgggacctgagatggaggcagggggccagtaggaacctgttgcaaaacccaagtccagggacaggccccgcctgtctgtaccagacagcctcagcgtggagcccatggtgctcacccccgggctgattttggctctgcctgcactgcgccatgatcgttgctctgacgagggcccagctgccttcaagacagcttctagaaccctggagagggacggctgccctgcccgttcccacccctcctctgttggatggaggttagagggggttcatttcctggcacccaccaaacggtgtcacaaaaatactctttgccccttgacatcctcgtgccggggacagagtgaagaagcagctccagaacacgccgtgtggacggtgccctcccgctttctgccatccctgtggcaccagggctgcctacctcacgcgccaatgccagccgcggggccttccacgcacccagtgcgcggacggcagcagctcctatgctcctatgctcacacagcttgaccccagtacagcgccaggcatgatgttgatgaatgttgaagacgggaaattgcagcactggtgtctgcactgttggcacaccccaaaggtggcccttgctgaccaccagacagttggcatctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggagaaaaggtgtcctgccactcagtgctaagttgtgccaaaaactagcatgtttcactgaatcagagtggtaagcacaccccgcctgtccgggactggggtgccttgttgtttacgaggaggtgcggcagcccccgcaactgggagctggtggaaagcttgggcggtagcggggtctttattgccccgggaggcgcagcgtgggaagtggctggcatcccagtaaggcacctgtctcccttgttcctgccgcacatcacctgcgatggccgtgtccctgcgtgctaaccacctttctgctttgcttaccccaatagcccaaagcagcttcaagacggtgaacagcagctccacatcgacgatgtgtgaactaacacgtaagtgcgctctcagcgggaggcccatgccgcgaggcgcacacactgtgcccagagccagctggtctctcagtgcaagggaaaaccagcctggattaatggctccagttctggaatcgcctctcaaacgctgcgtctccacataccaaaccaccagggagataggaaaagaagcttctagaaacagaggctggggaaatttactaatatctggtcttcaagtttgggacagagaggaaagccagatagaacaagatctctgatctctccaacttccttcttcctttttttttttttaaagaaacactcttttttcttttcttttctttacttttttttttttttagagacagagtctcactctgttgccgaggctggagtgcagtggcacgatcacagctcactgcagccttgaactcctggctcaagtgatccccctgcctcagccccccaagtagctgggactataggctcatgcaaccatgcctggctaattgtgttttgttgttgttttttaagagacgggttcttgctatgttgtacaggccggtcttgaatgcctggactcaaacgatcctcttgtctcagcctcccaagatgctagggctataggcgtgagccactgcacccagcctttctttttttattgtggtaaaatacatataacagaaaatggaccttcttaaccatttttaggtgtacagttcagtggcattaagcacattcacactgttatgcagccgtcaccatcattctccagaactttctcatcttcccaaactgaaactctgtccccattaaatactaattcgttatacccctccccaccagcatccacattcaactttctgtctcgacggatttgacgactctggggacctcatagaaggggaatcatgtagtatttgtctttttgtggctggcttgtttcatgagcttaacgtcttcaaggtccaagcacgtgagagcaggcatcagaatctgagtcaagactgaataatatcccatcgaatgaaagaccacgttttgtttctccactcagcctcccttcaccctttcaataaaccacgttgtttctcctttgattcccagctagggaggagtttcaaaatccaactcaagggctagacgtggagccataatgtgatcgacttcaacacacagaacttggctggtttgggaagtggaccaggcaggagggaggggctggccctccccgagcctatgttgtgttcaggcattctgtaggggtgggagtgatttgcagggcagcacagctccaacatgttgagatactgactccatagcatgggtggaccctgtaagcatctctttgaaggcagccgtccaaggacgggcgcctgagtcacggaagctttgctgggctggtagctggcaggaggcacaatttgcaggcccaagcacaccaccatccacaccagcacacaggtgccaggcacacacatgggacctcggaaaagccaagccacccacagagcagtgttaaccagtgggagaaccttccagaatgttttggcttaaaggtcaattattctcaccctgtcacttagtgcggagctggtgcttggccccctgccctaaggagttctctgtgtacagcagcccacgcccgttctttcccaggacacggccgctaaggtctcagaggcctttggttaccagcgtccttctacattctattttcaatgccacagtcttactctatctgttcataatttcaaggagagattctgaaccaaaaggcaggcccaggttatgttatgtattctaactcaggggtctccaaccactttgacaccaggggtgggttttgtgggagacaatttttccatagaccaggtggtaggggatggttttgggaggattcaagtgcatcccatttattgtgtactttatttccattattagtacatcataatatagaatagagtgaaataattctacaactcaccatcacgtagaatcagtgggagccctgagcttgttttcctgcaactagacggtcccatcttggggggaggggagacagcgacagatcatcaggcattagattctcataagagtgcaaaccctattgggaacagcacgtgcaagagagccaggttgtgcaaggcataaggagcacgcaacctagatccctcgcacgcgcagttcccaatagggtttgcacttctgtgagagtctaagctgatctgacaggaggcagaactcaggcagtaatgcgagggatggggagcaactgtcaataccagtgaagctttgctcactcacccgctactcacctcctgctttgcgacctggttcctaacaggctatggctagtggcccaggggttggggacccctgttctaaatcctttactttagaggagggagctccgtgctgcctcttacctgaacacaggataggatgggtacgtcttttgcttaatggtggtgggtgcttagttaataggagagaaggagggtgccccggtcacagtggatgcaggtatttcacagatttctaacaatcccgcctcctctccttggagggtgctccttgcttcattgtggttcatagggggaactttggagaaagagaaggtggtcctggtggaagctgatccatatttccttcaaccctgcagatttaaagaagtaccggcgctatgaagtaataatgaccgcctataacatcatcggcgagagcccagccagcgcgcccgtggaggtctttgtcggcgaggctggtaagctccgtgcacccccaaccccactgccagagagggccacagtggtggggacagccaggcacgctgcggccaagcccctcaggtgtccagcagcgttctttctccttgaacacattgctgtcggggctgaggtctccacgccactggcagggaaagatgggctcagctgagagctggaatttcctgacagcttcagtgaatggtcaagtcttgcttttgagacctaaagggtttgttcgatacctggggccatcatatttactgtggctttgctctacgaaagtggtattaagtcagtggtgatgtaggtgtgtgggaaatggaacctcgttatctggaggggcagatgtttgtatctgcatgggtccttcagtgggcttcggcagtggcctggtgacagcccattctctaggtctgggagagccatgtgggccattgtctccaccccttttagataagatgtgactgttgggtctgattcaagggaccttgccttctgtggggctcacagtgggaagcaacgtctatttttagatcagatcctgtccctatccctctccgggcccagcgtgccgcaggtaatgagagcaacgccattccttcggccaaggagaccacagaacctcaccctcctcgctggctggtgactttaaagagttccctgacttcacatagagcctgatgtttctgctcttttccgctggtgcagatttagaagggtgttgtttcaggcccggaataattagagtgtccctgaggacagaggctcggcctagcaggagctgctgcatagtggggagggtgagatgggggggcaggggcggctcggactgcgggggccagaggagggaaacacatcaggtgaccttttgcaattgggaagggttattgttatgaaccaatcaatagcaccaagggtcaagcccagcggattttttccggaatggtcaagcggtatttgcatacaaatgaggatgcgtggagagaggcatcaagagcatacggtatttctgcctctctttgcacgaaaatatgttcaaaggggtcactcagagccaccgaggtacggctcagctttccctcagggatggacctggctgtagaggagcccattgagggccatggtggggccaccaagggtgctgtcagagaggggtgccagggtgccgtcagtaaagggtgggtgccactgcggacggcggccatggcagattctgtgctctccagttgtattcgggtgactgggccccagttggcccccatggctgggggtgggtcagcctgtggcatcgggggagcacaggaaaggagggccgggaactacagtgtctgaactgcaagcagaaggtgtgggtgtcagagctctgcctgagggtctgcctgcgcctgggcataggacaccaggaaccagggggctcagggcacttgggcaggccctgagaccgaggcagacgtccagagaaaagagcttcagcaagcggtagggaagccaggggtggtgcgggaaactggggagtcgcgccagggccagccaagcggcaacaggactggatgcccagcaaacagctccagctctatgcccagcgcccagctccagctctatgcccagcgcccggctccagctctatgcccagcgcccagctccagctctatgcccagtgcccggctccagctctatgcccagtacccggctctagctctatgccctgtgcctggctccagctctatgcccagtgcccggctccagctctatgcccagcacccggctccagctctatgcccagcgcctggctccagctctatgcccagcgcctggctccagctctatgcccagcgcccagctccagctctatgcccagcacccggctccagctctatgccctgtgcctggctccagctctatgcccagtgcctggctccagctctatgtccagcacccggctccagctctatgcccagcgcccagctccagttctagggtctgcgctgttggtgtcttagttccttctcacactgctgtaaagggacggggtaatttataagaaaagacgtttacttggctcacaattctgcaggctgcgcaggaagcatggtggtctctgcttctggggcggcctcaggaagcttccaatcatggtggaaggcgaagggggagcaggcatcccacacggcacaaacaggagcaagagagcgcaagagggaggtgccacacatttaatgaccagatctcatgagaactaagccattcatgagaaacccacccccacatccccatcccctcccgccaggccccacctgcacgttggggattatagctcaacatgagacttgggcagggacacatccaggccatataagtctgtcatcgtggtaagatgcgtataacatggaaagcattctccgtgtgcagttcagcggcattcaggatggtgagcagccatcaccaacatccatcgctggagctgtctcttcttcccaaacagaaatcccatacctatgaagcaggcccccttttccctcttttcccatcctgggcagcctctcacttactctctgtcactgcaagttcacctctcgatacttggtacaaatggagtcgtgcagtgcttgtcttcctgtgtccagatccttgccctcggcgtgaggtttttgaggttcaaccgggttgtagcagatgtcggaattgccttccttttcatggctgagtaatatcccattgcatgcatttaccgcatctggtgtgtctgctcctccagggatggacactcgggggccttcccccttttagacttgtgagtgtgctgctgtgagtgtgggagagcgaagagcttttcagcagtgcagagctgagacagcccaggtgtggggaggcagttgcagaggctacaggtgagcccggcctctgaggttagcatcacggtgtgatgtggcttctcccttccccactgggcccccatctccctcccctcccaacatgtgcatccctgctccagccctcctttccagaggcctgccctcctgccccactcctcctcaacacacccacaccctccacgtgactcacctctgcccagaggcctgggctctgccacctgcaccctttgcagtcccacagaagggaaaggaaagcctacttgctgtgcccatgccaccaaggccttttccatgcacacacacaaactccacgtggccacactgcactgctcacagagctcgaaggcgggtgctgagagtcagcagagccggttcccacagcatcacacccacccagagtgccctgtgcagcccctccagtttaacttggctgaggcctgaagcaccctttatgcatcttttttttctttttttgagacagcgtcttgctctgtcacccaggctggagtgcaatggcatgatctcagctcactgcaatctccatctcccaggttcaagcaattctcctgcctcagcctcctgagtagctgggattacaggcgcccgccaccacgcccagctaattttttgtacttttagtagagacggggtttcaccgtgttagccaggatggtctcaatctcctgacctcacagtctgctcaccttggcctcccaaagtgccatttaggcttttatcccctgaggagcggctgccactgccccaggacaccctctctgtccccctccctctaggcggggctcagatttcccctctgtgcggtatcctgggtgctttgtgcacagctctgccttccccccagcagcggggctgccttctctctaatgctgctcctccccattagaccaaggctgcttcatcccaaacagctccttgccccaggggtattgccagaggggatcagaatacctttgtcattcgggcaaattgaggttcccaaacttccacagggcaggagagcagctggggaaaccctgcacccagggacgtgtcctggagacagggcctcccagatatgctgagatgaaggcaggtggaatcagtgtctcatagcagggctgcagggaaggctaatcagaagctcctcatcctgagggagaggagggagaaggaacctatggtctctgtccctgtaacagcagataacacagtcaccatctgccgcccaggcactcatgttctaagctggtctttccatggggctccttcctgaggctcctggcagtagggagggagaggcagagctggtgagggtgcacaggctggcagaggctgtgaggccactttagggccctggcagatggggagcagtgccaggagccggggttcacacaagggaatgtaaccgcccagcaggctcctcctgcctgcagcacagacaaaaccagttcactgagcccatggtattgcagtcaaaacagagtttaattagagcccagccacatgggggaactggagttatcactggtcagtctccctgagggctcagaggttagttttttccaggatagtttggtgggcgtgggggctagggagtgggtgctgctgattggctggggatgccatcacggggcgtggaaaacggtcctcatgtgctgagtccacctctgagcggggccacaggaccccctaagccgtgagtcgtgagtcatgagtccagatggggtcagtccattttcagaatgcaaaagtctgaaaagcatctcaaaagatcaattgtagtttctataatagtgatgttatctttagaagcaactgggaaagtcactaattttgtgacctctggtcacatgcctcctgagcagtgagggattacttacccagcttacaggctgggtgcggtggttcatgcctgtcatcccagcactttgggaggctgaggtgggtggatcgcgaagtcaggagttcaagaccagcctggccaacatggtgaaaccccatctctactaaaaatacaaaaaattagctgggcatggtggtgcatgcctgtaaccccagctactcgggaggcggaggcaggagaatcgcttgaaccggaacccgggaggcagaggttgcagtaagccaaaatcgcaccactgcactccagcctgggctacagagcaagactccgtctcaaaaaaaaaaaaaaaaaaagaaagtatgcttatattttagccgagttcaggcttctcccatactcctaatctctcagccttttattagctttacaaaggcagtttccacccccaaacgaggagggggattggctttagggaaggaccattatcagccttgctctaagttaaactaaaaagtaaattcctagacacggcccctgcatccaggtctctgctccaccccacccatcagatgtggcttggctcttgcacacccaaaacaactcacacatctcctgtgccaggcctggcagtgccaaccctgcaagtggacatctcagttgtttggcctcagcacactcctccgggttctgtgtttacactgcagagagttttctggaaggagaaagccagttcgccattccctttctagcctctgcttctcgcagcccaagtacctgcattgtaacaaccctaatctgctgaggagaggcactgctaacgtattgacttagagcaagtaggccttcagaagaggaaattaaattgggccagcttccgtcccctcggctggaagcttcagagcaccacaaactcgtgggcccgaaatgctcaaaggcttttatgaaaactaagactttgctgtggtcccataggtaagcgtgcaggtccaagcgtcggctctactgtttactgcctgtgtgaccacgggcaagtcacttaacccctctgagtctggccttgagaccttgtgctgctgtggggagacctgtgagtgaggagactcaggtactggcttcattgctgccactaaggcaccagtcctgctcataagatgagtgtccagaatgtacctggcccggggtcagcccccagtcagtatttggtgaatgagggggaccctgggtgagtgagtcggtttgtctggcctcatctgtaaaatgatgaaatgttcagaatagatgatctctgggtcccctgaagttcaaatacgtgatacttaaatctgtttaaactcagagaggaaggataatttttagatttttagctgagattgatgcacaagcccaggcactacaaattggtaaaaataatccatcggtaaggactccagtgtgcaggaggtaggacccaacgccaacaagcttaagctgaaagaatcattattaactcctgcactggaagagttgcagagcctgggacagcttcaggcatggctggatccagcgccccagcaagctgctccatgtggcctcttggatccactttcctcctagttggctccttccttggtcaggctcttcatcaaggtggccatacagccctgggcacagagagcttcccttttctgcagtggaagtccactggctgtcttcagcctgcctttagttgcatatctgtccccaaactagttgctgcagccaacgtcctgaggtgcccaaagccagggagatgtcatctctacctggaccacctgggccaactgtgaagcgagagggtccctagaggagatccagtgcgacagtcagaagaaggggactcgggcattcaccaccacagctgtcctgcagtgctgataggcagagtttgactaggtggccagaaatttttctggtggaggtatggacagtgtctatgggttcctcagcaggagagctcttcagatgacccagccagagttctgggcccagctccacattccacagcgttccgggcactgtgggaccacgctccagccttcaagacactcactattcatggatgggccctggtctcaggttaagcctgcactcctgcccagaccccaagcaggcatctcagcccctgcctgtatttccagagcccccaggcttccccctccttgagtatgtgccccctcatccataccaagctgtttccgcctgggatgactgctccctactcccgtccctgggaggacagacagtcctccctcccatgcagccctgcatccacgcgagcccttggatggggcagctgtcttctctttcccgggcaggattagctgtttcttcctctgctccagaacatgccacgtacacagctctttgcatatccacctgaggacaggtctttttctctctgagttccatgagggcagggacccctcttatccccagaacgttagcataaggccagaacatagaaaacattctgaagatgttagaggaagggtgggagggagagaaacacatttagacaggaaggaaggaaagaagggagggagggagggaggaggggaggggaggggagtaacaaacatagcccaggccaccggcccagaagcacaagtgactgagtgacccctgagctctaaggggggatggagcggctccagggcccagggagctcagggagggcctaaagcaaggcttcctgtccagaggtgcccggcccagctctcctgtttgctctgcaactactgtcctttcccaggagctctaaaacagttaaagctttaaaacaaaacgaaacaaaatagcaaagctggcctcacacaccaaacaaagcttgtggttttctgttcatttatgaatccacgctgaccgaaaactgattcagccccagatgtgtcgtggggacactaggggcagtcaagttctacccactttgccctgggggtcctggcacagacaagcatggccgccagcccagctcccaggaactgcaagagcaggacctcctctcctggagcagggccctccgacacccaccccggctgctgggacccctcgtgcacctttgttatccccagggtcgctctttagccagagttagtggcagctgccccaggacagagcctccaaataaaaagaggtgctgtgtccccacataggccgcctccttggagcctgtggcctcgtggttccctcgacccttagctcgtccccggagccggctcgccttccccacctgctgagccctgccactgatggtttaggtcactcggcggtcctgggggcttctggggcctacagctgggaagctgggttggggtgaatcaggaggaagggctgccgtcaatgagtagagccccccgctgctccagcttcctagggagagaccagaagcccccagcccacctcactaagccctcaaatgctgtgagcatgcctgctgtctgtccagtgagtctaggaggtgccttggaatctcctgggcccgtatagacagtgcgggtacaggcatggcccttctttggggaggaaggcgcccctcctagcctcctcctccacgggccttctccagttcttgccctgtgctttggggtctagtagtggccagacctgggattgccacccctggcatctgtagcctccttctgggggctgcaagtagtaggggctccagcatgtctacctaggaggggctcaagagccacactgtggttcggagtggggcttgggacccatcttgactgtgtttgcagtgtgggttgtgtgcatgttgggtgtgttatgtctgtgtgagggactgtgagagaggacaggtgggcttgctgctacatgaggcacgggggccaagtccagggatgaggcagggggcacctgagggagtggggagggctgggtcccatgtgggggtaaacctccatagttaacccacggcattattaccattattttccatcatccaatacatttgcacaagactatgggtccagcaccttgctattagaaatgaagctactctgaacactgttacaaatcttttccaacgtctccaatgcctgccttgggataaaacgctagaagcagaacttctggtccaatgacatgaacatttttcacctttgaaatacttcagctaattgacaccctgcagcggtgaccagatacagggctcaggttgcattcctctttcctcctgcttttaaatctttcctagtttattaggcaagaaggtatctcattattattttcctagatgggcttttaaatgactggtctgtgattaaatgcctgcagagctcatggctattttttgcatgggggtctgttacaaggtaaactgagacacaaaatgttagaagagtttattcgagcagacagcaattcatgaatcaggcagcaccagtccaaaggtggtttggggttctgggaagggaacacaaggggaacgtttttatggtgtgaatgtgggagctggacaaagaaaatacttgataagagtatgttgttgccttcttcagtctcaactgttagaaaattcctagttgtattggttttcatgctgctgataaagacatagccaagactgggtaatttataaagaaaaagaggttgaacggactcccagttccacgtggctggggaaggtgaaaggcacgtcttaaatggtggcaggcaagagagaatgagagccaaccccttataaaatcatcagctcttgtgagacgtattcactaccatgagaacagcatggggaaaaccactcccatgattcaattctctctcgctgggcctcttccgcaacatgtgagaattatgggagctacaattcaaggtgagatttgggtgggggcacagcccaaccatatcactagctgtatatctgcctttagttgcatatctgtcctcaagctagttgctacagccaacgtcctgaggtgccctcagtaagttgttggcggcttctgattggttgggcttaagttttatttttctttaatatgggcatttacaagaaatagcccaggttaagttttgtttaggtttgcagaaccagcaaggtcaaggttgtctccacggcttaatgggctttgctcaggggattctcaagcctggtctccattttattttaatgggtcttagtgttttgtgttgatttcttagagcttcttatatattagggatatcatgtttgatcatgtctatggcaaatactttgtctttaattttattgtgtttaagtggttgtgtgctcaaacctccatatctgaggcatctctccttcccattttgagaccaagtaaatattcacccagatattttttcataattttcatggttttatgttttccattaaactctttcatcaaaaaaaaaaagaaagaaagaaaaaaaaaactctttcatcctcctggaattaattctggagcctggcatgaagtgagcttctaaatggatcatttgtttccagagaagttttttcccccgaaaccatctattgatttttaattgctttgtggtgcgtcttaatcatggtttaaattcttacacacagtcaagtctgtctgaagacattccttcgttccacagacatctttactgttgccctagtacttctaaagctttcatttacatcagtttgttacacatttttttcatgtttaggagggcttgtcttattcctctttgttttctaaaatttctcagccattctatgaattttacaatcattttggcaagttcttaaaaaaaagcaaatgctcctgggattttgatggaaacgtattaaatagtaaagggatttggaaatcctcgccgtcttcctccttttcgtctattcatgcttgctcccgggagctggctgtccctctggcacggtgctgctgggctggcagcgctcctggtgcaggtcctgctgttgcttgtcaagtcattcctggcagttttattgcggcggttgctgtgagcctgggtattgtaatggctcgtccctgctctgcccaccgccaatcgcagctcaaggctgaggctcacatggttactcaggcatgttaaatattagtccagcaaaaagagcaacataggttttccccaaaaagcgagccaggacttgccttttttccacacccaatggggagtggctgcccagctcagatgagagccgagtgtccagcactgtggcctttagccccgcaactttcaccaaaaacagaagacagacagatacccatgctcagcatttaaaatcactcggccggccaggcatggtggctcatgcctgtaatcctagcactttgagaggccaaggcgggtggattacttgaggtcaggagttcgaaaccagcctggtgaaaccccatctctactaaaaatacaaaaattagctggatatcgcttgaacccaggaagcagaggttgtagtgagccgagattgtgccactgcactgcagccatggcaattgagtgagactccgtctcaaaaaataaataaaataaaatcagttggtggctttaggtggtgtttggttgttcctggtgtacatgtggctgtggaagacagaaaagtgtcttgaaaatatctgtttgctgtttttaagaatgaaaaaattgtcgtacaatatgggtcccacctttcttctaagtgctccaagtttttaattacagttggttggaatgagagaaaaaaaaaagcacagcttctagctgtttcagctcccgctagtgacaaataaagccagtcctagtgcctattaagtgaaattaaaaggcttcagtgacgccagtttgaaaacatgtgtttgtagggaagagtgaatggcacctgtttacagggtaattaacgtcgcaaccccgactccacaggctgcactgtctcatcatcgacgttcccagggctccctgggtaattattaacatatcacgcgataatgacattgtgcaaaccacaggccgcccctgtcatttctgcggccacagtctctccaactgatgccggtgggctgtgctgcgtacagggctgtctacacggtcctggatgatggataaacatctgccgaaagcctactgtgctggtcacagatggtcaccatcccctgggtgggaaccgttgctccgtttcacagatgagagtgatgagtcagctttatccggagtccgcagggggctccccgggcgctatcccaccctctgggctccagctcgtgttgtttcagacgttcccttcaggcacaaatgcactaagaagccctcgccaaggagtgcagagtggagagactgtgggatgcaggtgcctccgccgtgggggattctccaatgcgctgcacccggcccacagcaggctgtgcacaggcactgctgactgactgggagcttggcccaccccttccccatgccagggagtatttcagaattcacggcttccttcaggctctctgcagcatacgctatcccgggacagcctcttgccaaagggcgggtgataggagcagcttctcagagagctcccaggatggagctgtggtgcccctaggcagacacagcccccgagggaggatgggcttgacaccagcctcatcaatgctgggccggagggtggagggcggggaggctccttgcccacaggtgcgagcctagccaggcttctctgggcgggggctctcagggaagcctctggggcctgtgtccacccatcctctacacttctgctggggtgacccttgtgaaatgcaaatcccatcccctcactttctgtttccacccttcaggggatccctgttatgtatgcgggaaaaatcaagctcactcctgagactggccccagggactctgaggtcctgccaggccaaccccgcggcggtcacagtgggtgtcctcatggcccccaggccctcccccgccgcagtcacggtgggtgtcctcctggcccccaggccctcccccgccgcggtcacatgggtgtcctcctggcccccaggccagggttccctttcgtgctcaggcttcacacgcacagcccggcagatgcccaggagaccttggtggcgggctggtagtattactcatctgacgtccatcactgtagacaaaggttgtggagcatcgcgcggtgcccgctgctgcatttggaaaggctccctcacctctcaccatcctgagtttcactccttagccagcttctctgggatccctccaggtcgccacgctggcagccagtggaggcctttcttcagcacccacttgctcagcaacttgctggcaccgaagggagcgagagagccctgaggtacgggcctgcccttcagctgctcccccgaagcgtgagccagcccttcagctgctccgccagggagagggaggatcaccggcctgggcctttgcgaccttctctggggttgagtctgcaagggttagggtctcctgtgagtggcagagctcagggtggacagggggctgcaggtgggctctgcaccataggagaagctgggctatccccacagaggagggaagcgccatctccacaggtgtggccgggcagaccacccctcccagggccgcgcgtcacgcacaaaagtggggttcacatccaacccactgttgagagtgcaccagaacagcagatttgaaagggctttgacggcagtttccgaccccacccccaggcctctctcaaaccctcgccctgctcctcctctccagccacactctcttccgagagaactcttcccctctttgcctgtttctctgttgtttaacttctagatagggaaatctcaagcatacacagaaggagacagacaagtgcaggcgcatcacactcctcacagttggccttagtgtgcttcgtagatactgtgtcagttacagatggaaggtttggggcagccctgctgtcagtgccattttcccaacagcacgtgctcactttgcgtctctgtgacagcatcttttttgcagcagattttttgtttgtttctttgtttattgagacggagtctcactctgtcgcccaggctggatagcagtggcactatcttggctcactgcaagctccgcctcccgggttcacaccattctcctgcctcagcctcccaagtagctgggactacaggtgcccgccaccacgcccagctaattccttgtatttttagtagagacagggtttcactgtgttagccaggatggtctcgatctcctgaactcgtgatccacccgcctcggcctcctgaagtgctgggattacaggtgtgagccaccgtgcccagccagtaaagtatattctaattgaagtatgttccgtgttttttcagagaatgctttgcacattgaacagattatggtatcgtagaagcatagcttttatatgcactgggaagtcaaaacatgtacgtgactccctttttcaatgatctggaaccaaacccacaatatctccaagacccgcccgtgtcgagaacactcctgcactcgccaccagctcaaccacaaggcagcacggccagtctggcttcatccaaacatccacctcctcccctcccgtgtgatcctcaagcagctctcagacatcatatatagaggtttacaacatcatatcattttattcacaaatacttttaccatatatccctataataactctttaacatatgtattaggattctctagagggacagaaccaataggctatatataaatatataatatataaaaatatataatatagattatataagatacaaaaatatataatatatattataatatataatatataaaatacaaatgtatatataatataaatatattaaaatatatataatatataaatatattaatatatttatataatatatattaaaatatttatatattgtataaatatattaatatatttatatattaatatatatattgtatattaattgtataaatatacaatatattgtaattaattgtattaattacatataaaatacatataaaattacatataaaaatattaatatatttatacaatatataaatatattaatttatataatatatttatatatattaaaatatttatatatatatatatatatatatataaaggggagtttattaaatattaagttacatgagcacaaggaccaacaataggctgggatattgccactactggggatgaggaagctgttccttctggcaaaaaaggttcattagagtttacaagctcagtgtccccagcttcatcaaggtcctcccacacatccccattccaagttgcagagtcccattctttttcggtccatgccctcactttaatagtagacacctggcaaggctgtgcatgcaccttaacttgcaggtcagccactcacatggtaagagcttgtgtctgtttttccacaatttcagctcttcctctacaggagtgaagactctcactcaaggcaatcttagcagacttgagactcagtatctgcttctgaagctgggagacagaatccctgagttcatcattttctttcatcactttgtgcattgaacttaggagcaaccaaccagcttcattatgtttcttggttctccacacatggtcagaggtattatgtatagagtccctaaactccttgcctctcacgagcggtgaatcaggagcgtcaaatgcatttattttgcataactctctaaacaattcacgccaaggactatcagcattctccatactactagaagtagagtccttagcatttttggatctaatcatattaagcagccaactccggaaaccgcaaaaccaacagaagaactccatcctgaatattctgtctctctagaaccactcctggtaccaaaatctgtattagtcagggttccctagagggacagaactaataggagagagagcgagagagatatatatatgtatacacgtatgtgtatacatgtatagatatatgtatgcacgtatgtgtatacatgtatagatatatgtatgcacgtatgtgtatacatgtatacatatatgtatgcacgtatgtgtatacatgtatagatatatgtatgcacgtatgtgtatacatgtatgtgtatacatgtatacatatatgtatgcacatatgtgtatacatgtatacgtatatacatatatgtatacatgtatatatgtgtgtgtgtatatatatactcccatatatatgggagtttattaagtattaacttacaggatcataaggtcccacaataggctatctgcaagctcgaggagcaagcaaggagatccagtccgagcctcaaaactgaacaacttggagtctgatattcaaaggcaggaagcttccagtatgggagaaggatgtaggctgggaggctaggccagtctcactcatttcacgttttttctgcctgctttatattaagtggcagctgatgagatggtgcacaccacattaagggtgggtctgcttttcccagcccactgagtcaaatgttaatctcttttggcaacaccctcacagacacgcccaggattaatactttgaatccttcaatccaatcaagttgacactcagtattaaccatcacaatgtataactacaaagtcattcttacacctaagaaaattataataattgcttagtgtaatcggttagctagtcagcatttgaattcccctggaattttctgctctgacagcccacagttctatccttctagacttgtcagccctaacccatgccactgaaaccatgatgcaaatcaatgagctgctttagaaaaaaaaatttgtatttttaattgacatataataatcgtatacatttatggagcacaaagtaatgtttaccatgtggaatgattaaatcaggctaattagcatctgcatcacatcacattctatcatatttttgtggtgaaaacatttaaaacctactcttctagcaactctgaaatggtgcaccgtgatttcttatagtcacgcgatgcgctgcttgttgcagagtccagtgggtgctcgcgtccccggtcttgccctggcctttgatttgaggccgactccttgcctggtttccagaacactctgccctggctgctgcagctccgcttctctctggggtttcttggggctcagcttttccccgtccctcccccacgtcactctccatcctcagctgcctctggagccacagctcccaaatgagtcccctcccgcctgggagtctcttggggaacccaggcctgcaattcccactgtctgcctggcatctctgccgggcgcacccacaagttccttgacccaacttgtccaaaattgagtttctgtgtagtagccaagagcaagcacttagaagccagaatgcccaggtctggctcctggctctgtccccataaccctgggtaaattactccacctccctggggctcaatctccttgcctgcagggctgcagagaggaccagatccgcagagggccctggaagcagtgccgcaggagctctgcctggggatgaagccgtcgctgctcctccccagcctctcggcagcagcagccacggtggcaacaagcctgctaacatgtgcccttgggagggtgcctccacccaccccaaaatccatgacagaaaccccagcctcagcccaagtctctccaccacacccacgcattacatattgtcagaggctgcttttgccctaggaaagcagagttgaatagttacagtgaagcccttcagtccctcaaagcttaccacccttcatgtctggacttttactggaagtatcgttatgtccaagcctagagaagcagcgtggaccttagagcaaggcagattcaggtttgaatctagctcattatgggggatgtgacttaacccctcaaggcctcggcttgcttggtcccctggtcactgcaactggtggattccaggcccttgccaacaggtccgcctctgtcactcttcttcctgttgcagccccgccctcgctcagaccaccctctgcagcctgtgaccttgcaggagctcctccgggctgggtccccacaccctgtgcactccctagctacagccaaagccatctctctcatgtacagctttgactgtctcactctctgctttcaaaccttcccagagaaacctctgatctctaaagccattcagtcccctggacgtgcggtgccgtctctcccgggcctttgaacacacagcctcttccacctcagctgctggcccctccctgccccttgctctccacgccgtaactctcctctccactgttcaagtctctgcctggatgcacctggccaggggagccctcctaggcccaggcactgcccggggagccctgctgctcacccccacagtgctctgggctcattcccagcacagagcccaccctgagggctggaattgcctgctgacctgcccgtggcctgctctagaccatgcaccacgtgaggacaagtggctgatgccatcccaggcacacagatcctacctcatgagccagtgcttctcacggtacctagtggagaagcattcggagaggatttatctgatggatgttgactcttggctaacaagggctgcctctctccatcccctgactttttaggacaagaccagagatgctaaggccatagctaggaaagtcaggccctggaatgagaccgtctaggcttgaactccagccttgcttcctgttggagcatgctatttaacttttcatcttattaaacagaaataatgggagtggcctccaacgatctgctgtgcaatccacacgggcaaacatgaaacctcctctcccacctggggttagagcagcgaggagacccaggctggccaggacagagactggtggtactttgcccttgttaagagttcttggggccaggcatggtggctcatgcctgccatcccagcactttgggaggccgaggtgggaggattgcttgggctcaggatttgagaccagcctgagcaatgtagcaagacctcatctctgaaaaaaaaaagaaaaagaaaagaaagaaagaaagaaacaattagatgggtatagtgatgtatgcctttagttccagctacttgggaggctgaggtgggaggatcgcttgagcccagaaggttgaggctgcagtgagctgtgatggtgccactgcactccagtctgggaaacagagcaagaccccatctcagaaaaaaaaagttatttgaaaacattcttccacaaggagaaaaagaatggatgcttcgcggtcaaggcctaatagccagccgggctgggctcgtgtgaggctgtaaaaccccatccgcagcttctgtgatggtgtacaggggagcggaatgcctggtgctggcgtcaggctcactgtcctgcagctctttgctggcctggcctgttctccaccctcgtttgctcctgggtcttgtaaacagtgttcctttgaccttcccctcgaggaccagagatcacttgctgtctggcgcaggcgctcctgaccttcagatgtgggaggactgtaagaatctcagggagacccccacccactgcttgcggtggtctcctttgtcatagacgacagatgcttgccacacgcaagcagaggcagggcttaaaggttactctcatttctcaggtgagaaaaagcaaagtgcagatggtttcggagggtcctccaggaatgctcagctcatccgtgggaccaggacgcacaggcctgcccactgcatctaaggcagcgaggccctgtggaatcaaatcagcactgagacagagggctgcaggacgtggtcactgagggcgtgaagccagcctgtgccctcctggcctcacttgccccgtagggcctctcatgtcacgtcacctgcctctgtggaaatgtcctgtagctcctgtttcctgcagggtgtcacagaagcgccaccttctgctagcggcccaaacccatcacacacccccctcatttgcccctcacagagtggtcagaacctactgccagttcccactgcacccctgacagctgtagggttaaaggatggggacaaagtcacaagggtgttggctgggacacctgggccaggtgccttgaattctgccccagggctctttgcacttgacgcaccagctcccagtcaaggcctctgctctcattgcagccctcctgcacttccttcctctgcctcggagcaggatctgcaaacagctcagcggccaagcctagcccattacctgttcttgtaaataaagttttattggaacaccgccacacccgtgcatgttgttggaggctgcttttgccatagaaggtggagttgaatagttgcaacaaagcccttacatccctcaaagcttaacatccttactatctgggcctttacctaaagttgtgcgactcccaccttagagaagcagcttggaccttagggttaggcagatccaagttcatatcgagctcattctgaggcctctgacttaacccctcgaagcctcagctttctttttctttcttttttctttgcttttttttttttttcctttgagacagagtcttgctttgtcgcccaggctggagtgcagtggcgtgatctcggctcactgcaacctccgcctccctggttcctgccattctcctgcctcagcctccagagtagctgaaattacaggcacgcaccaccacgcctggctaatttttgtgtttttagtagagacgggggtttcaccatgttggccaggcttgtcttgacctcctgacttcaggtgatccaccctcctcggcctcccaaagtgctgggattacaggtgtgagccagcgtacccggcctcagttttctaaaaggagaatacagtctttctccaacaggttgaattttgtgtgtacaaactgcatataatgcagttaatgagttaggggctgtggattgcaccatggaggaacaccaccgcttgtgatgctgtcatgatctgtgaggacccggatcttcctgtgatggggactcactgtacgggccaggaagcacacacagtccgcaagccgcagagccggttggctcaagcgtcttttaactttgtttatcataacagtgggtgatgatggctattgagctgataagaaggtggaagcactatttcctgatgatgggaagcaaagatcattactggacgaaatcaaacgccagaattgtctagcagtattgaagtttcagagctaacctttaaaatggaaatatctgtaggacaaatatgtttgttatcgtgagtctgaagctctctggcctcatcctccttttcctatggaaacaactgcttttaaaacagtctttaaagctactcggtttgttagaattgcagctgccatgtcacagcagagcagactaaggccatcccctggggctatggaaggagagtgtcccctgtcccagctgccacacctgtgctgctctcagcccctcacctggagtgctctgcctttctctccacacatccctgtgctcagtcagaacttagagcacacagcaactcctcctcttctgtgttcttgaggcacctgtactcagcgaaccactcaaattaacccatgcacagttctagaattctgtcatcctcactgacacacctgccaataaaaaccccatctctactaaaaatacaaaaattagccgggtgtggtggcgggcacctgtaatcccagctactcaggaggctgaggcaggagaatagcttgaacccaggaggcagaggttgcagtgagccgagactgtgccattgcacttcagcctctgtgacagagtgatactccatccccccaccccacaaaaaaaggccaggagcatctcttagatttcctctgcgtacctgtagtgccccacccagagccaggtctgggtgtgtgtaaagacatgtggaccctgacaatggattatcacctgtacacccacaccatgaaatccaacattcatggcaagggctgcaccaaactccaggcggtcttggagacttcaaaatgtgcagaggcttggctgaggccggcaccttcctagaggagctggagctacagctgggatgtatcagtcagctgttaccacatagcaaatgatcccagtatagcaacctaaaacaacacacatctcctaccttggtttctgtgggccagaaatctgggaataacttaggtaggtcctctgcctcagggtctctgggacagtgtcaaccaggcctgtggtcttctctgaaagttcgaccggggaaggatgcatttccaagctcacccatgcagttgctagtgggattccattgttcgtggacttttggacttgagttccttgccatgaagggcctctccatggggcctctcacaacatggcagctggcttccttagcatgggctggccagaccacaagagcaggtgagcaggagagatggcacaggctcttgttgctgagtcacagcagtgccacattctagtccttagaagcaagccatgtattcagcccacattcaagggaaggagattctcagggcataagtaacaggaagtggatctgcaaacagctcaggggccaaatccagcccattacctgttcttgtaaataaagttttattggaacattgccatgcccatgcattacagattgttggaggctgcttttaccataggaaggcagagttgagtagttacaataaagtccttacgtccctcagctcatgtagggacctgaagctcctggtgggcagggcagatggcactcagacatctggggtgcactgggcaccatgtcctttgttcctagggctatgcacttgcccagacacggggctctgcatttcctgggttgcttgctcaggctctgctgctggctttcttgcacttctgccttgagtcattgctgtctatctccaactctcacttgtccccacctgagtagaagcagggtgatccctttaaacctcctgattcattgagaaggcctcccgagctgcagagtcacccagaatggagcctgtctccaggtccccctgctcaggggagcagattgcgagcaagatttgccaagaaggtaaatgagatcagagaattctatttcccatagttccttaggaaatcagaaagagaatctcaccagtttgctttgatgtcattaaagcaaactgaggaatatacaatttttaaaaaatcatataaagaaaattatttcattatattaaaacattaacattgattctcaaattatccattaaaaccttgctttacccaaacagtcagtcaatgggctacagaaactgaaagtagaaatctggcatggtctatcctggtccagtactgctctagccacagcagatgcctggcatggcacagggaggctccggtgacaggaggcgcctggcgtggcacagcgtggctctagtgacagcagacacccagcatggcacagggtggctttggcaacaacagatgactggcatggcacagggtggctttggcaacaacagattactggcatggcacagggaggctttggcaacagcagacacccagcatggcatggggtggctttggcaacagctgacgcctagcatggcacagggtggttctggcaagagtggacacctggcacggcacagagtggctctagcagtaggatgaccacctgtctggtgtgaacctaacatgcaccccgtgttcccacccttctactctttctccttccatctctatagtcagcagtgcccttgctccctggcccactgtcacgtctcaaatcttccctgttatttaaggaccagccagatgttctactttccaggaaacatccacatccctagctggacatgctctctgggccccgaccctgtccccacactccgcctggcaccgtgattattgtgatgcgtgtctctctctgatgaaacttgtctttcacatctggtgtccacctgtccctcagcccaaggcctagaccctggttaatattcaggaggattttggcagcgttaggctgggataacaaacaacctccaagggctggtcccaccagtagtgctggtccctcccgctgccgccctccgagtgccagcatcttctcttctgctacctgccattttcatcccaagactctggttgggggagcagcccccgtgtgactggccagcctcagggctgctagaagagaaggttccaggccatgtgactctccagaaagtgagttgtttggtcacgtggggccagaggggaaaatgtgcagtcctccctcagttggagcgaccgccagtcacagggccatgtcgctgtccccagatcaaatggatgaccttccgcctggcggacggtgaatgttttgaatgagtgggcggaggctgaatgaatgagcatcattctccctgcagagttaattcctacagctctgaaacttttccctcactctctgaagcctccactcctccaccaaatgccacgtagaaccgttttgttttgtttttttctcctgagatttgagtcacaccggtgcctgtccagctgcctcaacttgcagcagaggttcctaaaccctgaggtgagggggctgcagcccaggcctgccatgcagggctcaggttcaccttgggtctggtgggacatggagttagaaccatgagctgctggtgctctccacccaccagcaaattaagactaagtcagggcagccactgtgtcccagcggctgcttttgatccagctgaagctcgctggccacttagggacggcgagcacagggaggttgggcgaggcgacagaatgccgtccttgctgccgtttggggcttggctgcagcctccagcccaccccttcccgcagaggcaggaggccacgccataacccggctcaggccccagcgcccagccacgcaaggccatccaagcaaccagccagaattccagaacatttcagaaatgtcaggaattccacgatggctgtcaggtgagggtccctccagaagtcctgaaagcttgtctctcattgcctcagcaagatccctctcccaggccgcagaggccccctggcgagggtacaggacccatcacaccaaggacctgagtcactcagctctgcgatggcatcgtagccttagcgtgagaccccagagaaaaccccagctttgcacctttccctttaaatgccagttgcaggcaatctccctagcagcagacgccagcaattgccggtctaaaatgctttttaaaaataatttcatgtattttttttttaaaaaaaaaaagcttccaagctggtatgtatgtcatccttacaccgcaaatgctaaggtgggaaaacaaaaaacgaacgacaatcagatgctccgtgtctcccaaactgcacacgctttacggagaaggagagttgcaccggggcttgtcaatggcagagccttcctgaaagtcaggttctcctgtcagggtggagacccagcggctttcaggagcaaaaaagaagtctccaaaccgacacgctttgctcagcgttgacatatatttctctcttccctgctggtgtcaacaaaaaatgctttgttgcctgcagtaattttacggtccagaagtgccttgctgtagcattgctggtaggcacggcagtgcggctcagctgcctgagacagggtcatgggcctttgcccagctcgtctccaccccagagaaaggggcatgcgggcccctaatttatgggggttcacctggcgctcacagacccaccagttcctacaggcggatatccaagtccagagctgtcgtgggcgcgctgagttgggccatctttggaaagaaaccctggggctgtcgcggggggagggcgatgtctcaccgactaccagggtaatggccgcgctcaattttgcctttcacattttaattgtacaacagtaattttgcaatggagttgccgatggcaaacatgcaaaagacattaactttatttatgttttggattattaatgtggctgttaaaattcctccagttagttttgattgaattgtttttttgtgtgattctgctgtttaatggggcggtaaataagaatttctgataatgaggctgagcatctgtcacaacaacctggtgtgggctattaacatttccattaacggcagggtgggcagtgataatacggaaaccacacagttagaacaaaataaatagttggtgtcaggctgagtgggtgttaattactattttattctgcgctggggggagagagcagaaagtggggagggggtgatggggaaggggcgagtcctgaggtcagtctctcccaagaaggcctctccagagagccgggtgctgggccatctccctcggacagcgactgttttatcgtctccatcgatggtccgtaaagacactcagtcaaaaggctgcactcctgggccgcagccccggcggcaggcggagaggagtgctcggctggcctctgcctccgggagccaggccccctgcacagctgccctggagctccccagggcccagctcatggacagccgggagagccccagtgggaggagggagtagcagagaataggccgtcaagagaaagtgcgcagcgtggaattcaaagatagtgtgaagctggcatggggcagacaggacggaggcgttctggaacgcaggcgtgtgctcccaactgcctaaatggctgtgtggtgaggtgcggaggtgcggccacacccctaatggcggtgtggtaaggcgcggaggtgcggccgcaacatcctcatgtgtcctttggtttgcgtgtgccatgcagccctgcagacgcagacagcaccccagtgagctcctccccagggggagcgagggggctggaggggaagactggatcctcagaacgtgaagccagagctggcctcagagagcaaagtgcagccatgttctcaaacatcggagcttcctgtccctcttagaggggcaactctgtgtatctggacgaacttcatctagatcagggcttcatagccagggatgcctgaacctgtcatgggaacacagctatcttttctctaatctcaatcagtaatattagtgacaaaaaccacagcagtcaggagtcctgtgactccctcgccgatagagccgcagtgaccctgtcacatcccaggcattgctgggacctcaagttaacatcctcacccaccaatgctttgatctcacagcaaccatcagaccagcccctaagcctggtcaggtattaaccaagaagcacgtggattacgatctcatacctttggtttcaaatactctgctaactgtatctcggtataattatttttctgtgcaattctatatattttattgtatgcatttaagaacatcgtatgggaaggatttgtggtcttccctggcataaaagggctgagagctcttagggggacacagagccacggatcccaggacataactgtctaaggcctcctaagccagggcgacggcccagggaagaatctctcacatggttcccagcggaattagggcatgctcgagccccatgggcatgtgggcgagggtccgggccggctctgaatgaacgtctcagcttctctccgcattgctctttcctcagccccggccatggccccgcagaacgtgcaggtgaccccactcacggccagccagctggaggtcacgtgggacccaccacccccggagagccagaatgggaacatccaaggctacaaggcaaggccctcccgtgcggttgcctcccctggctcgcttgggcacccctcgttcacgtggtcctgcctactgcattgccagcagcagaccccgcaggcgctccacctggagagctggggcccaagcgtcggagcttggctagacctggcctgttaactgtggtcacagctgcttgtgggtgggaggcagcacaggggccaggctcactgcacacctggctgtgcccaccacaaaacaacccaggttgggggcccttgtttgtccactggcttctccccactctggacgcatggcctggctggggaacccttccgtttcctgggcccattctggagcccccagtacattggctgactataaaagaacatggggcgcctggaagagaccaggctccccatcccagctccccccttggtcacagttggacactgagtgagtcccttgattcggtcggtccagggtggggcccgccagtctcattcctcacaaggtcccagatgtgaggtccctgggaaccctgctttgagaaccgccacggtaacatgtgagaagcccattgtcactggagggtctagagatggggagaaaggaaggcagcaggccatgacaggagagcgtcgagtgaggaatcattatgtggggctgggttatccatggggcgggaagcacctctccacgtcccatccctgaggcctggcctccttagagagtacagggcccataagcatccggggtctttgccatgaaaacgcccccatccttctcctaaataaattcccctgtctattctgctgggacccaagtcgatcagtcatcagattctgggggctagcctcccctaatgactattggaccgattaaatgtccatttaaagatggtttttgcaggtgtgttatgaaaattaataccttcctccatggcagggctgttacagtgatgaatgagctaatggagagccccatgagcttggaggcatggcgctatttatgtatgtccaaaatatgttttctaatttccttaatgataaagacactgatcttggatattgatctcaagttagcaaggcctgggcgagcggaagatcttagacggtcaattcagtgagcagaagcccactacatcctgcaggtggaaatgaacgatgctcaccagtcagggcctgcccagcaagagcaaggcgggcgggtgtgcgaggcaggcgtgccagccctggggcgctccaggctgcctccccgaagcctccgtgctgccttttcacatgggcaagccgctctaacagcctggccctggtttagacccacagagccaaggtgggtcttctgattggtgttgtctttgggcagcctggctggcactggtcggaggtagcagtggtttccggccagctgtctagggaagcaattctggcaacctctttaaacctttgtgcttgggcgtcaagttcaactacaagcacataaaagctagacaagaggaaatggcaccccagaggaatgaggccttcccagcagccctgagcccaacatagttctcctgcctgttgtttttgattgctttaatctccaaagtatattgccatattgaggaaaacttagatgtcggctctgaataaaatgtgggaacacatcgtaggagttgggggtttgttgtctccatagctcggagcagggggtggacacggggcggcttcccttctctccagaagatgggggagagggagaggccaaaaatcaaaacaccaacagagctaggtctgcaaggaaaggcacatcatcggcagctgaagggcagcttcccttccgtcctcacaacttatcttcaacagcgctttgtttaacgaggcaatgctcatactctaggtgagcaacaggaaaatgttaaacatcgtctcccaaacaacattagcagccaggggtccccgtccatacacagtagcctcagcttctccctgattcctccaggagggagcctttccaccttcccacccagcacagctcgccccagaactcagctcaccccctcgctttgaccttacactcagtggcccccgcttactggaaggcttccccaggacccaccccaacctcttgctgttcctaacagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccggtaggaggaaggcgggtttcctttgggcaggcctccttggacacgtgttttgagagcgccagctcaggtcccctcacacagtggttcccggcccgcccaggcggaaggcaacaccttttgagtagctgggagtttctggatgggcaggactgggtttggctcatttgttctccctgtgcctggcctcagactggtacacagtggcgctaaataaatgttaggtgggttggagcaatgcatgctttttcccagagccctggagattcagaggggaggaagggctttgagtctgcagcaaggcctcgttcataactgacagcatccattccagttcctccaagaaatggaacttcccatcaggggcgcctgatggcatgtccagatccttgggggtaggctcctcgggcagtaaatccaggccacagcgacgggaattcccctgggtctcagggccacagaccacccctggagactgctcactacacacatgccacgggccagtcccgagggctcagacaggtgctgcgctgctgtggcctcatctccacgcacagggcgcagcgcctgttctcagtcgacccctcttccagcgcatctcagtttcctagcagcctggaggatgctgtgaagctgcttggccttgggctctgaggagctctccaaggccctctgtaggattctggaagtctgagagactgggagagtgaggtctgggaaccgtgggcagagacgcagggctcagggccttccgacattccatgggttcagctgacccacagacaatggactccgggaatcagggccccttggcatcaaactctcatgtgctgaccacaaccaggttgcaaggaccacttcctttggcttcatccagtgcccgcatctgagctggaaggatgtgggcagatctgtaggcagagatgagggtagagccatgttgagcactgccggcctggcaggtcacagctgtgggtcccagagactggagggagggcagagagggaggagggtgggtgccacttcacaggcacttctgagcagcgaggggcaccagggcgaggagagtaggtcccccacctaggctgtctggtaggggcagccccagtacacgcccaccttacacggcgcccgggcagagggggagctgccagcaggctccacatcaccccggccacacacctgaccttcagtagctctagatatttccaccagctccctccccgctccagacccagggggacactcagcctggagagtgtggtgggagatttcacgtgcaggagccaggggtgtcccccaaaacccccaggcctctgagggagaggcgaggaggggtcaagagaggcttcatccatcacagagctccgtctctccggcaaagagcaggactagagcttctggaatcctccagcagttgctagaaaatggagctccctgcgtttcattttctatttccatctattattcatttttatgcctttgccgttttgtctctcaagcccctttgtgtttaaacactgtcattttctccactcttctcaggagggtctgcgtgtctgattgatcctcggaagttctgaggtgatcaataaatcttttcattttatgacattcagacttttactgagttgaaaataacatcgaataacattttttattctatacggaggcacagacatgtatgtatatgatctatgtaggagcccctgtaaaagtcactttgtgttctattctcccagcccctggggcccccagctttctggcgttctcagaaataacctccaccacgctcaacgtgtcctggggcgagcctgcggcggccaacggcatcctgcagggctatcgggtggtgtacgagcccttggcccctgtacaaggtaagacccggggttggggagatgggagcgcgggccacaccagtgcccagccctctgcagtctacacagtgagccgcacctgaccgcttctgtgggccaggagccttctggcgcctgaagtggggggttttggaatctgagctggacggggctggagctgagtgcgaggggagcggggactcgcggggaaaggcctgtgaggaaaagctgagccaagaccagacctctgtgttctgagaccagaacggcactctccctctgaagccgtgtcatatatgcccttgatcctgtctctgtcacactcaagacattcctctcctattcctcccgagatgtttgtcctgtggtcgccgacagagaccacccagggttccacttgaagccacgcctcacaacacaggccttcggctaccctcagcatcctaggagggatgctggcatccccgtgtcttagcaccctggtgctcccctcgctcatccgtcccctcagcggacatctatgaagctcctgttctacatgctggaaaagccaagacatgctccagatgctggaatcgaggacctgggaaagccaggattttgactggcttgtttatcaggtccctggctttcctgcgtccaggcagttcctattccagggcagaggtaacacacaggtaattaaatcagcaaacaacagcccgagcgtgatcagtgctttggaggaaagagaggagggctaacacaagaggcttagggaagagaccggagtgacaagggcccggacacacaagaatcctggggaagatcttccgaagggaggatccgccaatctaggggcccacggtgggcagagcttgggtggtgctggtggctggagcttggtgagtggggtgcaggcactgcaggccacagcacacggggctatggcatatcccactggagagtgacacaggagcaggaggacctgacctccccaagaccaggatccctcgggcccaatcccccgtctcagtgtcacgatggaaagaagctatcgttcatctccacacttcctagatcaaccggaaacagcttccatagaagagcagggaaggtgttgccaacacagaggactttgaaagaggaaatgtcaggggcttgacagtgagtgacaggtgaaaacggaaggtggaatgcagatggctcggaggagaacgggtggcagagattctgtagaccagggagtgaggaggccggccggggctgtggcatcatcctacaggagagcggcgagaaggggaagggtgcgggggcaggggaggagggctcagatcaggggtgtgtattgaaggtggagctggtggggtactggcgtgaagtggaggaatgggggttgcgggcaggtggctctgccctgctgtgcatgtggctgctgctctgcacctgctgggtcagtgcacaccctgctcaggtatttgttcttgtttttgtttctgttttttttgagacggagtcttgctctgtctcccaggctgaagtgcagtggcacgatttctgctcactgcaagctccgcctcccgggttcgcaccattctcctgcctcagcctcccgagtagctgggactacaggcgcccaccaccacgcccagctaactttttgtatttttagtagagacagggtttcaccatgttagccaggatggtctcgatctcctaacctcgtgatccacctgcctcggcctcccaaagtgctgggattacaggcgtgagccaccgtgcccgacccctgcttaggtgttattccagtgccttctgtgtccctctctcctgccatccagacaccaatgtgtccaccaaagattccggtctgggaggcacgtctttcccaccacactggggtgaaatacaagtccagctgtctctgccttatggtccagggcaagtttccccctgtaatatacacagacagactgtaaaaattatagattatttaatgtctgcgaggaaaaaatacaacgagcacatcaaagaatatcggcgctccatttaaagccgtgataaaagtttcctttaaaaataagcacatttagatgaaacggagttgatttgatgaagaaaatttaagcactagttttttatttcactgaatctcagatgccattcactgtaagattcatcattattttatgaagtgctcagaaagaaaaaatgctcccaataaaccagagcccaatacttttgtatcatcaattctgagctgcatcccaaatcggagatgtgaaaatccgagaaagaaaaaaaaaatcacgtcttagacaatcgatggactttggtaaataacagtagaggtgagatgtgggcatggtttttgaaccagcagagagggcatgggagggacggggatttagtgtggccacttcgaggggcggccaggatctgttgtgaccttccgagtgcccagcacctgcctgggagccagggggcctggacgaggctgccttcgaggtcccacagcagaggcccagaagcaggcatgccatttgctcttgcttgtcctgcagggagaaacagtagagaattttggagacacacacgggttccatgagcctgtgttacaaatgccttttcaagggtcataaccaacgaggaccatttaaatgagaattgactgtgaaagcttcatagttctgattgacctgtgagtccttcctaatcaaaggcagctcaggttttcccattcttcctcaagtaagtgactggttctgctccccagtcttctgtgttaatggatttgcagaatctccgtggaaactccatggtgtgtgcctctgggcttctctcttgggctgctgctcttagtcttgtgagaaagtgcttcatgggctgggcgcaggggcctgtaatcccagcactttgggaggccgaggtgggcggatcacaaggtcaagagatcgagaccatcctggccaacatggtgaaaccccgtttctactgaaaatacaaaaattggctgggtgcagtggctcacacctgtaatcccagcactttgggaggacgaggcaagtggatcacgaggtcaggagttcaagaccagcctggccaagatggtgaaaccccatctctactaaaaatacaaaaaattagctgggcatggtggcacgcacctgtaatcccagctactccagaggctgaggcagaaaattgcttaatcctgggaggcggaggtggcagtgagccgagatcgcgccactgcactccagcttgggcgacagagcaagactccgtctcaaaaaaaaaaaaagaaaacaaaaattagctgggcatggtggcatgtgcctgtagtcccagttactcgggaggctgaggcaggagaatgggttgaacccgggaggtggaggctgcagtgagctgagatcgcaccactgcactccagcctggtgacagagcgagattctgtctcaaaaaaaaaaaaaccagtacttcattccaggcaaggccattccatgggtcattacccagtcagaagtgccgcacaggggcctcgatgtgttgggtcctcttctctctgcagtttcactcccctagaattgtttcttggcttctaccaaaccttccccctagcccagtctcccagacacaagaccctgcacatctggcttcccttgtgttttcagtgttgccgtttcttgttcgtttcatgacagtttttgcatcactgggaaactcaaagcattcggaagatttttagacaatcctttcagcatgtcccgcttacatgggcattctgtgttctcgctatacacaggcaccccccaggtataatcacagtgataggtgatgtttgttgagctcaagtcgggcactgtgctcagcacttaacatccgctatctccaaatcctcagaacggctctaccttgtggctgcagcttttcttctcctcccgcagacagagagattgggctcagagccacaaagacatttgcccaaggcctgcgttttgaaaataatgacgagggttgggatttgaacccaggtgttctgagtccagagccaaggcctaaactgctccatgatgggcagaaagcgtctggagcacttgtgtttctgaaagtaaatgtgaaggtgaacttcagagatggggcttgaggaggattcactaaagcgttttatattctagacaaaccgctggctgcacagccgagtagggggcctgtctctcccctggatggcaaaaggtggagtcactttagtcacaaccgttttcgcctcttttcacaaatagcaagaccgtccgtcaccagccttgtctcttttgtctgttgcgaagggctggttccttcatcctggattttcctggctttgcaaccgaggcaatgtgctctgagattagagcgagaggggagcagcactgtcttgctttgcagctccttccttggctctgcaggctgaggggcggccaggatctcagcagaaaaagctccatcaggcctccccgggtgtcaggaagaacaagccatgcagaccccccacgtttgggcttgctgggggcttgggcacgttccagacttcggattcctgcacatcagtcaagcagcggatccaggtgtggattgcccagcggtgctggtgacatgaggcgtccagcccccacccaatggccttatagagcttcctctagacatgacacctggctctgactaagccatggggcccccgccggggtctttcccgccacaacaccgtcagtctgcaggcaccatcatccgtggtccggctccagccgggatgagcctgagtctggctataggttccagatccctcctggcttctccctcgggcaggactcagcaaccctgccccccagtgccacccaggtggacctcatggctgcctggggaaggccctcctcaccacaaatgccagcagagcctcgggaccctggcgctcgcctgcctcccctgatggtattggccagaaccctggctcgccgagacactaaccccaggcctgtccgacaagccacatcccgtacccacatacgtcaaaagaagaacgtggaccaagagaggatggcagatcagactcactgagtcagcttatatctcatcgggggccagagcactggcatctgatgaagattcccaattggtgggtggtgaaggtggaggtggcagaggcggaggggcctatctctcccttctcctgagtccaggccttgggcggagtccccctacaccgactctgcgctgggccacgggattcgcttcagccagcgggacaatagctgtcatgaggcaagcagcttcaaaagcatttgcacgtgggaggcaccctggtcctcctgctgcccttggaacccaaccaccatgtgaacacacctgggctggcctgtggggtgacagtcacgcacggcccagcatgggagaggggccacctgggccagccaacccccagtgagactcaatgtgtgaccgcagacatgctgagtctagtgcaggccagcccggccaaaggactgccccgcggtacgggagctggtttggtggtggtggttttgagccactcggttttggagtggtttggttcacagccgtgcatgagagaggtacagcaggtgaggagtccatgttgattgtggagcacctattacttgatgcgttcttagacaatagtcagagttggggtcctgactatcggctgggcactcccactcatcccccctgccctgctccactcctcaccgtggtcctatgaggtaagcgctgccaacctcagagcagagggagaaactgaggactctgcagagaccacatgtcctgcccagcctcacacagggagcaagcagtgggcttcagaccactcccatccccgttcctgcattctctcttcctcccagctgactctgcagataccacaaccggccttggcaggaacgtggttcaggaagcactcatcctggcagctgctctctgcctgcaggcatttctgagtgtcttggcctcctgaggctggggaagggaggacgtgaactctctgttgaatgtgggaggatgccgggatagcttgaaaaggacgacaacgccacacgatggagtgtggccaagggcagggtggttgacagaaggcaacgactgggaaaaagcaaagcagcttcgtgcaccccgtggaggttacaccatccagccctcactgccctgcacctccacacccagactggccccgccccacggccgctgctcccactctcacccggaggggctgcactcccgtctgctcctccccgaggcccctaggagacaactgtgcctgcgtgggggactctgaaaaatccagactctaaccctttcactattgcatcaggattcccaacggggaaccacaaaagcggtaactggacctccacatgactttcaatattttgctcatggagtctgtgcgtgtcccagggaaacagttgcaaacgcagtgaaacatcaggcatccttgaagtatattgtgatgacaaaatattttaaaatatggtaaagatagttaaaaagtaaacagtgatctcacctggtaggggatctgtggggtcttctgacctctttccacacctcctcacccagaaccaggtctgtgcctgacatctgcaaactcttggctgggcattgaccagtcgggccaaggcaaatagagggtacagcatttacccggtatgggcagctcctctagtcactccactgtgaacacagtcgtggctcatcctgtgtgctgggcagagcccagggccatccccagccatccccgtcactctagggaacactcctcgaacccctgggacatcacattgtccagagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccacaccccccggagcaccctgccacccggagcaccaggccacccagagcaccaggccacctggagcaccaggccacccggagaaccacaccacccggagcaccaggccacccggagaaccacactacctggagaaccaggccacccggagcaccaggccacccggagaaccacgccacccggagaaccaggccacccggagcaccaggccacccggagcaccacaccacccggagcaccaggccacccggagcaccaggccactcggagaaccacaccacccggagcaccacaccacccggagcaccaggccacccggagcaccacaccacccggagcaccacaccacccggagcaccacaccacccggagcaccaggccacccggagaaccacaccacccggagcaccacgccacccggagcaccaggccacccggagaaccacaccacccggagcaccaggccacctggagcaccaggccacttgagcactcagccatgtgcttgggaatccgattttatggcagagctatttttacattttttaaaatgtttttaatggtggtggtttatgggattgtaccctgaggctttgtagtgctgggcatggtttaaaaattgattaaataaataaaattctgacacacctgaaatggggagaaggccaggctggctctgcctcctgtgggatagaatttacaaaatctgtacctgggtttgtttttgctccagggagaaggaaggcatttttaacaatgaaaaaaaaagttgctctctagaatcactttacattggacaggacccagtttgtgtgttgatgacagtcactatgtgcacaaactgccatcctcatcacctctctgagcaatggaaggtcagtgctcacacatgccccattcctctacaggaaaacccagttttggagggtcacccaaaagtagccaaaattggccccaggcacggtggctcatgtctgtaattccagcacgttgggaggccgaggtgggcagatcacttgaggtcaggagtttaagaccagccgggccaacatggtgaaactaaaaatacaaaaattagccaggcatggtggcatgcgcctgtaatcccagctactcatgaggctaaggcaggagaatcgcttgaactcaggaggtggaggttgcagtgagctgggatcgcaccactgcactccagcctggatgacagagcgagactccgtctcaaaaaaaaaaagccaaaattgctctgaaataattcggaagaaaataatttagctgaatatatgtttgataaaaggcataatatatgaaaacactgaaccagctagaagatatgttggagatttttaggataagagaaatttgctttgatggctttgaaagatggacccgttttgtagtaggaaggcgctttgttctgttctgaagtggagatgactggggtattccaggtgctgactagcagcgcacgaccctcccgcaccaaggcagccatttcttagggctgacagcaggagggcagggctgggcaggtggactcaggacggtgggtgccactcaccaagggcagctcttctcagggatgctccttggaaaatgagctctgccaatcggtccatcctggaagtaccacaccttgatatcctcctccaagagctgcctggtggagattaatctattgaaagttctgagaagtccagcagttgagaacttatctaactgtttttttttttaatgcatcattttcaaacttgtttaaccaaagaacttgatttttccttctggaaaatgctgcatatgtgtaattttcaatatttattctctcccctaaaatgtgaaatctccattttctatttctaggtaatccaaccagcaagacttttgcatgatcacttgtttataacatcccataggtttgaggacgtttgtctctatgttgccatcgtcctctgaatcgaggcatcaatacttgcagtgaaattaattaattttttaaatcctggcttcagagtccacagatgaagttcttatgactcatttgaggcctgtaggccgcaagttggccaacccaggcaggctgcagcctcctcgtggggtctaactagatggagtatcttcctacatcttgtatacgctccctgtgttaatctgttctcacactgctaataaagacatacttgagactgggtaatttataaaggaaagagatttaatggactcacagttccacatggctggggaggcctcacaatcatagtggaaggcaaaggagaagcaaagtcacatcttacatggtggcaggcaagagagcatgtgcggagaacctcccatttataaaaccatcagatctcatgagacgtattcactaccacgagaacagaatgggagaaacagccctcatgattcaattatctcccccaggccccaccttgacaagtggggattattacaattcaaggtgagatttgggtggggcacagccaaaccctatcactcccctccctcgtgactatgtcaggaagcttgcagtcaccttacaagtgacaccagactttgcacagctcagagccaagtgggaagggacattccctggagtgtccaacctggagaatggcaggaccgccccccttcccccgcccccgctcctccctcccctccccgctcctccttcatatcattcctgagacggcagcctcccccttttgtgttgtcagcctcagttgttttctttgtcagcacccacttaccaagcttaagctctaattacacttatctgtgctgaaaattggctattaccaccatataaactcctaatagtaagaaatacttccttagcaaactgcagggaccactttccttgttatcgcaacagaacagacagtggacagttgcttctccaggctgaacccccttgtttcctttgcttctggcggctgcaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggtaagtggaactccaggggcagacaatgtcaattgcaactttagcctcccgcctcctgcttcactgagctgagatccatctacatggtcaacaaggtgatgttggcggccaagagctggcatcaactcggggatgtctgggcaacatggacgtcttcaaaagcacgcgtcaacatggagtttgcaggtggacttgttacatccatgggcacattgttaaatattaagcatgtcaagttttagttgtttttttttttttttgagaaatcttaagaggaaaataactgaatttggcatttgaaataaatcagaaaattttaaagttttccaggtcatggggaagaagcatgtaccttcccacttatccaactgttctgccctttgtttaaagacaggaaggcgtgggctgcagaaccggcattcagggagtgctgcttagtcccgggcacagtgtggggtgccctgcacctgccagctctttcaggccctcttcaggtttttttgttgttgtttgttttttgagacagggtctcactctgtcacccaagctggagtgcagcagcatgatcatagctcactgcagcctcaacctcccccggctgaagcgatacccccaccccccaccccgcctcaccctcctgagtagctgggctacaggtgcaagccaccacacctggctacttttttttgtattttgtagagacaagtttttgcaatgttgcccaaactcctgggctcaagcgatccacctatctcagcctcccaaagtggctttcaggcgtgagccaccacgcccggccttgcctccctgttattaagatgaaaaaccctgggtgcgtgaggttaagtaacctgcccagacactctgcagcctcgaccggtctgaccccccactgtgaaatctcacggggtgggatgtgagccccgcagggctgatgcctcacctctcttttcttctttatcccgcaggatccccgggctcgcctagagatgtcctggtcaccaagtccgcctctgaactgacgctgcagtggactgagggacactctggcgacacacctaccacgggctatgtgatcgaggcccggccctcaggtagggtggcaggccccacaaacggggtctcagcccagcggacggcagtgcttctaagactgtgtcgggggcttccatcactttctctttcagcattttccccccacaaagctgggaccaagagggcggttttggtgaaagaagacatccatggctcactcagctcctcccagtcttcatagtcacaactgtgcggttcaccttaagggcatacgctttgggatgttttagccccaggacacttacttaggatgataatggttattcctagaaacaggtgaatgagaacttagggacactaaaaggcattttcaaactcatccatgaatgttttcagggactcatgtcagggttctaaatgtttgctgccgagatggaaaacgtcaggcttgtttctgataatacgaagattcttattaatagtgaaaccgacacatcgtttgcttcattttttaggcttccgaaaatgaggtctaagatccatttccagccttattcaccagaataatttttttcacccttccttccatttgcctttaataactaaggatgggcattattgggaaatgagtttctgatcgggtgcgtcggatatgactgcttggagctagtgggtatcacctaacacagaaagcacggaacagctccaatatgaccttcagatggttgcacagttaatcatgaacatctgagcatgaaaatatgtgatgtgtcagggacgctattcaggaagcaaaccatcaaaccccacctgccaatctggcaggaccacggtgctaggaactagtttagtctaatacttaaacaggctattagaccaagaggaaagaccccaaagctacatctgtcactgtgtcaggacactcgttccctcctcccccaccaaattgcttttgaaagattattagttacaagtgctttctagaaacttctttattttatttttttgagacagagtctctttctgtcacccagcctggagtgcagtggtgcaatctcagctccctgcaatctctgcctcccgggttcaagcaattctcctgcctcagcctcccgagtagctgggattacaggcacccgccatcacgcccggctaatttttatatttttagtagagagggggtttcaccatgttggccaggctggtctcaaactcctgacctcaagtgatctaccctcctcggcctcccaaagtgacaggattacaggcctgagccacggtgcccagccgccttctagaaacttctaaggagaaacctagtgcagaagcgtgaaaaagccaaaggcaacataaacatttctttggctcaataactcagaaatccagacgtgctcgcctgggggaccctgagagtatcttttgagcagggcgtctgtcctgttgtggaaacagagggtcctgagttggtaaaggatgtgagtttggcaggggcctcctgtggtcactgcctgtgaaagcccatggcccctcacacagccagctggccctttgctaatgactttgattcaagagcactttcagagactgacaggagctgagacgtgtgggttctggggccaaattgaggctttgtggaggccaagggggagggagctggtggcagggagcagcccagacttaagaaaccacttcagacactttcctccccatatccagggagagcaccgatttcttcctcaactcttccagcctgggtgacagagcaaggctccgtctcaaaaaaaaaaaaaaaagtttctagaaggcacttgtaactaataatctttcaaaagcaggttggtgggggaggagggtacgagtgtcctgacacagtgacagatataacaaataggatccaggcgttcacaaatagaattcaggagatccgtgagcttggatggggaaaatacacattttattttcactgacctctaactagaatttggcatttcctgtaattatggatgcaggcacattcgttatccagggctgccttagcaaagtcccacaaactaggcagcctccacaacagacatgggttgtctcacagttctggaggccggaagcccacagtcaaggtggcagcagggcaggctcctcctgaggctgtgagggaggatctgtttcctgtaacctctcccccacttctggtgattacaggccatcctgggtgatctggggctgacaggtgcttcacccatctctgccttcatcttcccatggtgatctccctgtatgtgtgtctgcatctcagttttatcttttatgaggacgccagtcatactagactggggacccactctactccggcaggacttcatcctaactaattacatctgcaactaccctatttccaaataagctcattgggaggtattgggggttcggacttcaacgtatgaatttgcagtggggggcagagacataattcaatgcataatattagctaagaaaccacataactcatagtaggccctgtgacacttccaggagtactttcgtatgacttccccgccattgcagatatttcacaatgctgtttagatgtgtccttacgttgaaatcacagtcatttgtagactctctgctggaccttgttggctaatgagtccatgaagcgtagacttttgagttgtgctgggataacggtggccacaggtcacctaaacccaactcttcatacgtcttccaaggaaccacgtcgctaaacaagttagtgcaaagaaaaccacccataatccatgcctccagcattacctggagacacgagttcccaggaacctgcaggtgcctccaggtgatcgtaggcattaccagttctgtgactccgttctcacattgccataaagaaatgtctgagactgagtaatttataaagaaaaaaagtttagttggctcacagttctgcaggctgtacaggaagcatggtggctttgcttctggggaggccccaggaaatcatggggagaccccaggaagcttccaatcatggcagaaagccaacagggagccggcacgccacatggctggggcaggaggaagagagtgagtggggaggtgccacacgtttttaaacaaccaggtctcatgagaactcactccctattgtaagaacagcaccaaaggggtggtcctaaaaccattcatgagaaacccactgctgtgatccaaacacctcccaccaggcccctcccccaacaccggggacgataattcaacctgagatttgggtggggacacagagccaaacaatatcaccagtagaattggtttccttttcaattttagtttatatatctacaaccattctgagaaagtgtccttgagccaacagatcgccacagggacccatggtgccgagagcagattaaaaagcctgtaatcccagcactttgggaggccgaggtgggcggatcacttgaggtcaggagtttaagaccagcctgaccaacatggtgaaacccagtctgtactacaaatagaaaaaaattagctgggtgtggtggcatgcacctatagtcccagctactcgggaagctgaggcaggagaattgcttgaacccagaaggcagaggttgcagtgagctgagatgacgccactgcactctagcctgggcaacagagtgagactctgtctcaaaaaaaaaaaaaaaaaaaaaaaaaaaaaaaaaaagacacccgcactagaaaactacagaagggcctggctacgaaacttcctcctccctgaacgcctgcctccctgactacagattaaggatcccagcagatgggtggctgtcacagggtcacagaaggaggcattctggatctcgaccgcatccctgcccatgtcccagttgtgagactgcagcacagttttgcaggatgttaccactgggggacactgggtaaaggatacacagacttgctctccgttgtttcttacaaccgcttgggactcttcaactacctcaaaatgatatgtttagcgtcaagtaatcattgaaaaagccacggtgtccgtcctccccagcctgctcggacaagcacaccaatgtgtctttgagcactcttgtgtgggagagcggcctgtgggatggggcggtaccagccagacacgggtgcctgggctcagcctcttaacgctgtgaacacatctcagcattttccaggcagcgataaggcattggttctcaggcttgccgagagagcccttgactttctcctcaggttctcatatgctgctccgccggctgcacgaagggaacaggacgcctgttggttactggtgcggcccagggagcctggcaggccgtgcggattagaagtaattggcgtgtcggcgagggcttcacactgggcccacgcctcagagtggcttgcctaacatggagaagcttctgaagtcagctgagtctgagctcagcagggttggggccagtgtgtggaaactgacccacaggggaccaagatgtgacaacagacttatcaagaagaccccagctttttcggcgagggctgaagatcctgcacttaattctgcttggctgctcaacattcaaaagcaggtcgccaacgatctcccctttcggatcatgaagggaacccaagcaggccgcgggacccgtgttctttcatgggaagttgagacgccccctcccttcaatgattaaggccagcagcagctcaggcaaatgaaacgctttatggattgtcaatatttaagcaccttgctggtacctgagggctttggatctcagctgtcatccattacaggcctcattacacaaaacattaaatgctgtatcatctcattttcccaccgaagctccctggcaagacgttctccaggtggggtgtggtttgctccaggtgcaatgaatgggccccgttttgtattgggaggggccacacaggggccctcaccgctgggtatctgggagacgggcactcggtgccaggcagcccctctggcccacgtggtcggctcggcctgatgtctctctatccagctgagtctctaccttgcccctgggagacaagacactcatcagctttgttgctgctttgcagagggtggccagcgggcctgggcagcccgggcagatggtagtggagcgtgctgccctcccatccccatccttccttacaccccccgcacattctactgcatagcccctgttgctgtggccatgtggagacgcagaactgagcagcagctaatgaaattagcaccaggctagaacacagatcccctcttattcctggagagggcgctccatgagtgtgagcccaaggacaccgccaccagcttccaccagcatggcctggcccacacgttcctttctctggctgtgcgtaagtttcctccaaattggtgttgcaaaactccctggaaggcactggaaactatgcactggacatatgcagatgatctatttacacagattattctaaggcattttactgggtagatcatgaagcctaatttacatatttacacaatagactggaatgacgctaaaggaactataaatatattttcctctccaaagcagccatgaaatacatatttagaatgtgcccaatgcaggcagatattgtattgcattttttttttttttcttaaataatgtgtgtagcccagagacgagggcaggtggctggaggacaggtcccgtgcctgatggggacaccccccagccggaggcctggactgctgtccactcgtagtcccctgggggctttccagttccctccccattgattttgttcaatttcagtctttggcaacgggagttttcaagtgagtaaggaagaaaatcagtatttctctgaaggtttgacatccatagaagttccaagtcagcaggttcagcaagagggggctgttgccatggctctgatggtgcccggtcccctcatgtgctgcttgtctttctcataagctgcttgtctttctcataagcgtgtttctgacagcttgtcagcccggcttcccaccccttcctgggatcagcctgcaacacgggctttcttcgtcatcttaacatgcaatgcattttgcctcctgccttgaatgaggatccgatggaaggtaactgtcttttttttaaatcagatgtatttagcctcatgtttaagcgccaccagcttcagtaaaatttctaacctggattggccattcatacaaaaagaaatggcagtatttaagaaataaacaactgacaggcttgcatttgctctgagctgcagactgacagtcaagcggttggttgtgtgagtgcgtggaaccagaaatctcaggcagtgaatgacggtttcattcagcatggagaccctgtttaattgtccatgaaatcaaacttttgtattggcatgacgtcggccctaatacctgcagcacgcagctccgttctgggcgttggagggataaattgagtgcagacccttcgacgtgctgcgctgggctccagctcaattcagaaaagaggtgatcatgtttctgggtgtattaggacattgtctgggaacagatgtgcctcctaccgcttgggcggggggagatgctggcaccagaagctaacagctgactcattctgtcggctggagacaagcatggatggatagcagaacctatttatacagaaaagatttcttttttcaaggatcttcaatattagccacttacttcccttgtttaagtggacaaatcacgccgtaaaaaatgaagatgcatagttcatattctttaaagaaaagccgcctcaatgggaagctgaactggctcttgctttttcccactcagccttccttctgaggtggacaggattggaggttgtggtgacagcgtggcttcttcaggaatattttgcaaagtctctttctcagtggcttcccactttcttagtggtatttctccaatggcgtttcagtaacaagagtccaggaaggtgctctttcgggcagccaggaatgaaagaccaagcacgatagacaggtgtgatttgcagtcacatcaccatgagggcacctccgccctccacagacatgaagtggcaggtccagcccagaggtggacattacccacaggaagttcaaaccctgggcctcagcaggggacttgatgcctgcatcagtcattttgggggatcagtgatctggggatgtggctttttaggggacatgactgtcctcttccagccgggcattgcttttctcttttctttttgaaaccgagtctcactctgttgcccaggctggagtgcagtggtgcaatctcggctcactgcaaccttcacctcccgggatcaagcgattctcctgcctcagtctcctgagtagctgggattacaggagcgtgccatcatacccagctaatttttgtatttttagtagagacggggtttcaccatgttgatcaggctggtcttgaactcgtgacctcgtgatctgtctacctcggtctcccaaagtgctgagattacaggcgggagccactgcacccggcccttgcttttcctacaacggcaacacagctcgttcactggggaagagaaaccaggctggctcttccggacatcccagagagctgaccctagcctgggtgattgacaagtggctgactgtgtgcccagaattgcctttaaaaaggatgaggccctgctgtcctctcgagtgttgactgagatggaaatccaggcactggggactgtccagaacatggaaaaattggttgcataaatctcatttttgctaatagttctgtaatgttattttccccctaatttgtagagatacttttctccatcattgatttattgagatatttaacagcataatacaaatgagaaaaacaatccacagttgagaaatagagtggacgccttaccagctgccaaatttttttcttacccactcgtgatcgtggtgtaaatattagtacgagataagtagcccggtgaattatagctagagtggaaaatatgctaatttgggaaaggcagaagtaagcagaataaaaatgggaacattttcttctgttaattcagaaggaaattatctcggtatgacattccccctcacccaacatttttgagtgtaaatggattgctaaataaatcgttctgcgttaagattctgtatcaatattttaaaatgttattatgaaaaatgcacacaattcctggagctatgacagagtgcttaaaataaaatgtggcctttaggtgatggtacaggaagggagaatcattttttttttcctcaggagcaggaaagcattacagaaacattaatgcaaaagacattcagagaatccactccggaggtgttcagaccttctcagaacagtctgaagaaatccttcactttcttagtcccttaatttcaatggctttaagcaacacccagtttataagagtctgtatttggtctttagtgtctattacaacataaaattgtctatctttttagaggaaaaatacaattcattcaatatataaagcccttaaaatagagacttgctcacagtaagcagtaaataaaatagtggtggttattatttattgaaagcctgctgtactaggccctgagaaagcccatgggatacaaagaggaatgcaggggttgggggtgggacagatgggtggatgggtggaaggaagaatggatggataatggatggatggatggatggaaggagggggacccagaaggaaggaaggaaggaaggaaggaaggaaggaaggaaggaagggtgggcaggcagatggatgggaggtggatgagtgggtggctggtgggtgagtggatggatagatgaatggaaggaaggaaggaagggtgggtgggtgggtggattgatgggtaggtagatgagtagatgtgtggatggatggacgaatggatagatggataggtggatgggtgagtgggtggatgaatggatgaatggatgggtggatggatgaatgaattgatgaaggaaggatgaatggatggatggatgaatgaatggatggatgcctggatggatagatggatggatggctagagggaagggaagggagggcaggggagggaaggggaggaaagggaagggaagggagggcacaggaggagagggaaggggagtggagggcagggggaaggaaggagggagggaaggaaggaaagaaggttggttacatggatgaatggaaggaaggaaggaaaaatggatggatggatagaaggaaggatgaatggatggataatgaatggatggatggatgattacttaggaagatggatcatggaaagatggacagaaggatggatggatagatgatagctggagggaaggaaggaagaatggaatggatggatggttacatggatggatgggtggatggatgatgctaagcctgatggtgtgaacagccaggtaaatgtgctgatgtgatttagaagcccattggtggaagcagtcatcccttcctggaacgtggggtggggtcaaggttgacctcaaaaagatgagtctgagggggcaaaaggactcttgattttcctccatcccctgtccacaggctgtgcgtaagtcattagaacagcaatctcatctgattccctgatggatggcacagggtctgatcaaagagtagaccgcatttgtggatgaataagggagtgaggcaggggaggagggggcaacagttctccaggtccagaggaggcctgaacagagtaaatgcacaagccttccctgaccattcttaagccaaactcacatacgacaatataaaccacatacaaccagcataaactacatacagccagcaatctgtgtgtgaacctcagcatcctaggagaaagaaggtaggcttaggctctggcttgccattctgacattattagtggtgatgagtgtcttggtgagaaatggctgtaaatgagaatatttagaaataatggccaggcatagtggctcatgcctataattccagcactttgagaggccaaggcaggcagatggcttgagctcggcagttcgagcccagcctgggcaacacagggagaccctgtcactacaaaaaaaaaaaaaaattaacaacttagccaggcgtggtggcgcatgcctgtagacccagctatccaggagactgaggcaggaggataacttgagtccagtagtttgaggctgcagtgagctatgattgcaccactgcactccagcctgtgtggacagaggagggcccggtctcaaaaaaaaaaaagaaaggaagaagaaagaaagagcaagagagaaagcaatcagagagggagggagggagggaagatcagtattatactacctttctgccggtggagagatttgtacctttaaaatctcattcacgtctattcctcattaacctgtgactgtaaggacttagtcggtgcacattctaaatcctctgcaaatacagacagatacaatagcaattttctgcctatttactgttgggctaatccatctgagtgtacctggtgattccgggtgggtgataaggttggtttccggagcagtctcagtgcccataaagtagtcagcacgggtacacacatatccaaatgggttttccctcaccagattccctgctttgtaaaagatctcatagctgcacctagaaaagcaaatacagttcatgaaggattgctacttcaaatgaacattttggcctctgagcctactttttttttttttttttttttaaccaaacagcctccttagaattgaatttatacaaacacacgtacagcacttactatgtgtgaggcactgtcctaagcactttataaatattaacttacttaatcctcaaagcaaatctatgatgaagatgcctttgttatcaccattctacagacaagggtcagagaggttccgttctttgtctaaagccacacagctaattgaattggtggggccaggctttgcaaagaggctgtctagctccaggctccagcacccctttcagccctgatgctatagtgtcataagtttttttctttctttttttttttccttttttctttttttcttttcttttcttttctttcttttttttttttttttgttataatgtgaagtcataaaaattgcaaagttctttgtttgttttttgagatagagtctcactctgttacccaggctgtagtgcaatggcacaatctcagctcagctcactgcaacctcaacctcccaggctcaagcaatcctcctgcttcagcctcttgagtagtagtagggaccacaggtgcatgccaccatgcctggctaatttttaaaattgtgcatatatatgtttccctgtgttgcccaggctggtctccagctctgggctcaagcagtcctgtaaccgcagcctctcaaagtactgggataacaggcatgagccaccatgcctggctcatcgtgattctttacaacaaatctcactgatcacatttcttttgctctgtggctggagagatgcctcagaacccaagtcatgtgcctctaacatcctctctatgtctgattttaattttaaatttattaatggctttaattttgagtttattcatgttttcttatatgtgaggtttataataaatcatacatacatatatttactgtggggagatatgcataacctaacgtttcccactatgaccatttcaagtgtccagttcagtagcattgagcacgttgttctacaatcatcacaccattcatctccagaacgctcttcgacttgcgaaactgagactccgtccccattcagcactcactccgcatccagtgcccctgatgcctcatccagggctgctgcaagccgacccaccaggcaggtgcatggggctcgcatctgggacttcgcacttctaacctctgctctcgcctccccatccctcttgcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcaggtaggccctcccagggaggtctgtcttcttctggaggactagagggagaaatggggtcgagggggacccagggaggtctgtcttctcctgaagggtgggagggagaaatggggtcgagggggacccagggaggtctgtcttctcctgaaggatgggagggagaaatggggtcgagggggaccctgggaggtctgtcttctcctgaaggacgggagagagaaatgaagtcaagcgggacgaaagggacacacatctgctgctgtaggtgtctccagcttagttgaggttctgcccagggaacatgtgggtggggagagcagtgccagtctccgggtgcctccccagtgccacccatcctcctgggctgctccctgcttccctctggcaggaccccaggccccagagcctcccccagcaccaccagcaaggccccttatgggctttgtgtccacgctgtgcaccggcaattcctaatgtgtttcctcatagttttaaaaatcagagacacatggaagtgtcagaggtgtgagcatgagccacgtggtgtcccctccgcaacaaaatcattcgcaaggaaagcagagccccgatcccctgtgttagctgacgcatccttgccgaggagcatgtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctgggcatttcttcacgtgcacaccttcgctgtgaggtaccgcaggctccagaggccaccctgggtccaggtccaggtctgctctcaggggagtggcagagaaggccagggcagggcttcctccccgagagcacccgtgttagatgacagacatgtctgcagtcagcagtcatggcaggggttatgacacacagggtgggggctgtgacctcgcctgggaatcaggaaggtgcccaaagcctaccacaggggaagggaaacctgcaggaggcagaaggtggcggagaaaaagtcctggtcactgaagagccgtgggtgggggagctggagagggagggccggcaaagctggtccctggttgtggccccccagccccccatgtgcctgtgagggactcaaccctggccgcaccttagggttgcttgagaaagttaaacacacaccctcgctggcccctcaccccagacagtgacttccgtggctccaggcgtgactttctttaccccgcgatgattctatcgtgcagaccggctgcaagccagggcgctggggggttcagagagggatgggctgtgtttgaggagaggggatctcagcagcatgaagggcagggaggcctcggcgttggggcagcagagcctcagccagaagccccaggtagggccagctctgttggtcctcttcctgggattaggaagaagctgttcctctcctctgcgttagagctgcttgagctactgactgcacttgttgaaattgaacttaaccttcgtcctttatgtgctatgagtttggaggaacgaccctgtgctcgtctgtgggtgagcgtgggccctaagcctggtaccctggcctgggaacatccttgaattccggggttgctctgtgagaggggctgtgaggaagggacccagaggaccacctgattttattttttttgagatggagtctcactctgttgcccaggctggagtgcagtggcgtgatcttagctcactgcaacctccgtctcccgggttcaagggattctcctgcctcagctcgcaagcagctgagattacaagcatgtgccaccacgcccggctaatttttgtatttttagtagatacagggtttcaccctgttggccaggctggtctcgaactcctgacctcaagtgatccgcctgccttggcctcccaaagtgctgggattataggagtgagtcacggcgcccagctgaccacttgattttttaatgagtaagatttagaaaaagcacagatttctcatttccctaattttaattatgaatattttaaatgtaccccaaagtatagagaatgaggaaccctcagcacccctcatcctaattcagagatccaagatttactgcctgagttttatctgtggaaaattggtacagagcaattacacatgcacagaaagccggttcctcatgcggaacgtgcactttgaccccacttcccagggcctgtggttcaggcctctctgaaactccatcagacgcagagctggccttgccatgagctggaccgcactgagctcatcagtccttcagggaagccagcaaccatcacctgctggcgtcaggaccgggccaggcccgcagccagggtgtcctgccccgtatgagagtcctccaggacagcccggccttcctttcctaccaggtgctggggtcaggcccactccgggccagttgcccggtggtgtaagtgtggcatgcgtcagacttgccgcatggagtaccaaatgcgcagcccacaaacctacttctgtcttttggatttaaagcaccgtcacctcctaaggagccctgtgaacctgcattagccaaagccgattccctgttcttcttcccggtgtgcacacatcccctattcgtgagatataggatagaagcttcgggtggctgtgtttggaagggttctggctgccgtgagccaatgcctgggctttgcctgtgagaggctttctgttctggggggcttccagtgccacagaacctactccccttccaggcccatggaaggccctgaatgggacgccgggaccacccagcacccatcaagatacaatttcccgcttttctgttctgagcgagcagaacgagacagaaggaagaagagcgtccttcaaagccgcctttacatgcatttttttctattgatttctcaaaaacacatctaaagacagggccagtcgttcagcttggttttgctagaggcagaaaataaataaaacacagccccaggctttaggggtctgtggcctgtggaggggccaacaggtagagaagcaaatacacacagtgcgtgtttgcggcgggggcttccatagacgtgcagacggcaggtcctggggtgcttcgtgggctcagggttcaccccgtggctgttgggaaccactgaggattttaggggggacaactgatttctatcggaggaagacctctcttgggtgatgtaaaggatggatctgagcaagacaggaggaggcgtaacaggtggaatgtgagtgctgtgcgcaggcaggaggtggtgacggagaaggcaggggacctggagctgttttggggggtgtcccagcaccaggagagagaaggacgtctaggcgctttgttccatcctcactttaacccacacaacgtttttgtttgctgccttgcttgttttgtggagacagggtcttgttctgtcacccaggctggagtgcagtgctgtgatcgtggctcactacagcctcgacctcctgggctcaagtgatcctcccgcctcagcctcctgagtagctgggactacaggtgtgccaccataccttgttttgtagagaaaggggtcttgctatgttgcccaggctggtcttgaactcctgggcttaagccatcctcccacctcagccttccacagtgctgggacttcaggcacacgcctctgtgcctggctgtttttttgttttgttttgttttgtttgttttttgtttttttagagatgggatctcactacattgcactggatcaggcagtgtttttaaacagatgaaattaagagaaagcaagcaggaagggcggttttgatgggcaaggtcagggcaaggacaaagatactgaagtctccagggcagggggcagcttggaggacagaggagccctgagcctgatcccacagaaaaggtggcaaatgggggctgttgaattcccaaagcctgctgaggaccatgggagcctcctgagcttgtcccatgggaaaagtccacccgcccggctggacattggtttcatctcacctgtaactgggagttatctaccccagccttccctgccaaccacctgactcgcgggaggtgactgcagctggagcgtctgccccatgtcattgtgtgtccgtgtcttttccacagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggtgcaggtccagccccttcctcgcgtgtcccacgatgccactcagccaaaacatagcgttcgttctctcgtggatctgccgggcccgtgtctgcttttccatttcatttgcttgtaggtgctgagagaaatgcaataggttttctttctgggggcagccaggcacagtgcagcaaacgctctatgcctcgggacccagatgctgaccctgcctgccctcagattaactatgtgtcttggataagggcgtatgagtcatccagcctcagagatccccactctgtacctttgttcaaatgcaattgctttttttttttttacagtctcactctgtcacccaggttggagtgcactggcacaatctcggctcacagcaacctctgtctcctgcattcaagtgattctcctgcctcagcctcctgagtagctgggattacaggcgcctgccactacgcccggctaatttttgtatttttagtagaggcggggtttcaccatgttggccaggctggtctcgaaatcctgacctcaggtgatctgcccgcctcagcctcccaaagtgttgggattacagacgtgagccacggtgcccaacctaatcacattttttaatagtattagaaagtgaggtgtgtctgggaatggtggcttatgcctgtaatcctagtgattttggaggctaaggctgaggatcacctgagcctaggagatccaggttgcagtaagccatgatcacaccactgtactccagcctggacaacaaagcgagatcctgtctcttttttttttttaatttgagatggagtttcactcttgttgccatggtgcagtctaggcttactgcaacctccacctcctgggttcaagcaattcgcctgcctcagcctccccagtagctaggattacaggcatgcatctccacgcccggctaattttgtatttttaatatggatggggtttctccatgttggtcaggctggtctcgaacacctcacctcaggtgatccacctgcctcagcctcccaaagtactgggattacaggtgtgagccaccgcgccctgccgagatcctgtctcttacaaaaaaaaaaagtatagagcattaaacaggtggcatattgtactatgcaatattataaacacagtgacctggggcactgctcagacgttgatgttttgctgtggctcagagactgtcacagaagcatctccatggcatagctcttctcacccactgcagcttgaaccttgcctgtgtccgtggtctagctctgagccgtctgagggccaggtcactactgtgtttccagcagaaactccacaccaggcatagagcaagcattcagtcaataagcatttattgccgaatgacccactatcattagagaaaggagcaaatgaacgtagggtaaagccagccacagagagcacagaccttgtgactccatttacatgaaggccaggaacacccacagtgaatggaagtttccagaaggcagaatcctgcttgcctgttggtggagaggtataaacagggaagatgcatgagagcacctcacaggtgctaaatgtgctctgtctctctacgtggacggtagttacattcacaatcataaagcatcattctggacacttaagattagcatagcttgtgcatttgattatcgtcaattttaaaaacctcataattatcaatgagaccacttctctggataaccagaatgtaactgactgctagaccgcagcctgttttttgttttttaaatagacgggtttcaccatgttggccaggctggtctcgaactccagggctacggtgatcctcccacctcagcctcccaaagtgctgggattacaggagtgagccacgcacggcgcccggcctatggcctgttttgatcctacggagcatccaccagagctgtagctgagcccaggaatgtggtcacttctgtgatatcaccacaaccgctgggccagacctcttcctgagctcagctcatttgttggaggttttcccatcaactgggtcttctctttttggaaaggcagatccctgatgagctgttcttaaaaagaggagctggctacattagccccctgagccaaggagccaggcagagtaggttcctgaccccgaccacaagtcctaccatccttgtgccaaaggggttaaaaaaaccagtcacctaaaatgcctccttatttgcttctataatgttaagcaattcatccttcaaagaaaggatttatttttttctgtataaattcacttctaacaagtgttcgtaaatcagattttattcctgagggatttacagtgtatgaatggcgtgtcattttcctgagttaatgctattacagaatcctgtgtctggtgcatagaaaaatctccctgcttttcactgtcctcctccatctggaaaacagacttgaaaaggcagatcggacctgcagcttccgatgctcagccgcaccctggagtgttaatttaacatcataattgaagccgggaaaaaataacacttatctaccagaatgtctcccgtcctgcccaggagacattgcagaacttaaacctctgttgtgatggcctcactcgacacccctccctgcgtgcactccttatcctcccatcctcgtctgaattcctttctgatcttggtttccacctgctcacctcccatcatcccaaatcccctctcccaggcaagcccatctttcattttctgctctgtgttcttccgttaaacacagagcattaaggtttaaagcacgtcaaaggggggccaggtcccagcagagaggagcctcttggggtttagaaatgccaacgcacttagcaaatacctgccaagcccctggtatgtgtgtaggcgctgtcctgggggctggcgggacactggggagtgtgatggacttaagtctgtacctcaaagagcaaatatgtacatgggcctgagaaacagaggtcactttatgtggtcagggaggtcgcctctggtctcagggcgtttgagctgtgatctgcaggaaggggagagaaacccgggaaatactgggagaaggagcttccagcaagagggagagccccagggggagaaacccgtgttagggaggggctgagggctggaagatgacgcgggggtttgcagggtggacagaccaggccaagcttgggggcagtttggaggccttggtctttcctgcagaatgagccgggaaaacccagtgcaattattttttatgttgttcggtttttcagaactttatttttattcatttgatctgttaatatattttagaatgtgttttgctatgtatttgtaaatttactcttttttgaagtgtgcggttcagtggtgaacgcacaggtacgtgcagtcatgaccacagtcagttctagaacgttcgtgtcacctcaaaaggaagctctgtaccctttctttagccgtcacactcccacacatttatctttacttcctgttttgttaaatgagtgtgagtttttattttgaaatttattaaatatttaatttcccggaatttttagaagtgtatgcattcttggccaggtgcagtggctcacgcttgccatcccagcactttgagaggccgaggtggaaggatcacttgagcccaggaactcgaaaccagcctgggcaacgtagcgagaccccatctctaccaaaacaaacaaacaaaaaatcaaaaaaagtttatgcattctgagtctattttcataaaacactggcaagaatactggtattttgggatcagacagaacaaatatgaaaatgctaatattgtcactttgctccaacactgtgatcagtacctagctcttctccccagctcagccctaagcacagctgaagcaggtatcctcagctctgggctctgcgtgcagcaggactcaggagctgccccgctggccagctctggcttggcgtggctgcggtggccacaccagtaacacgtctgttctcactctcctgctgggctttaggaaaggggatctccaccatggaggagtctgtgaccctggacaacggaggatttgctgccctggagctcagcagccgccacctcaatgtcaagagcaccttctccaagaagaacgggaccaggtaggcaggcagtgctgtgctgcgcccacctggggatctgagctgccagggctggggtggcagcccacgcccactggcacctcctgcatcccgccctgtggttccaggaagcaaaacccaacccaccgccaagtgcgctcccaaaccaccaggggcagccctgagtctaggagggacggggtcggcagagcggctggaaatattttcaggacatctccggagatttagaaagagggtctcaggtgtgtgggaagggcctggaacacccaggggctgccaggctggccttctgtgtcaatcgcatgcaccttggatctgggcgttcctagttcatggaggtgtcacctgggctgccacaggcccgaccaggtgtcctcgcaagcaagcctggtgcttgttgctgatttcattgctctgtgtattccaaagttttcctgtgccgatacacattgccattccatacacggattgagtgcaggcgagaaggattttcatcaccatagcctccttagcttataatccttttcctaaatccagcaggaagcagggtttcccaaacaagagaggggttgacctgggtttgcctttttgatgtgcagagcgccatcctctgatttgagtacccttgaccaaggagaagggccaggaatggggaggggtcttgagcgtctggaaggaaaaacccaaacacctgaggacgcttcgtctggagaacagacagctccgggctttcccagggtgccccagcatcggggtggaggaggcttctctccctcagccagactcaccttggattagactcagctgcaagggtgtggaaatcacacatcatccagacccagacagaccccagggtttcctcttccctttactgtttacaaagctgcaggggccagcagtgtttggagattccctgggccgcccccgccctccactgaatttgggaatcttagatcactcgggtggcgccgaggcacgggtgggccttctcccagccactgacgctctgccagccccacaggtgccagtccaaagcaccgcaggccgccaccccacgaggccttcccaagggctggaggtggatgctggtggtgacatctggtcacacctttcatttcatttgtctactgggaggcaagtttttcctgccgtgtaatagaaacatgaaaaagcaaccacatgtagtttcaaggccaggaggaacttgtcacagagaattttaagatattacatgccctgcttccttgctgcaactctgtcttctgagttctgagaagagacacagccttgaagcacattgcccaagaatagacagtcgttcagtttgttaagtccatctgcttcctaggaaagagaaacatcatttgatggtgaggttggaggttctcagcccacaaagacccaaggacaaaataaaattaagatggaaaagaaaatggacccttcccttaggtttttaaataagccatcaccttttcagtcctagcaataggaccctgtattcatctgtcctcacgctgctaataaagacatacccaagactgggtagtttatacaggaaagaggtttaatggactcacagttccacatggctggggagacctcacaatcatggcggaaggcaaggaggagcaaagtcacgtcttacgtggtggcaggcaaagagagagtttgtgtagggaaactcccctttataaaaccatcagatcgtgtgagacttattcactctcacgagaacagcacgggaaagacctgcccccatgattcaagtacctcccaccaggtccctcccacgtcacatgggaatgatgggagccacaactcaagatgagatttgggtggggacacagccaaaccatatcagaccccacatgtgattgaaggaaaggattctctgctgagaggggaagggtctgggcagggacacctgagattggtcctgtagcatcatccccaaaatatcttagaaatacgggcacagttgatttatgtctcccccgtgcacgtttgtgcttccaatttctttttggggaagacaccattttagctccttagataaaaagatttacccaaatgtttagataagaaatggcatctttcccaaagtaaattacctttgagatagagaaagaaaggcccttgagccttcactgggcctttccaggagaaactgaggcacaccctgggggagacaacacccacgacacaaaaccagaggtctccatcccctccagccttcccagcagagtctccacccaaggcctggtttcctggcctgtagcctctccttgatcacccagtgttacttctcccattgagggatgagaagacacttcctctgtagctgccactcagttctgcactcactcctcgcagcatgagggagggcttgctgggttgctgggggtcctggacatggtccctttgagcacacagctgcctgtctgactgcccacaggctgctctcactatcgagtccctgcacacccttcggaggactaaggagcactcagtcctgcctgatgtgaaaattcagcaatgttgtactcagagtttttccccaagttctgagttctccatctgaaaaacagaagctgggcttttactcagctcagatagtcaccaggaagtggggagctgaagagggtactcattttctatcgctgcatggcaaatgatcacaagttcagcagcttaaaccaacacccatttagcaccacgcggtctccctggggcaggagtctgggcacagctcagctgggtcctctgctcagggccttgcatgggtgtaatccaggtgtagatgggctgtgttctcatctggaggctcaactgggcaagaatcttcttccaagctcattcagcctgctggcagcatgcatttccttgtggccgcatgactgagggccccagcctcttcttggccctcctctggaggccgccctcatgtcctggaggccgctcatggtcccctgccatggggtcctctccaggggctgttcacaacatactgttggcttctgtgaggccagcaagagcatctctgtctccagtccgccaagatagggtctcctaatgtcatgtgatcatgggcgtgatgggagtagctgtccttcacccattccatttaatgtaaccgagtcttcagtctgccatgttccactggttagaagcacgtcacaggcccttcccacattcaaaggatgggatgatgggggtgggggcagtgatggagccatcttagaattccaccagccagagaggacgaatgctcccccaccagacagggagaccaggcctggtgcaaacttccccaattccctctcatctgtaggagacaattcccactccttagcatggcagatcagactgttcctcatgactccatcctcatctctctccactgcactcccctgcctgcatctggcaagcacctaagctccccggcctcctatctgtcccgacctcagggtgctgtttgtacgtgagtgtctcactgcccctcctggcacagaccagctcttcctccatgcctgcaggcctagcacagtctccacaactgacaggcacaggtacacagaggctgttgactcaccaggtagccagtgctcagaattttttgcatcagttgccaaagtgatgtcaaaggctgtgggtttcctcttagtccaacgcaataaaggccaaatgccaggttaggagtcctccggggaagggcgtcttttgcccagagggtaattgcagcatgggtcctcatcctaggtccccaccccggcctagccccggcggcctgcactactcagacgaggacatctgcaacaagtacaacggcgccgtgctgaccgagagcgtgagcctcaaggagaagtcggcagatgcatcagaatctgaggtcagtgtcggtgcctacttccgggcagtgaccatcagcccctacttctgcagtgagacttctgccccctcaggctgtcttgtcctatttgagtctcataacatccccacaggcagagccaaggacaaagggcttcattatgcagatgagaaaagagccgaaattcaaccccacggcctgctctgggccccgcagagctcacatagcctcgagcagtctagacattccaaggctgattcatggaggagcaggttgtgactcctaagtcctgggatctgctttaggcccagcagagctcacacagcttcgagcagtctagatgctccaaggctgattgatggaagcgcaggttccgactcctaagtcccagagactgcagtgagagataggcaaggctggtgccctctgtgagaggtttcttgcagagcagagtgtgggtgttgcctgggtgccagcaggctgagtgtcagatggtcgctttcacgtgctccatctcatgtagtcccggggtaactgggcctagaccacctcttacagatggagccggcagggctcagggaagatcagtaactttcccagtgtggactcctgcctcggaggcccattctctctccatttcactttcatagataaacataggctgccataaaaattggtggtctgtagaccccagttagggtggcagcgggtctgatcctgcagggcggatagaaaatgtgacccctttaccagataggagcttcctgctcacccctggacattcgtttccccctacaccctgccagcctcccaccctgcccaggaagcttctgtcctagctccctcccttgcgctgaagaagagggatttgctcacagcagttccaggtcatgtatcgggctcagggtgaatccagacttgggatgtgttcctctcctcaccaagcagctggaccagggagatggcttccccgagggagtgtcagcctccacgcgctccctccaggaccccagggcctacccgcctcaggcctcccctgcgcctgggtgtgcagcagttgagacatggagtgtttttcctgtgccaggtcctgtgcggcgtgacccaaagggactttaaccagcaaggcagccacgagggggctctaagcagggggctcaacacaccttccctacaggtgcaccatctccgtttctcatacttaccagcaaaagcagcagaagcagcaattggagaggttgccccttgggtcctgaacttttttcttttggatatgccaggcctggagaggggtgaaaatcaccaaccattggctgtacacataggcctgccccgcctcctggcactcaggttctaaatcaatatttaatctaaaataagtctcaccttcattttaacctgaattcaggccttattgagccccggggctctatcgaatggcttcttttcaactgtgggttgtagatgaactcccggcgggaagggccagcaggtgggtgtggtgaggccgattctgctttgctttgcgtgttctgtttacagaggatgccgggtttgctgtccgcaccatagccttgggcttggcagaaacagcaggcagcaaagcagatgctcggaaagggacatttgtctaaaactcaggggctgtcaagtgaaatcctgcaaaactacctgcctttttgtgataaagaaaaagcttatcagaagctcgctgcatgtacgaaagcagcaggttgtgcggagcaggcagccttcgagcaggacagtctggtcagcaaagaggctcatctcacagcgccggcctcgggcctgtccctgctgccgctgccgggccgctgctctttcgagtatccaggcaccgtgggggtgtcatagctgtgggtggttcctgtgtgctgagcgctcgctgctgtgtgtttccagcactcactgtgggcctggcccagggtgaacgtgcactcctctgctgcccaccccagccccatgaggtggggccagtctccttattggtcagaggctgaggttgtccagcaggcggctgttgaagctgacacccagccagacccccgtgtctccagagctcagtgtaccccttccctccccattggtctcctccagccccacaccagaggaaggggagggaggcatccagggatggtgtgtcctagagcaggcgggcaggattggatctgtgaactctgaatatttgttcctaaaagcattttcaacatgggctaatggaacgcatttggtctgtttctccccccaacatatgtggcgtgtttggagatttaacatcggcaaatgtttatggaagattattgagcacacccgtgaactgagctaagcatatacattcacgtatgcatgcacacatgaacacatatgtacatgtacacacatgtgcacggacacatacacacctgaatacatgcacacacctgcatacacacatgcatacctaaatagaacacacaacacacacacctaaatacacacacacgcacacatatctatacatacacacatgcacacacatatacatatacacctgaatacatgcacacacacgtttacctaaatacaacatacacctaaatacacatatgcacacatatgtacacatacacacatgcacacacgtatacctatacacctgaatacatgcacacatgcatacacacgtgcttacctaaatacacacaacatatacacacctaaatacacatatgcacacatacgtacacatacacacatgcaaacacatacatatacctatacacctgaatacatgcacacacatgcatacttaaatacacacaaacatgcacatacctaaatacacacacatgtacacatacctgtgcacatgtacaaataactacacacctgaatacatgcacacacatacatgcacacatgtacacacacgcacacgcacatacccaaatatgtacatgcaaaaatttgcatgtgcacacatacatcatatactcatacatatacctacatacctaaacacatgcacacaggcacatggctcacacatactacatgcatgtacgcatgcatatatacacgtgcatgcatacctaaatacaagtacaagcacacatgcataccaccatgcacacatacacatatgtacatacatgcacaacacatacatacctaaatacacacatacacatatgtacatacatgcacaacacatacatacctaaatacacacatgcacacatgcctgcacatatgcatatacacctaaatacaaacacatacacagaggtggcctcagggagggaggtgagtgtggggagggagggaggtgagtgtggggataggggaagaagggtggagggcaggacatggaacccacactaaatggaattctgcacagagggtgttatcatccttatgtaacaggcagaaagccgagactgagagtttttgaatgtcttccctgagacacgcactgatgagctggactggagaggcagacctcagcatctaactggaaatcccaccttcccaccagtcctgctctcagagctgagtctcaggcagcgtggctgaggtggcaaggggcctgggaaccaggccacactgctcccacatggcaagccctgtgctggaggaaagcgttcctgcaaatgcacctcatggttcctagtgccttttgggtgacaggctgcttctggaggctgatgaaaggtgcagacatgctctccacctacatacaggcagaatttcacctaggatttgggggcccaaggcaccccggaagtctcttacagaccccaccagctagcatcccatagagtcccagctaagaatccccacacctggaccatcctgtgctccccaggtttttgagtggataaagcgtagcctcccttgtctgtagagctctttgctaggtaaccttgctgcatcctgcttttgaagcttatgaatttgggggatttgaaggcactccatattcatgggatcccaacagagggaaccggggacttagatcgttttggaagtgccagctcacatggtaacattcactttgaaccactgtttgaaacagctggattaagacctaactcacatgtcatacaattcactcatttgaagtacacaattcagtgggtttcagtacattcacagagttgtgcagccatcaccacagtcaattttagaacatttccatcagcccccaaaacaccctgtaccgattagcagtcactcctcaatctccccaaaccacccacatacacctgcagccaaccccagctcttggcaaccagtaagctactttctacctctctaggtgtgcctatgtggacatttcatctaaataaatcgtacagtatgatgtcttttgtgactggcttctttcccttagcatgatgattgcaacgcatttgaaccacttttacgaagtaatcaatttgtgtgtttcatcagttctctttcacattgtttgttttaaaatctgacttcagaacttctccctttataggaaacaaacatgttgtattttgcccatgtggtttcttggaacagaagtgtaatttttttttttttagatggagttttgctctgtcgctcaggctggagtgcagtggcatgatctcagctccctctaacctccgcctcctgggttcaagcaattctcatgcctcggcttcccaagtagctgggattacaggcacctgacactatgcccagctgatttttggtatttttattagagacagggttttgccatattggccaggctggtctcgaactcctgacctcaagtgatccgcccacctcggcctcccaaaatgctgggattacaggcatgagccactgtgcccggccaggaagtgtatttttctgtgtagggtctaacggaacacaggccaaatgtcacaaggggatttggaaaggctgccatcttgacaattatgtccctcctagtccccaaccccactctagtcagaatcttctttttaaaaaatgctttattgagttataattcatatatcatataatttgcccatttagaatatacgattcaatggtttttagtattttcagtttttgcaatcatccccacaattttggaactttttcatcgctctaaaaagaaaccccataactctaccagtcacctcccattcccttctccctccaaaccctggcagccactttctgtctctatagatttgcctatcctgagcatttcatataacagactcatgcaatatgtggttttgtgattggcttatttcattcagcataatgttttcagagttcatcagggtcactgatatatgttgtagcacatatcagtacttcatttctatattatatggggggaaattccattgtatggatataccacatttaaaaatgcattcatcagttgatgaacatttgagtttgttgtgtctgggatccccaagagcactcccaagttcagtgattcactagaaggactcacagaattcagcacacaacatcctcatgactaagatttattacagcaaaagaatacagagcaaaatcacaaagggaaaatgtgcacagagcaaagtccagaggagaccagattcacgcttctaagagtcttctcctatagaggcacacagaacacacttagtcctccaccagagagctgtgaggacacataggaattgttgtctaccacggctttaccatagccttgcacttatagcaaactgcaactgcattgtaggtactgctgattagaaactcactgcccagggtttttatcggaagctggtcacataggcatcctctgccaagcatgtaccaaaactccagactccagaaagaaagcaggtgtttggcataaaccatattatttgtacagtttagacactgcagtcttataatttagggaaaacattttatcaatgaaaggaactttttaccagtcaagttcccagatgccaaccaagggtaatctttgaaagcaggtctttttaaggctagtggtctcagacctgctctgttaactttcttccacaccagattgtttctactttttggttactgtgaacaatattccctttatctggttgagtttggtgagtgtttttattatcgaaaggtttggagttttgtcagatggtttctctgtgtctgtctggatgttttttgtcctttgttctatttatatggtacattacattaactaatgtttggatgttaaaccaaccttgcattcctgcaataaatgcccattgttcatagtgtataatcctttctcttttttttattatacgttaagttttagggtacatgtgcacaacgtgcaggtttgttacatatatatacatgtgccatgttggtgtgctgcacccattaacttgtcatttaacattaggtatatctcctaatgctatccctcccacctccccccaccccacaacaggccccagtgtgtgatgttccccttcctgtgtccatgtgtgctcattgttcaattcccacctatgagtgagaacatgcggtgtttggttttttgtccttgcgatagtttgctgagaatgatggtttccagcttcatccatgaccctacaaaggacatgaattcatcattttttatggctgcatagtattccatggtgtatatgtgccacattttcttaatccagtctatcattgttggacatttgggttggttccaagtctttgctattgtaaatagtgccgcaataaacatacgtgtgtataatcctttctatatgttgctggattcagttttcaatattgctgagcatttttgtatctatacttataagggatataggtctgtagtttacttgtcttatttatctttgtgtgatttttatgtagggtaatattggccttattgaatgatttgggaagtatttcttccacaactggtattaattctttaaatgtttgatagatttcatcagtgaagtcctctggtctcgggcttttgtgtgtgggaaattgttaattactagttctatctgtttattggctatagatttattccgtttccccccccctctttttttttttgttaagtcagtgtcactcatttgtgtctttctaaggatttttaatgctacctcattaatctaatttattaagatacagttgcttatagttgtgtacagttgtttataatccttcatttctgtaaaggcagtggtaattaatatcaataattcattcctgattttaataatttgagtcctctctcctatttctggttaaagttttgtcaattttgttcatctttgcaaagaaccaacttgtagtttgattgattttctctattatttttctactttctatttcatttatttctactctaatctttatgactttcttctgcttaatttggagttaatttgctcgtcttctttcaatttcctaagttggaagtttatgttgttgatttgagatctttctttttttgtaaatacaggactttatggctaaaaattcccctctaagcactgtgttagctgaatctcataagttttaatatgttgtgtttttgttttcactcatctcaaaatatttttttaattttctgtgtaatttcttctttgacacattcgttatttaggagtgtgttttacatttcctcatatttgtgaatttcccacattttcttctgttatttatttctaattatatcctattttggtcagagaaaccataatttatatattttcagtcctttaaaattcattgggtcttattttaaggcctggcctatggtctatactggagaatgtttcctatccacttgagaagaatgtgttattctgctgttttggggtggagtgttctgtatgtgtctgtaggtctagctgatttatcatgttgtttccatcttctgtatgtatgatcttcttcccagttctgccatttgtcagtgcattgaaatctctatttgtattgaattgtctgtgtctcccttcaaatctattcatttaatttcatgtattttgaggctctgttaggtgcatgtgtgtttatagttatatcttcttgatatatttaccattttatcagatatttgctttctaataaagatatgtctcgtatctttattccctattttccactatcagcttctttttgttaaatgaattttccaaatatatcattttgatttccttgtttttgcttttgctctatatttttggatatttttgttagtgtcttactctagtattattatctacctcagatttatagtacattttcataacttatgggaactttactcctatagctgtatttcttccttttctttttgtgctattactatacatattttaccggtagattaatgatttttatcaaatttgggaaactttaagtcattattactttgagtgtttttgtttttgtttttgtttttgtttttttgcttttttctctttctcctctcattctgatattcttattatacgtatgttggtgctgttagtgctgtcttatatttatcaaaggctctgtccatttttaaaagtcttttcttcagactgcgtaatctctatcaatctatctttaagtgaactgattctttcttctgccagctcaagtctactattgagcctatctaatgaattttaaatttcagttattgtatttttcaactcaagaacttcccatttgtgtttttaaaataatttctatcactttattgatattcttcaattgtcatcatacctttaattttttaaacatggtctcctttagttctttgaacataattataatagctacctttgaagtctttgcctgcttagtccaatgtttgggcaccctcagaagctaccttctttttttttttttttcctgtgtatgcattatactttcctgggtttttttgaaaacagatcatttttggtcatatattgcagcaactctgaataatgatattcatgcctcattgagggttattgttgcttgcttgtttgttcagtgatttggctagattcattcagtgaagtccatttcccctgcactgtgtgtgctctcatgttgctcctcagtcttgggcaatgcatagagtcttgctgcctaccagggatgactgtggttttagctgggctccctttgcctgtccccattaagattctggatggtttaccatgattggcgtcatacccagcagttaacctccactacgtgctagctctggttttctcagcaatgccttagtgcatagattgctcctcactttctgatccagttgaagtccagcctttctgcagttgccagatgctgtcagtctttgaagcttgctctgacactaagaggcctcttcttagcttcagaagtctcttttcctggttctgtctttcaaactgctagctggttttaccgcttccattgttgctgacatggaactaccagcttcctcttcattcctcacctccaaagcctccacagttttcaacaatgtccttaggtatgctctgttccaaataaagtcattttcctcagtcagagctggaagctctctgttcttacagaataactctccactctgcgcaggacctctgtgtcactgcatcaaagtggaggtgaggacaatagccttcttcttccatagtgacacacccgctacacaagtggggcactgggttgagagggcagtccctggacttttgggcctgctcctcccagcgtgggacttcttcctacaaacaagctggggtgggagcactcggggcccagtattcttggcgtaccatacctggtacaggctcccagcttacaagcaaaggctggatgcgggacaggagccccagtactcttggccatctctgcctagaatagagcttcttcaacatggagttgggttgggggaaaggggaagctggataagagatgccagaactttcctctccaagttaaattcctaaaccagcagccctgccttgttgccacatctgcccagggtggaatttctgtcacactgagctgggggaattggatagggagagcaggtcatggctcaagcaccacagactctcactatcgagtgagatttagcgcagatcttgtatcaatctatctttctccatttgctatctactctgagcaccatttccaaatactttttttttttttttttttttttgagagggagtcttgctctgtcacccgggctggagtgcagtggtgcgatctcagctcactgcaacctctgccttctcagttcaaacaattctcccacctcagcctcccaagtagctgtgatcacaggtgtgcgccaccacacccagctaatttttgtatttttagtagagacggggtttcgccatgttggccaggctggtctcgaactcctgacctcaagtgatccgcctgcctggtcctgtcagaaggctgggattacaggcgtgagccactgcacccagccttcagagattttagatggttatttataaaatacttttcaccagttaaatcattgttccgctggggagagggtctgctgacctcctcacattgccattccagaaatatcctggccttcatggctagtaactctgatattcagaggggactgggaagaaatgtgggctttggcctggtgccttaactccaagtttacagaaacggaatccagtcccagaactgcagaaaaggctgttagagaagaaagcattgcagggaaagcagaccgagggttgctcagcaatggaataaacccaaaagctgtagcattggttttcaaataggactatcaaaaaagtggcttggatttcgacgagggtttaagacgtttatcctctctactggagacagcttgtagatttgagtacaatataaaccgaaatgttgggaataaagagtaatgtacgtcctcggccctggcttcaagccagtgttttgacacagcatttttgttggtgaaagccgtggacagaggcaggcttctgctcaccgtcttctccagggcccaggggataaggagtgagaagccctttgtggtctctgctagaaaaactctcctgagaagcgaagatttcactaagaaaacagtgaggccatccttttatcccccaggacatttttaaaccactctcagaactattgctaaagtgaaaattctgcagatccgttcccaggtgctcaggagccttcctgatcggaggtgctcctctgaattatgtcctaagtgtcacacgacgcatgctgtggctatttctgtttttctgtttagaaacaagagggtttgtcacggttttatcacatggctgcttctgaatgatatctgccgttcaaatcacatgttaaagattgttttcgaaatccaaagaaactgttttcaaaatccctcctgctcccaccagcttagaccaaccccatcgtacccaattaattccttaataatatttgagtctttcatcttgccaacgtaatacccaaagtgttgagattatctttattagctgctttccaggcgtctgtgcacctttagaaactctcgcagtcggtctgatactgcatccaatcactttctgtccttctacagtttcccgggaaaccgacacacgttgctacttcacatcacacaggaaacttaccaaaaacagactctgcagcatttccattttgtcaataattctaactcactaaaatacatccccattaaaaaataataatgtcatataaataataaacagagcaggcagcaggaggaagaatgacattttaagattgtgctttctcaaagaggcaatgacaggggctgagcaggagccaggaaacccagcttttagcttcagctctgcctgacatttattggtcatgtggctctgggtgtattctcacttctcctccctaaatagcaagaaggaaaagcctcttggagcctcgtgtctctgcttctttctgtacaatggttatgttctgtccgattagctgttattatagaatcacctggctgggtctgtgggcactggccactcagaactcacggcctcccagctttcctccccagaacaaagcactcttcccttccagctgcattgtgaaaaatcccaaggcaagactctgattggctgagctgaagccacatgcccagctattagccaatcacggttttctgagaggcaagctagcctatccatgtggtggggaagaactgcttccttcaaagaaggggttgaggcctagacacaaacaacaggaatcactgcgagttggacgaccaagcactcccaatttgtgtctcccgccaggcccccttcttggcacccacatgtgtcacagacccttctcttgagactacaggacttttagatctttggctgaggaaacatcaggatacatagcaacatatatacaagccgtgaaggaaatggtataaacacgcagatgggtgtgggccatgtgctacactcattctctaagcagttctggacatgctcttggaaatgtggactccagtgagagctcagcagtcccttccgaaccacccctaggccccacccagtgtgaaccctgcttccctacagcctggcagctgcaggaggaggggtgggcaggggtgtacacagggcagagagatgcccaaagggtcaccgagtgggtgcaagacagactaactgaattcgtagcatgccctcccactgaaattgctgatttccccaccatgcagagacgctttccatataagactcacccatataaatagcgtttctctatcttttctacaactggggttgaaggtatctcctccctgctactaaaaggactttatttctgccacctttggctgagaaaccaggctggttttggccccggtctggccccggccagtatgaccctaagaaggtcacttgcatttgtggatgttgattgtttcagacccaagacgaggaaattgaatccagtcaccacttctctcgtttttccccactaggatcccttgtggtagggaagttgaatggggaagacccccgggacctgggaatatagtcaaaagagggtgaaagtcttgaacctcatatttgaccttcagatgataatgaaccctaaccccagtttgtgaaacctagcactaaatttctgtcattcgttcctaaatattctgtgaatttctcgtgagaaaagtgattccttcactatatttcaatacatgtgattttccctaagtttcaggaagtttagattccaagttggtctctaaagaagtaacaaacccaattcaggggctaatcatggagattcctttggcttccttcagatgatctttgttctcttttcttccgttttagtttacgcagagcttaaccttgtaagccacctcaaggcccctagaaaacagatgaagaataaatcttaaacaggccaggtgcaggggctcacacctgtaatctcggcactttgggaggccgaggtgggcaaatcagctgaggtcaggagttcgagaccagcctggccaacacggtgaaaccccatctctactaaaaatacaaaaattagccaggtgtggtggcgggcacctgtaatcccagataggaggctgaggcacgagaatagcttgaacccaggaggcagaggttacagtgagccaagatcgtaccactgcactctagcctgggctacaagagtgaaactctgtctcaaaaataaataaataaatcttaaacagccacaaatacagatccctgatctcttagctgaaacccttgaggctagatatatttaagaatccagtgtttctcaagtttgggagtacatcatatattagggaactgctccagtagggccgggccagcgcttggcgaccaaacacattggtcttcttgtagcagaatatgagaatattcacactgaatagccctacatcagctcacctaggggtaagctgccaggttagctcaagtcagctcagccttcgccaccaaatgagttataaaaaaaccttttgagtttcagagcgttgtgggttttggaatttggaatggagggttgtacacctgttgcgcggatcctagagagaagcctggaactaggaggaagttacaggatctgcggaggtgggtgaacccgaggggttggggagctcaggtgcaggctcccacccagcctctctcgctgagccttgcttctttattcataaagtgggaattgtaacatctgcatcataggatcctcagccagttgcagagatcatgcccgggcattaatctggtatgtaatcggtgttcccgaaaaaggagccactgccacgtttatcatcgtcacccgatgaaggagaagctggctgctctggggtctctgtgtgtgtgggaagatgtgttcatcgtcacctgatggagaagctggctgctccggggtctctgtgtgtgtgggaagatgtgttcatcgtcacctgatggagaagctggctgctccggggcctctgtgtgtgtgggaagatgtgttcatcgtcacctgatggagaagctggctgctccagggcctcggtgtgtgtgggaagatgtgttcatcgtcacctgatggagaagctggctgctccggggcctcggtgtgtgtgggaagatgtgttcatcgtcacctgatggagaagctggctgctccggggcctcggtgtgtgtgggaagttgtgttcatcgtcacctgatggagaagctggctgctccggggtctctgtgtgtgtgggaagatgtgttcatcgtcacctgatggagaagctggctgctccggggtctctgtgtgtgggaagatgtgttcatcgtcacctgatggagaagctggctgctccggggcctctgtgtgtgtgggaagatgtgttcatcgtcacctgatggagaagctggctgctccggggtctctgggtgtgtgggaagatgtgttcatcgtcacctgatagggaagctggctgctccagggtctctgcgtgtgtgggaggatgtgttcatcgtcacctgatggagaagctggctgctccggggtctctgtgtgtgtgggaagatgtgttcatcgtcacctgatggagaagctggctgctccggggtctctgcatgtgtgggaggatgtgttcatcgtcacctgatggagaagctggctgctccggggtctcggtgtgtgtgggaagatgtgtcttacgtctgcaattctcctaaatgcagaggagccacagatggattcagctgttctgtgtattgtaccataagccaaacagtttatacttaatgttcggagaagtcccaaatctgtgactcgctgttagtttcatgtaaatattccagtttgaggtagattttcagcctgtgtccccaaatcccaggaacctctggctccctgctacgcctccatggggtttctgcacagcctggaggctgaccactctcacagggctccgggacagatccaagtccctaggtgccggacggtgtcggctcatggatcagagcttcctgcccgggtgctgatgtgggtaattcactctgactctcagatgagggagcagctggcaggaacatcactcaccgcacccagggacgcttttgttttcctgggtctcagtgtggacctcctgcaaaattaggggagctggcaactctcccatcccctgcccacccccgcctccagctgcaaggacgcagctcacacaccctggggaaaccggattggcagttttccttctagagtgtttacttctgaaagagctgctgtggctggcaatggggcccacatctggggccacagccgtctgtcttaacacccacaaggcgcagctcctagcctggccgctgatgggaatcctcagagagcctgtaaaagaatgcacattccccggcctccgacagacccacagagtcaggatagctggagccactcccaggaatctgctgcctcgatacacagctgatgatcctcagatggcatttcaaggccgctcactcttttaccccctccccagttcccttgataccctctggggagaggaaaaggtcaggtctgcctgacccctgtgagagacgggggccctgggaagcgtcttagcgttagttccgcagcagcgccttggtctctgtgccaccaggtggatcccctaggagcctgggaagctgttaggacgcacaggtgagggtcccaggatgcttccatgcatcgggaggatgtggcacttatcagcaaaaccgagaaacctccaccttcttaggggaaaaaaaaatcaatttcaccctctgctttctcctttttttttttttttttttttttttttttgagatggagtctggctctgtcacccaggctggagtgcagtggcgagatctcggctcactgcaacctcaagaatcccttgaacccgggttcaagggattctcctgcctcagcctcccaagtagctggtattacaggcacccaccaccatgcccagctaatttttgtatttttagcagagacaggtttcaccgtgttggacaggctggtctcgaactcctgacctcaggtgatctgccgacctcaggtgatccgctcgcctcagccacccaaagtccactttctcctttaacggtccttccaatgacttcacatcaaaccgaaagaccataaaatagaggtttgctttcagaaaatgaacctagaaaacatgcagggtccatgttcttaatggaagctgctgatttattttataaaaaggaaaaaaaaaagcctcaaagggactgatcttcaaacatcagtgggaggcctcaggccacttttccgtgtgtttgaggggccaggccattcagtacctggccggggagacatattagacaccctggcttattcaggcagcttcatttctccgtcccctccccaccctcggaggtctctgtggatgtgatgtcacacgatcacttgcaaggggaggatgcaccccccaatcctctcccctcatcacctcccccatcccctcccttctacttaatcacaccccaccccctcccctcccctctacctcatcacctccaccccctctcctcccctcccttctacctcatcaccccctacccctcccctcccctctacctaatcacctccccaccccctcccctcccttctacctcatcacccccaccccctctcctcccctcccctctacctcatcaccccccaccccctcccctcccttctacctcatcacccaccacccccttccctccccgccacctcatcaccccccacacccaccctcccctctacctcatcacctccccacccctcacctccacctcatcaccccccaccccctcccctcccctcccttctacctcatcaccccccaccccttccctcccctccacctcatcacccccacacccaccctccctgctacctcatcacccccccaccccctccttcccctctacctcatcaccttgcccacccgcttccctgtacctggtcacctccagaatccttttgttttggtctgtagcagcccacatcttagtctcaggcaagccaaagacccagatcttccccacccctggggctcttctatgttctgccctgtaggggcaggcagagtcccctggggcctgtgtggggaggctgcgtagacctctgctgggtggggaggccacctagatctttgctggggtgggaaggctgtgtagacctctcctgagtggggaggccgcgtagacctctcttgagtgagggagtccgcgtagatctctcctgagtggggaggccacgtagacctctcctgagtggggaggccgcgtagacgcctcctgagtggggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtgggggaggccgcgtagacctctcctgagtgggggaggccgcgtagacctctcctgagtggggaggccgcgtagacctctcctgagtgagggtggccgcgtagaactctcctgagtgggggaggccgcgtagacctctcctgagtgggggaggccgcgtagacctctcctgagtggggaggccgcgtagacctctcctgagtggggaggccgcgtagacctctcctgagtggggaggccgtgtagacctctcctgagtgagggaggccgcgtagatctctcctgagtgaggaggccgtgtagatctctcctgagtgagggaggccgtgtggacctctcctggggtaaggaaggccgcgtggacctctcctggggtaaggaaggccgcgtggacctctcctgagtgagggaggccgcgtggacctctcctgagtgagggaggccgcgtggacctctcctgagtgagggaggccgcgtggacctctcctgagtgagggaggccgcgtggacctctcctgagtggggaggccgcgtggacctctcctgagtgagggaagccgtgtggacctctcctggggtaaggaaggccgtgtagacctctcctgagtgagggaggctgcgtagatctctcctgagtggggaggcggtgtggacctctcctggggtaaggaaggccgtgtagacctctcctgagtgagggaggccgtgtagacctctcctggggtgaggagaccatgtagattgctcctgagtggggaggctgcatagacctctcctgggtggaggcccagctcttctcggaaacctggtacagagtgaggggctggatgcagctgagaaaatgcagtgtcggtcacacctggatcagggagggggacctgggggctgcctgctctcctgtgtggagggtgggagggcctggcattgggttggggtggggagagggctggagaccgcgacacacgcccctggggaggtgcccccaccgccaggcctcctgcccagcacgctccgggccctgcgccctgccctgcactcacaccttctctcccgctccccgcaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaa

SEQ ID NO: 1211 - DNA, 449249 bp, Homo sapiens
gttatttgcagccccgagatctacccagctgtggtgttatcccctttgttcaaagccttctttgtaacactggatcaaggtgtaggaacttcagctatgaagggtcaatggagcatcattttcggtaagagaaacacaaagatctttttcagaaatctcagaaagctgatacatagaacaggcttctgctttttgtaaagcctcaataatttgggataggtcagagatcatgagaagtatagaaattaaagttttattaaattcagagtcatataattctgcctccaactaatggttagcttccagcaggagatctttccactgtcacttgcgggactcacagagtaataactgattagcaaatgccatttgcatgtaataatttgttttctgtaggttaaaactcttgacttcaaaattacttgtctagccaacttttcattttagtgccacatgcccccagaacaattattttttgagctacctactgggttttttctcctgtgctactagttgactagaatcttgtcgccagctgagggaaaataaaactgggcagtaactctttatttgtcataaaccacctaaacggactacaggacagttaagttgccttctctgagtctctgaatgctgagctatgcctgtggttgcctacagtgtcagttggccttaaactcaagaagagaaggagaagaagatatttcatgtgagaagagacaaagtgagggggtttaacttgggggatcctgaatgccctggaaacttctcccaggtgaagttaggaagggaaggaagtggctagcggattaagatagtttgaatttatcaggtatgaatgatctgagttttatttaatctatatttactaatattaaacaatctaagatatttaaatgtaaagcaaatgttgacatatatgatctttattttccaactctaagttacaagaggaaaattaaaagtttccagataattttcggcatatcaggtacaatatttataaatggtgttgttttagttcatttgggctgctataatgaaataccataaactgtgtggcttataagaaacaaatatttatttctcatagttttggaggctgggaagtccaagatcaaggtgccagctgatctggtatctggtgagaaccctttccattataaatgacaccttccagctgtgttctcacataatggaagggatgaggcatctctccagggtctctttaatacgggcactaatcctattcacgaaggctctgtcctcacgatccaatcacctccgctatatcatcttaggggttatgtttcaacgtaaaaatttggggatgggagatgccaactttcaggtcatagtaggtgcttactttttctgagacaaatcatatagaaatatgatataaagaggctcatttgaaaatactgtaaagtgataaccctgaaaagttcaatggtcttttcttgaatgtgtggagaagggaaatatacaaaactctgtctttcttggaagcattagaagagcttgagacttagcagtgtctttatttcaagtctttcttatgtctcttccttacttggattgggaggtttaaatgatgttgaagtggaaagaatatgattttgtggctaaacaatactggctctgttacctgtggttctgtgaatctgtgcaaattaattgacctctttgaatctgtttactcacttcaagtgttgtgaatgttaaagacaaatatagaaaacatctagcgcaatgcatggcacagaggcattcaaccaatgggagttgataataacaaattcttattactacggctgtaacaattataaaaatactacttgaaggccaggcacggtggctcacacctgtaattccagcactttgggaggccgaggcgggcagatcacctgagatcaggagttcaagaccagcctggccaacatagtgaaacccagtctgtactaaaaataccaagaaattagctggacacggtggcagatgcctgtaatcccagctattcgggaggccgaggcaggagaattgcttgaacccaggagggggaagtcgcagtgagccaagattgcgccactgcactccagcctgggtgacagagcgagactcattctcaaacaaaaaaaaccccccaaattacttgatatcaggaaataatctacctttgttttctttgtgtttttccacatcaacatcctcacttcaatgtgcagaaattcaggggttataaaagcaacctggtgagattcttcacctaacattctgagagtggtagtcaggttaatagctcaccagcattgcaaagcctttaactttgagaacgaagaatgaaattcctcactttgtctggtagtgcccaagtcagaggtataagaaatacaaaataaaatagggaaaggaaattgtaaggagtaaggaaagagggagagggagaaaggagacaagaaagagtgaagcacgctgtcagtagggcctctggtttcagactcagccacttgaccaagcagatttcatgcgttttcatattggagtaagtgtggattcaattgaagttcaagcccataaataaagactcactcctgattattttgtggtaattgtctcagttaaaaaatacctgaaagcggctgggtgcagtggctcacgcctgtaatcccagcgctttgggttgttggggaaaccagccccacaccacctggcaggtaccccaagtccagcggagacaaaggaaatagaaagagaataagagttcaaaggcgggtccaggggtcctgagcatcggaggctcgctcaccgcgcagagctctcaggctccgcctactttattggtttacaaagctctttgttcttagggcagatgggagggggaggaagggatgaggaaaaggattaatcagtgaaggagaactcctgagtcattcaataagaagtatagcaatggcggtttccgtgaatttccttgagcaaaggcgtgtctaaactacttaagatctttaatttatctggactgaaatgggtgggagcgggtttcaggaggagccaagatgtttgattatactccactgcttcaagggagtgttatctccctgagcaacctgtggaatgctgcggagctgttacgctctcgggcataaagacaggaaggcagtaaggagacttttctcctcagaagctgcccatggctgtctcacacagaggagaccaactcgtctggcatcccagcactttgggaggctgaggcgggtggatcactaggtcaggagttcgaaaccaccctggccaacaggctgaaaccctgtctctactataaatccaaaaattagctgggcgtggtggcaggcacctgtagttccaactattcaggaggctgaggcaggagaagagcttgaaccggggaggcagaagctgcagtgagcagagatcgcaccactaaactccagcctgggcaacagaacaagactgtctcaaaaaaacaaaaaatcttgaaggcaaatatcacagttaatttagttcataatgtgtctggaattggtgggttcttggtctcactgacttcaagaatgaagccgcagaccctcatggtaagtgttacagctcttaaggtggcacgtctggagtttgttccttctgatgttcggacgtgtccggagtttcttccttctggtgggttcgtggtctcgctggctcaggagtgaagctgcagaccttcacggtgagtgttacagctcttaacacggcgtgtctggagttgtttgttcctcccggtgggctcgtggtctcgctggtatcaggagtgaagccgcagacctttgcggtgactgttacatctcataaaagcagtgtggacctaaacagtgagcagtagcaagatttattgcaaggaacgaaagaacaaagcttccacacagtggaaggggcagcctggctgctggctagggcagcctgcttttattcttatctggccccacccacatcctgctgattggtagagccgaatggtctgttttgacagggcgctgattggtgcgtttataatccctgagctagacacaaaggttctccacgtccccatcagattagttagatacagagtattgacacaaaagttctccaaggccccaggagaggagctagatacagaagtgtcaattggtgcactcacaaaccctgagctagacacagggtgctgagtggtgtgtttacaaaccttgagctagacataaagattctccaaggccccaccagagcagctagatacagagtgtcgattgttgcactcacaaaccttgagctaaacacagggtgctgattggagtgtttacaaaccttgagctagatacagagtgccgattggtgtgtttacaatccctgagctagacataaaggttctccaaggccccacctgagcagctagatacagagtgtcaactggtgcactcacaaaccctgagctagacacagggtgctgattggtgtatttacaaaccttgagctagatacagagtgcccattggtgtatttacaatccctgagctagacataaaggttctccaaggccccaccagactcaggagcccagctggcttcacccagtggatcccgcaccagggctgcaggtggagctgcctgccagtcccggtgccgtgcgcccgcgctcctcagcccttgggcggtcgatgggactgggcgccgtggagcagggggcggcgctcgtcggggaggcttgggctgcacaggaacccacggaggtgggggaaggctcaggcatggcgggctgcagtcccgaggcctgccccacgggaaggcagctaaggcccggcgagaaatcgagcgcagcgccggtgggccggcactgctggggaacccagtacatcctccgcagccgctggcccgggtgctaagtccctcattgcctggggcctgcagggccggccggctgctccgagtgcgggcggggcccgccaagcccacgcgcaccggaactccagctggcccgcaagcgccgcacgcagccccggttcccgctcgcgcctctccctccacacctccccgcaagctgaaggagtgggctccggccttggccagcccagaaagggactcccacagtgcagtggtgggctgaagggctcctcaagtgccaccaaagtaggagcccaggcagaggaggcgctgagagcaagcgagggctgtgaggactgccagcacgctgtcacctctcaataagtttccatgacctccctaattcctcaggtaagttcactttgggcagaaatcctgggtaccatctgatgtagcttatggttatgaaaatcagcttcctcattcctgcctttgttggggggtttccccttcattttaacaagaggatttcagagcagaaatatgaagcactgcaggcaacagaagtggatattcttgtgttagtggtcactcctattttgtttaatttaaaatgctttgtaatgcgaatgtgctgtctaaacccgaccctcacttccctttcactgtctgacaaccttcgggaggcggatcgccatacccatgctggggcactcccacccttagtctacagcacccggtgccttgccttctgggctttgattgggtgacctttcatttccagtttcttgaaatgtttccagccatttcctactggtctcatttggtggtcatcaatattttaatttatttttttctccattctcaaacatgcccagaccccctgagaatcatctgaccctctctgcctcttttccaaccaccatactgcctggttctcagccttatttgattatcacctgctgctgcctcacctcagcttctcagtttgcttttcactctcttgacactcttttttttttttttttctgagacggagtttctttcttgttgcccacgctggagtgatatgatgagatctcggctcaccccaacctccgcctcctagacttataattttttttttttttgagacagtctggctctgctgcctaggctggagtgcagtggtgcgatctcggctcactgcaacctccgcctcccgggttcaagcgattctcctgcctcaacctcctgagtagctgggactacaggcgggtgccaccatgcccagctaattttttgtatttttagtaaagagggggtttcaccatgttggccaggctggtcttgaattcctgacctcaggcgatctgccccccttggcctcccaaagtgctgggattacaggcgtgagccaccgcgcccggcctatccttgtttcttaaatggctttcctgacatggagacgtaacagcattagattcgccagggagaaggattccttctgtgcctgccgtcccattccgatgctttggggccctccacaatgatgagtactcccctccccttcctccgcaccttccaccgcatggtcggcctttctctttttgtattccccatctgtccagcccttacacagcccaaggtcttcctcttctatatgcagtcagctctgtcgtggtcagctacctgctcgcgatgcagcaccatggcttctgcacactgaggaaagacagctccggatgggtctggggtttatttcccagcccctttcataacttagtggagagctggcccaggaggggtgagtgaagaaagaaaaaacgatccaagctcctgagcccagagtctcccctcctgacccagccacttgcctaaggaagccctccctgtaactgcagtcacttgtctacctgcaatagagcattttagggctgggtctctgtcctggggttctctccttgccctgcctaggcatgtctcttgatggactgttgaaaacttgggaattatgtgctttttgctaggtttttatttttaaatttctcctccaataaaacttattttatttttacaccgtgtttagtatttcaattttgttttctttcctacttcaggttataaagataatttcttacattattttcttaaagtattatagtttttcctttcacccgctggtctggaattcatctgggttttacgtctatgtatggtgaaggtaatgatttaactgcattttttttccatttggataagtattttttcagttgtattattaaacagtttatcaatttcacattgatttgtaatcccattgtgacatgaattaagtttttgtatgtggtgcatctgcgtctggcttctccaacttgttatagccccagccattccttgaactataccctgctgtcttactgtagctttctaatgtcttgatatctgaaggagtaaatgtctctatcttgcacttctcctttagggaagtctttgttcttccatgtaagtgtaacaaccttgttgtacaagtcagtgaaaaatattattgggatttttattggagttgcattgcatcttgagatcctgatgcattatttaatttatttaggttttctttagtgtctttcaacatagctttatagtattttttcatgaaggttatgcatatctttcattaacttacttccttgttactttatatttgttgttgctattgcaaatagtattttttaaaaagttacactatgttacttatcattgcttgtgtaatggaaataaagttaattttaaaaatcaactttattgatctatacaataacatttaagagtacatttcaatgaatttgacatgtctatgcacctgtgtaaccaccatcatgattgaaatataaagcatcttcattttcctcagaattctcctgtgctctatcccagcccaacctacctccactcaccccacatcttcagatccaggcaatagcttgtctgcttttggtcatctagattagatttgccttttctaaattttatataaaggatatatccttggtgtttggcttctttcacccagtaaaatgttttgagatttatttatgtggttggttgtattagtatggtcatgcaccacttgacaatatttcagtcaacaatggactgcgtatatgacaggggtcacatagaattataataccatatcttaactgtactttataaatgtgtagacatgcaaatgcttaccattgtattacaactgcctacagtattcagtacaatgacatgctgtacaggtgtgtaggctaagagcaataggctacaccacatggctaggtatgtagtaggctccaccatctaggtttgtgtaagcatgttctgtggtgttcacacatgatgaaattgcctaagaatgcatttcccacagtacattctcttctttaagtgacagatgactataattcattcctttttatttttcccatgggtaaggatgacccgggatgttcttttctgtttttttggttaatttttaaaaaaaattttgtttctgaatatatattttaaaagtctttatttttaattattgtggatacatactagttttatatatctctgaggtatgtgcaatattttgatacaaatacacaatgcataatgataaaatcagggtaatcaggatatccatcatctaaagtataaatcatttgtgtgagtgtgtgtgtgtgagtgtgttaggaacattccagtttcactcttttagttattttgaaatatgtaataaattattgttatctatagtcatcccagtgtgctactcaacattagatccaactccttctatctaactgcacttttgtacccgttacttatcccctctatatctcccacctcaccactacccttctcagcctctggtaactatcattctactctctgtctctatgagtttaattattttaagctcccacatataagtgagaacacataatatttgtctttctgtgcctggcttatttcccttaacataatgccttccagttgcatccttgtcgttgcaaatgacaggatgtcattcttttttatggctgaataatatacgtactacattttctttatccatttatatgttgatgaacactaaggttgattccatagcttggctgttttgaataatgctgcagtaaacatgagagtgcagatgtctctgttttttttttccttttggattggatttatacacagcagttggattgctagatcacatggtagttttatttctagttttttgaggaacctcccttctgttctccatagtggctgtactgatttactttcctgccaacagtgtacaagagttcctttttcccaacccctcactaacatttgctattgcttgtctgtttaataaaagccattttaactgggatgagatcatatctcattgtaatttggattttcccttcttggatgagtagtgatgttaagcaagtgttcatgtcctagtgacccatttgtatgtcttcttttgagaaatgtctattcagatttttgcctatttttcattgaattgtttgtttgttttgtattgagttgtttgagcttgttatatattctggttattaatcccttgtcatatgtgtagtttgcagatcttttctcccattctgcgagttgtttcttaactttgtttgttatattattttctttgctgtgcagaagcttttgagcttgatgtgatccatttgtccatttttacttttgttgtctgtgcttttgaggccttactcaagaaatctttgcccagacctatgtcctggagtgtttccccaaagttttattctattagtttcatagtttcaggtcttagatttaagtctttaatcaattttgatttttttttaatatggcaagagataggggtttagtttcattctgcataaggatatccactcttagcagcatttattgaagagactgttctttcctcattgaatgttcttggagcctttgtaaaaaatgaggaatttaatgcttggatttatttctgggttctctgttctgttccattggtctatgtgtctgttttcatgccaatactgtgctgacttggttactaaagctttgtagtatattttgaaatcaggtaatgtgatgccatcagctttgctctttttgctgaggattgctttggctattttaggtctttgtagctgcatataaattttaggattttaaaaaatgaattttttttctatttctatgaagaacatctttggtattttcatagcgattgcattgaatctgaagattgctttggggaggatggacattttaataatattgattcttccaatccatgaacacggaacatctttctaactttttgtgtgtcctcttcaatttctttcatcagggttttatagttttcattgcaaggattttttgcttttttggttaggtttattcctaggtatgttattttatttgtagctattataaatggtattgctttcttggtttctttttcacattgttcactgttagtgtatatacatgctattgatttttctttgttaattttgtatcctgcaactttactgaatttgtttatcagttctaatagtttcttggtgaagtctttaggtttttctaaatatgagatcatgttatatgcaaacaaggataatttgacttcttcctttccaatttggattccctttatttctttctgttgctggattgttctggctgggacttccagtgttatgttgcataaaagtagtgaaagtgggcattccagttccaaatcttaaagaaaaggtcttcagttttcccctgttcagtatgctagtagctgtggttttgtcatatgaggtgtttattgtgcttgattgtgttccttctatatccagttttttgagagtttgtatcataaaggaatgttgaattttatttaatgctttttcaacatctattgatatgattatatagtttttgtcctttgtcttttgatgtgatgtatcacattgattaatttgcatatgttaaatcactcttgcatccttgggatggatgaatcccacttggtcataataaatgtaatattaaatgtaatattatatttacatgtaaatttaaatgtaatattaaattcagttaaatgtaatattaaattcagttttgttggtattttgttgagaatttttgcatctatgttcatcagaaatattggcctctggttttcttttttgttatttttttgtgtatatgtctggttttggtatcagggtaatactggcactgcagaacgagtttgacagcattccttcctcttcaaccttttggattagtttgagtaggattagtattaattcttgtttaaatggtaaaattcagcagtgaagccattgtttgggtcctgagcttttctttgatgggggaatgtttattactgttatcttattacctgttgttggtttattcaaattttggatttctttgtggttcaatattggtatgttgcatgtatctaggaatttatttatttcttctaagtttttcagttgaagaggacacacaaaaaatagaaagatattctatgttcatggattgcaataatcaatattaataaaatgtctatgcttccaaaagcaatctgcaaattcaatgtaatttctaccaaatcgatgtattgatatatagttgctcacagtagtctctgatgatcctttgaatctttgtggcatcagttgtaatttctccttttttgcctcaaactttatttatttgggtcttctctgttttttcctatgtcagtattgctaaaggtttatcaattttgtgtatctattaaaaaaactttttgtttcattgatcttttaaagaaaacttctgctctgatctttattatttcttctactaattttgggcttgttttgttcttgcttttctaattctttaagatgcatactgtattagtcaattcttatgctgctatgaagaaatatccaagactgggtaatttataaagtaaagagatttaattgactcacaattctgcaccgttggggaggcctcaggaaacttacaatcatggtggaaggggaagcaaacatgttcttcacatggcggcaggagagagaagcatagagcaaagggggaaaaagccccttataaaaccgccggatctcatgagaactcactcactatcatgagaagagcatgggggaactgcccccatgatctaattacctcccatgaagtccctcccacaacacatagggattacaattcaagatgagattttgggtggggacatggccaaaccatatcacatagttaggttgtttatttgaagttttttttctttttttaaaacttttgtgatgtaggcatttattgctataaacttgcctcttaatactacttttgctgtatcccacaggttttggtacgttgtttttctattttgatttttttttaaacaattttaaaatttccttcttaatttcttcattgacccagtggtaattcaggggcatattgttcactatttctgtgtttttacaacttgcaaagttgatcttgttattgatatctagttttattccactgtggtcagaaaagatacttaatataattttaattattttgaatttttttagacttattttgtggcctaatatataatatatccttgagagtgttccatattctaaaaagaagaatgcagattctgtagctgttggatggaatgttctgtaaatgtttattaggttcatttcatctatagtgtagataaaatcaaatgattcttcattgcttttctgtttaaatgatctgttcaatgcaaaatatggggtgtcaaagtctccagctgtgattatattgagatctctctctctttagctctgttaatatttgctttttatatatggatgctccagagttggatgcacccaatttatattattatatttatattacatttcgctgtctgagaggtcacatatctctgtcactgcaggattggtcactgattacttagtttgtttggtgaggttgtgtttttctggatgttcttgatgcttatggatgttcattaatggctgagcattgaagagttaggcatttattccaatctttgcagtctgggcttgtttgtacccatccttcttgagaggactttccaagaattcaaaggggaataaatgttgtgacctaagcctgtggtcactgcagctgtttcagcactagctgtttcattcctaagcccaagaatgctgcaactcttgaagactcccagataatcagccttgttggacttagggaagttaagagagcattctctgggttaccagttgaagtctcttgctctcttccttctgtttcccctaatcagaaggagtatctttccacactgggctgcctggaattgggggaggggtgatgcaggcactcccatggtaccatgttgggtcacacctgaagctcatgttcttcctgatgagtacagtactggggcttacccaaggcccatggccactacttcctggctgctgctgatgtttattcaaggttcaaggtcaccttactcagcaggtggccaatcctgctgggactgggtccatcccatcagggcagcagattctcatctagcctagatgggtctagaaatgccattgggaagcaaaggcctggaatcaggggcttcagaaatctgcctggtactttattttacagtggctgaactggtatccagcttgccagaccaagtcctctgtaatattccttctcccttcctcaagcagaagtctttccccaagctcactgcctggagttggtggagggttgatgtaagcactctaatggctactacagctggtattgcattggtactgcaactccactgccttcaaaaccagcagaacaccagggcttatctaaggactgcagttcttgtggcctgcctgccactcaaatttatttgggatctcaaaccactttatcagcctgtagtgaggccagccaggacttggatacctcttgctgtggcacaggatgctcatctggctcagggctggtctaaatgctccctctgtgggcaccagtagaattctgccctttgttgcattctattgtgatagggcagcactgagtttcagtacaaagattcacacttagtttgctctccctccctcaagcacacagaatctttctccatgctgcactgcctgggattgagtgaggagaggtaggcaacgcaagactgtcctttctatcttcttcagtgcctctttccatcttaaatgttatgaacattaaaaaataaatctgtgtgtggacaaatattttaatttttcttgggttaatacctaggagtagaattcttgggataaatgtttagtgtatgtttagctatatagtgtatgtccaggctgtttgttcgaaagtgttgtgcaattttatactcccaacatcaatacataagaattccagttgctccacattcttgctaacacttattatgttgttctctttaattttagccattatactgttgtattgtgctttctaattgtagttttaatttacattttcttgatcaggaatgatgttaagcatctttttatgtgtttattggccatttcaatattttttgaggaaagtgtctgtttaaatattttatgcaattgattttttatttttggttttattgaattcttagagtttttttacatatactggtcacaagtctttaatcatatgtatacatattatacatgtattgcaaatattattttctcatttgtgctgtgtcttttgaagagcaagggttattttgataaaatataatttatcacttttttctattttgagtagtgctttttgtgtttttctttaacaaagaaatatttgcctaatatttttgaagattgttcagattttttcctgtattttctatgtttaataattttagcttttgtttataggtacaatttattttcagtttatttctttctatggtgtgatgtaacttttgaggtttatctttttacatatgtatatacaattctagtagcatttgttgaaaaagctattctatttcattaaaatacattgggacctttgtttaaaatcagttgatttgttaatagtatgaagggctgtttttggactctcagatcttgtaggtttcatttcacaacatcagaatatagcaaatattgcaataaagtgagtcacataaattttttagttttccattgcatataaaagttatgtttacactatattgcagtctgttaagtgtgcaatagcattgtctaaaaaatgtacataacttaaataaaggaacactttatagctaaaaaatgctcatgatcatctgagccttcagtgagtcaatctttttgctggtaaagatcttgttttgttgccgatgactgctgactgatcagggtggtggttgctggaggtggaagtggctgtggctatttctttaagtaagacagaaatgaagtttactgcatcattgactgtttctttcatgaaagatttctctgtagcatatgatgctgttttatagcatttacttacagtgggacttctttcaaaatgagagtcaatcttctcaaactctgtcactgacttaccaactaactttatgtaatattctaaatcctttgttatcatttcagtaatgttcacagcatcttcaccagaagtagattccatctcaagaaaccactttgcttgcttatccataagaagcaactcctcattcattagttttattatgagattgcaacaattctgtcacatcttaaggctccacttctaattctagttcttttgctatttccatcacatctgcagttactttctccactgaagtctggaacccactcaaaatcatccataaatttgaatcactatctatgactctatagctttatgaaattcatttcttaaataataagatttgaaatttgaagttacttcttgctccacgtgctgcagactggatgtttgttagcaggcttgaaaacattaatctccttgtacgtcttcattggaactcttggataactggctgcatggtcaatgagcagtgatattttgaaaacaacatttttttctgagcagtaggttttgacagtgagtttaaaatatacagtaaaacatgctgtaaacagaggtgctgccatctaagctttgatattccatttatagagcacagaagcagttgatttagcatagttcttaagggccctaggatttttggaatggtaaataaacactggcttcaacttaaggtcaccagctgtgttagcccctaacaagagagtcagcctgtcctttgagactttgaaggtaggcattgacttctcctctccggttaatgaaagtcctagatagcatcttccaatgcaaggctgtttcatctgcattgaaaatctgttgtttagtgtagacacttacaccaattattttagctagatcttctggagaacttgcttcagcttctatatcaatgcttacatcttcaccttgtacttttatgtaatggagacggcttctttcctgaaacctcatgaaccaacctctgctaacttcagactttccttctgcagcttcctcacctctctcaggcttcatagaactaaagagaattaggacctttctctggattagactttggcttaaggaaatgttgtggctgatttgatctatccagacctttaaaactttttccatatcactttcttatcatttgtgttttcactggagtggcacttttcattttctttaagaaccttttctttgcattcacaacttcattaactgttagtgaattgcatttattaactgcttggtgaaaaagtcctagctttcagcccatctcagcttttaacatgctttcctcactaaacttaataattcttaatcattaataaacatgggaggtggaggttgcagtgagctgagattgtgctactgctctccagcctgggcaacaagagtgagactctgtctctaataataataataataattctaataattctagcttttgatttaaagtgacagacatgtgactcttcctttcactcgaacaattagaggtcattgtagggttattaattagcctaatttcaatatcattgtgtctcagggaacaggaaggcccgaggagaggaagagagatgggggaatggccaaacagtggagcagtcagaatacacacaatatttattgattgagttctccatcttatatgggcatggtttgtggcatccccgagcaattatgatagtaatatcaaagatcactgattacagaacacaatagcagatataataataatgaagatttaaaatattttgtgaggattaccaaaatgtgacacagagacacaaagtgagcacatgctgttggagaaatggcattgatagacttgctcagtgcagggttgccatgaaccttcaatttgtgaaaaatacagtatctgtgaagcacaataaagcgaagcataataaaacaaggtaggcctgtacacaattcaataattgttagtatattcagagctgggcaaccatcatcacagttaattttagaaaaatttccccaacctgacaagaaaatctaaatgtattagcatacacttctcatttcctcccaatctcccccacgcctaaccctgggcatacaactaaactactttctgtctcgatagattttactattctggacatttcctacatatagaatttgtataagttataggctttgtttggtgactgccttctttcacttagcacgatgtttttaaggttcattcatgttgtagcatctaaaatccttcattttaaaattgatgatcaactaatattcccttgtatagatacaggacagtttctttatcttttcctctgtcgaagtacatttgagttgtttccacttttagcctattatgaataatgctggaatattcatgtgcaagttttaaaataaatgtatgtttttgtttctcttgagtatatgctaggtcatatgatagctctacgtctaacattttgagaaaccgtcagattgtttttcaacgtggctctaccattttgctctcccatcatcagtggtagaaagcttcaattactccacattctcaccaatacttatatttctgttctttagattgtagccatctaggtggatataaggagttatcccattgtgattttgatttacatttccctagcggtttatgatgttgacaatctttttatgtagtttttggccatttgtatatcttccttggagaaatgtctattcaaatcttttgcccattttaaattggattatttgtctttttattataaagttgtaagaattcttcatatattttacagacaagtcccttattagatatatgatttccacatctttcccccccattttctgggttatctttccactttatgattgtgtttttgaagtaaaagtttttaattttcatgaagtccaacttatctttttcttttgttgtttgtgcttttggtgtcatatctaaaatgctcagcctaaccttcaatcataaggatttcctgctatgttttcttctgagttatacagtttagcttttacattttagtctattatccattttgagttgacttttgtgtatggtgtgaggaagggatacaacttcattcttttgcatgtggatatgcagttgtcctaaagggttaccttctatctatagattagtttggagagaattaacattttaaaaacattgaatcatccaatccatgagcatgatatagctctccatttattttaagctttctggaatttctctcaggaatgtttttgtagctctcagttctatgtatatttcattaaatgtattcctaagtagttaatattttttggtattgttttaaacattttgatttctcaaagaactaagaatagaactaccactctatacagcaatttcattactggatgtctatccaaaggaatataaatcattatattaaaaagatacctgctcttgtgtatttactgtagcacaattcacaagtgcaaagttatggagttgacctagtactgtcctcagatccttcctctctggctcagatgaatgggagcagtaatgtgagtcagccataacaaccttcttaggagaattacttctgcctttggatctgcttagagataattctcatttgataacaatttgccctgtttgtctaagcaaaaattaacaaaaattgtaatagaaagaataatcatattgcttcacattccttgcttattcttgtagtccttacgctgaaaatgcacatatctcagtgttagtctcaccactgccgcttctcttcctgcttatttacacagtgctgggtgctggatgatcctcacaccaccctattaggtaggtaatattttgatcttattttaaagataatctcccaagtgtgacactgctttaaacacattttgactccaagggagctctcattgggtctaagttttctcatcttcaaactgaggaagggacctgaataatgatttccaaggccccatgtacttctgacaacctcaagtgggtccttcacagaattgcaaggatgtctctaggtgcagcattggttcctggccctttgaaggggtgattctcagtgtcagtctgagggctgggaaagttcagtcatctctgcccagtggccttctcttgatctccccactgtaatctcttttatccccttccctttgcaagtcttttcctagcctggcaggtcaagcattacctgataaaagtctcaataaagacctgtactcagaaaggaggaaactgctctccacccaaatcctattatagctctgggatttccctgctgctctggaattcactctctctctcacacatacacacaaattaacatttaatcaggattttctatgtatttttctgctataaacatttctcatgttaatgatagttcctaatttggtcttaaggacaaattgaggtacttttgagataataactagaaaaagaatgtaaaacctgctcattattacaggggaaactcatcttgaattacatcagtttctataatctgataattctatggtttccgaggcgaatctcatgtatgggtgaggcaggagagtttgaatcatggttcatagctttcagaggtcatttttagcctttaatatgaggcctcagtagagaagtaatttcttgttgtgcttttgaaattctgatccattcaagttgaaggccacacttaaaaggtaagatttctggctggtcatggtggttcatgcctgtaatcccatactttggaaggccaaagtgggaggatcactggaggccaggagttcaagatgagcctgggcgatatagcaagatcctctctctacattttttttttaaagcaaagcaaaacaaaacaaaaacaggtgagatttctgttgagtgtacgtagcaaccacctgtagtagaaggtcctctaagccagtgctcagttctctgggctccagacctagctttgctgcaaacattctgcttgcttttagcaaattcactttgattgtctgggccacatttcctcatctctaaatagctgacttgaaaggcattgaatttattttattcatcagtaaatgttgaacctgctctgacttcattataggttgtgagaattaagtgataatatttgtggaagagatttactgtaactctttgtgatgtaagctttgttattttttcatggtagatatgcatgttgacaactgttaattcattttgactatgttctctaatttgtaaaataaaggcatggaattaaaaaactaaaacattctccgtaattatctctgtctcctcctcatgcacagatcatatcatgtccgtactgttcactgatgtatttattccaggcaccgtgtgcagggcatgctgtataatatgtgttaaataaatttaaaaaatggcttataaacataaaatggctaagctttcagataatacagagaatgagaacgattttctaattttaaatttgtgaagattttttaaataatgatttctcttttggatgagggtcaggtgaaatgggctctcagggtagatgatgagagtgtaagttggtacaagtttaattgaaagcaatttggtatcaagaatcttaaaaaatgccaaggaaacttattcttgttaaagagtttcacttgcagtatttattctgtttaaagtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccaggcaagtaaacctctcataactgtgacactacctacctggacatagcttaaggagagctgtggaggctatgagaacccagaatgctaaatgctcaactcctgcctgtgctaaactttcatagtgagtctttgatggatgaggccagcacctgcagacggttgtggagggtggagctggattctctctcctcaaccccctcggaaggcaccttgtgcagtgcacacactgcataaccttcagagggctgcagcccatcctgactttgtctccacagttaccttctcaccactctgcctactcctttacactcttcggctgttgtcttcctttcttgctttctcttattctgtttttaaaatctgtccccaccttccccaaacacacacacacacacacacacacacacacacacacacacacacacattcccaattcatttcctccttcttgtatatttggattggtcttttccatgttagtaaccctttaagactggccttggatgatttatttactttgattacaaaccttttggattattggggtggattattccctaaacaaaagcaatttctgtttattataaagaacatccacattataaatggcttcatcttatttataatctatagtagggaaagttaggatggataaagatcttagagagttttgcttacaaatggagaagtttgcacctcagaaataggcagccagttgcctctcttcacatccctgagtcattgcctattgtgatatttgttaataaatgggggcattcagttaaatttgaaatttaaataacaaaaatttgttaatatatgtatgtcccaagtgttacatacttgggtaagaaataatttatttctaatctgaaattgaaatttaactggatgtgttctattttaaatttgctaaatctgataatcctaagtatatagctccaactataattcctatgtaattttttctttcttcatggagtgtatacaaaaccacgaaataaagagtttggcagaaacatgaagaatgggcttcccaaggcagatggcattatgtggtatttttaagagacaaaatagcacctttgtccaggatggggcagggctggccatggcctgcctgaaagctgatttcacaatggacccaaaatgtatcaaaatagaccagaatggttccaaacaccaaatgatggagttcttatattacactctattttggggtcattctacttttataaaatttgattttcaaatgaggtttttaacatgctatttaaagaagaattaaatttttttgagatgaagttcccactttatttctagttttctattatttgagccattttctgtgagatatgtaacttaaaataatctgaaaaattataatttcacttttttctcttcaagtttttccttcatttttttctttttaaaaaaattttcatttattccctctctcctatcctgaatttttgcaatgcccagtgaaattagatactaattaaataatacaataccctttggcaaattgttgaaatttggtttaccagttaaattttttccatgaatatacttagatttggaaatctatggtgatagctttcttcagataaatcttatgaagatagatttattcttcagttttggtgtatttgatttttgggccagggctcttggatactccatttgactttagaattaaaagtaggcatttagcatgtgctttttcattgatgattgaactaatatctcttaaaccttctttattatagattcttcttatggttccagtttttttacagtaagtatcttaacaatagtttgaaaattagtcttcagagacagaatggttaagtttacaacactgtttttaagtttacattttcaaagattatttctaatgacttgtataacaattgtatagaagctggatttgagagagccaaggtctttgtagatacgggctaaaagacaagtttgaattttctgaagcaaggctctgggtctgtgaaaagcagaggtgaaacctgaggccagcaggtggtgggcgatccacagagttgctttgtaagatgggtacagagtttatctgatcccagggatggtctgagatttgtgcttggcacataagcggtgactccctcgaggcacgaagccctcagttaaggaactagttatcaacaggggggattttgacctccaaaggatatttgtcaatgtctggacatatttttggttgtcataactgtggaccagtggggagggtaatattaacctctagtgggttgaggccagagatgtcgctaagaatcttacaaagcacaagacagcttctacaacaaagaatcatctgacccagaacatcagtagtccggttgataagcctcaagttaaggtgcaaccctgacaatattaaaaattcttccttgctcatattgcagcaccagacactgactgactgtacaggactttgtagtaacattgcattaacagaagcatatgtgtctgtatctgtttaattctaagaaagatttagacagctcaaaaaaaatatgccataaaaccattaggagaaaagtaaaagaataggggccagctaatggattggaatgaagcaagaatgtcagtgcatccattaaataatgacactagcaaagagtattgaacaaacactcatcttaacttggagatttctgatgcaccaggtcaaaaggaaaatatgggacacacactcaaaatcttacaaataatgaaagaacttaaaaatagaataaaccatcactttaatgattaaattagcatttaaaaaagaaattataatacctgatgcttgtgatgttgtagcttactgatataatctcatatggttgtgacaatgtaaaaagatataataatttttggaaaagcaacttgattttcttgctctgtaattgttctgaaaattaatgttatgtataatacaagggaaataaaaagctgtatgcataaaatgttcattgataatgatggataattcaaatttcccaaagtaagataagttgaccttggtggccttcttagtacagtcacttaatagtgagtatggtatgtggaaaatgagtatgttattagatcaagtgtaaaaagcagaggacagtatcatatccatcgtatgtttgcgatgtaaaaacatttcggtgcaaagaattgaaggaaaaaagatttgttacaatgaaagagttctatgttgcttttttattatagaattctgataaagatgttataccgtttgattttcactgagagtgaaatggctatctgaataatctgagcagaggaatggtgggacttgagttatgtttttggaggatttctttggacattgtgtcaagcagagaccgacggtagccagagcggaagtgggagcccacgtagggaatcagctcatccttctatgcaacattaaatggaggtattttagaacagacgcacagttagtgagggaggtagtgagatgtgagggtggttttgatatattttggaggtaaaatcagtaggctctgttgatgaatgtgaggtaggttatgagagaaagagaagaatcaaagatgactctatgtggtttgacctcagtaattggaaaaatggagtggccatttactgaggtggggaaagactgaaacaggtttttctgaggggagaggaggagagggtataaagggaaatcagaaattgatttgggggatgtcagtgagatatccaagtggcattgccaaggaggttgtgggagtttccagtttggagctgagataaactctcttggctggatatatcaatttagaaagtgttggtgcataaatgagacttcaaggtcatcaagggagagtgtgtagacagagcagagaaagagggctgagcaccaagcacttgcatttgaaaaagagtatcaggcaaggaggaggaaggtgagaatgtggggtgttgtggaagcccaggaaggcaattttctaggagatggggatgatccattgtctcaagtgtggctgattgatcatgtaagaagaggatggagaagtgccactgggattagcagcatggagttcattagtgatgttgacaagaaaggctctgatggaatgatgagggtaaaagcctgactggagtgggtttaaaagagagtgggggcactccgggctcagtggctcatgcctgtaaccctagcactttgggaggctgaggcggtccaatcacctaaggtcaggagttcaagaccagcctggccaacatgatgaaaccacttctctactaaaaatacaagaatgatccaggcgcgtaatggcaggtgcctataatcccagctactcgagaggctgaggcacgagaattgcttgaacctgggaggcggaggttgcagtgacctgagattgtgccactgcactccagcctgggtgacagagcaagactcggtctcaaaaaaaaaaaaaaaaaaagagagagagagagagaatgggggcaggtaagtggagacagagagtgtatatgactcaagatggtaggctgtgaagcagtgaagtatggggtggaagctgctgggcattgcagaggcctttgctgtctgttcccaccctgctggctctctaatttctccccagctaagatggacagttccccgagagctcagacatctggtcacagggccccatgtcaaacacatgctgagagtattttgctttctgttcttccccgaagtcagttcagcttgagagggcaggggagctaacaaccccattgcaacccacagctggggtgaccaccagactcacattgcctgggactgagagtcccttgttccaggaaacatctcagtcctgggcaactggggaaggttggtccaacttcccccagcaatggttcaactctgggcagtacctttgttcctgagaggctttgaggattcaagccagcatggcctgtgcaggtccttgatggctgcattgacttttccctctttccctctttccccactgcaacatggatgttgcagtgaaccttctccagaccattttgaagtgagtgaaaaagaaaaacataactaagtatcaatatgttgtttttttaccttatttttaaatgggaaataaaaattactaattgttggatttaaaaaaacctcacaataatgttaccttgaaacaagaggagcttctgcacctccacgaacgtccctcatctgtctgtgtacatattttatatacaggcagtgatgttgttcagagcgtgtgctccctgatttaaaaaagtcagcgccatattttaatatttcatatgttgttatagtttataaatggccagttttaatcgctgcagcattctttccacctcctcagctccttcttcctgggaccatctcctgaataagccacctatatacaagtccttgttgcaggggaacctaaacggagacaggagatatggatttattttccttctttattattattattatttttttagagacaaaaaatgctctgtcgttgagcttcaaactcctgggctcaagccatcctctggcctcagcctccctaaatactgggattataggcgttaatcaccatgcgtgcgtgcctgcctgcctgcctgcctgcctgccttccttccttccttccttccttccttccttccttccttccttccttccttccttccttctttgcttccttctttacttccttccttccctccctccctccctcccttccatctttcctctctcctttcttccctccctctctccctgttcagcacagatggaaccatccatttttttccctaaattttttcaatcgatggtttattgaatccaaggatgcctaacacacagttacgaaaggctgactgtacttcactgtatacttctgaaaaacaaggtcattcttgaacataaccacagtacaattattagaatcagaaaattaacactaatacaatagaattatttaacctatagactttttccagatttgccaattgttctaataatgtccttaacagcaaaagaaaatcttggatcatgtattgcattcagttgtcctgtctttagtttcctttgttctggaacggtctttgtttttatttcatcatgatttttgaatagatcacttattttgtagactatctatctcaattttggggttgcctgatgtctgttcgtgattgcatttggggttttgtacttatggcaggaacagcttgtgttttttaagatggcagataataacatgctgataggaatgaaccgatagaggggaaaagagagaattgctggatgatgctcttgaggggtgggagagcaggagggctgagctcagcctgaggactgaagcactgaatttggctggggatagatttttttttcttttgccagtggaatatatgatagattgtgagaagagaagagagttgagtgggtattcaagggaaagatcatccaggaatggaccaggggcacgagggcaatggggacaagaaagaggtgttggcagaatggaatgtggggcctggtagggccaaagagtcattagagttggggaactgtagaaaaggagtggggttggtcatcgaagagtgaggtgcataaagttgtagctattgataatgaaaacaaaatgaagattttgaccagagaaatgggtgattcaagcaggtggaagaaaatatcattggatggaagggagataaagtaacagaggggatttgaggatcattagatatggaaattactgagaatggtggctgaagtcatgccgaaaagcatggtagtgtgctagaagccagaatcctccagaaatggaaagagctcattctgggagcttcccaggaccctgctgagttctgagaccctcttttcattccactgagagtggtgtgaggaagagggagtgtgtctcgtttggagtagttggacctctggagaatgcttctttttctgtttgtttgttttaactctatctcatctgaaagataaatgctgtgacttttatgagtggtctaaaatgcaggactcacttttattgaagaaatgggaactaggcagcaagaagagaaccagcaactgcggagcttggatcacagagtgtggggtagttgttactgggatgtcatggagcattggggtgtttttccacctagggagagcatgcgggctcagtgaggcactggagacccatgttccttctatttttgcacttagccattcttggcatataataagaaagcctcgggtatctagagaaatccaaaggctctatactatgggccagctgcatttgccttctgatcaagccatcagtgctcagtgaaatgttgggtttttttgttcatatttgaattactctcttttctttatcatttacatgtaaagaatagatcattacattcttatccaggatctatgtcacagactttgttgcttcaaaaactgtagaagttggtacagcttgttacaaaaatcggccttctttgtcttcttaccccatccatatttttccctccttgtccatatttttaagccattaaaaaaaaatcctccaactgcacagaatagttttaacattgtgttcagcagattggcaaatctgttcaatgtagtgatatattaagtgtgagtttctactaggagaatgtctacaattttgcacctttgtagcatctgtctgtctcatttactttattaataaaactccagagggaaacttttggtgtattttttttcccatcagatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaagtgagtgaaaaagaaaaacataactaagtatcaatatgttgtttttttaccttatttttaaaatgagaaataaaaattactaattgttggatttaaaaaaacctcacaataatgttaccttgaaacaagaggagcttctgcacctccacgaacgtccctcatctgtctgtgtacatattttatatacaggcagtgatgttgttcagagcgtgtgctccctgatttaaaaaagtcagcgccatattttaatattttgtatgttgttatagtttataaatggccagttttaatggctgcagcatatatcattctggtaaagtactatatactgtaatttacttaataaatttggcattggatttttggttgtttctgagtttttcactattagagataggcttgaatataataatttcaactaatttcttaagaaattatgccatagttgcccagtatagcattcagaactgataagctcagttgcttcagttgtgtaattcagttagctggacgttggtctcctatgctggatttgacccccatgttacctggggtgacctttgggagcatcccttcccgtggtgggcttcttatgccttaatcagcatggccctcttttataaccaattgaattattttgtgtaaactcattgtatgaataatgggttttattatttttcattagcaaaggtttatattcttctctgttttttaactgttacttattctatctgccattggtgagagccacattacccttaagctacaacaaaaagggccctgtcctggggcctgtgctttggggaggtccccgttctggctttccctggactgtgcctctgctcatggctcagactgcccatggggtgaaggggatgtgtccacggagcccacacaccctgattccctctcaccctggagttccctaatttaatgaccagatcatggtcaagcctcttttctggcccctccttctgagggcaagtcttaacactggactgtggctcctgcagcccaagggtattctagggatggctgcagccattggcaggagtgtggggtgggaggcacgggtgctgttgggctttgtaggctggaggacctacctatgtgcactgaggccccttgaggtacagaccaagctgagggtggggagcacataggggaggagtggactgaaggttggggccagggacaggtgctccccaaactcccacattctggtgcgtaactctgaggatcacaaaattctaaatttgaatgtagctttccaagttgttatgaagatctatttgtcaatgtaggaaaatggaacgtattttgatagttagttagcttgatttataacttaaatatttgaacatatttgaaatgcctccctttgtattcttgcccgaagctctgactgtgttagcagtgaacaacgaaaataattggctattctgagagatgcaaaatttaaaatgagaagatattgatgacagttgttgaaccatatcagcttcagtataaattgtatttccatatttggcttcagtggcatgatatcaagaaaatctgcattcatagaagtatttgcaagtggtaccaggtttcagtgatatatcttataatcctgggatacgcttcaatacacaaagttgtcataaaagatttttcttgatgaaaatctacaaggaaataatctgtttggaagcacagcttatgattgtgttggtctcatgttgctaaaatgcagatatattccaacttctgttgagtgcattttctaatctacaaatttaagcatatttatttataaaataaaatattaatattttaaaaataaaattaatatgtatatgtagattctccctccccaaagctccttgttctttgaaacagtttaacagccactgattaacccttgacctattcagatccataggttaagacagggtggaggattgaggtacatggtattgccccccaaatattagactgattatctgaacttgaagcagccaggctgactgttcatttgcttttctaacatagcagccctttgcaccctggctggcctcatcagctgccctgcggcaggaagaatcaaggctgagtataaaataacacctatggcagagccaatgcaaacttgagttctgtgtcaaaggcagagtggaagatggcctaagttctcaagtgtttcaagagaagaccttacctcttacatttagttactagttcagggagttagggtcacattaaagccacaaagaatgctgacatgtaaatggtccagccacatcttgcaacagcactaggggcccagtccatgggatgtaagtaaacctagaattgatgctacttgttttgctaactacccactcatattgctttttgttttgttttggttctagttccttaatatccctagaagatttagattggcttccactcaaccaaactttttcccaggtttctgaacttgtactgaatgtgaccatttcgacactgacatttctgcagcaacatggagtagcagtcaccggtatgggtgccttgtagctattgctatatttcaaaacgtttaactacttaaattcattgacagttgacatagagctaaaatgatgttcaaaatgatttaattaaaatttcaaattcaaaaaagtatcaattgtttctgttaatacaagacaaaaatagaataaaaattttgaactcgaaactgaatttgactttctaccactgttgacattctgcagtcattgctaatataaatgatatttttaagttaaaaataactgattttaaagttctttgactttatttcatctaatattagacctatcactagctctgtgattttaatctttcctctctctaagctcctattgggaggaaatattttaaaaatggcaaagctagtaagaggaggcaggttgatgtggacttacagagtccctaactaaataagcagccctaccacaggggagggaatggaattatatagctcttttcttgatccaggatattattatttcctgaattaccaattgagtctgagctttttacttttaattcccttcttttctctatttttctatctttggctatttctctaagggaaatacagtgagagaacaacaaagttggaattcatccacccatttatctgttcatctgtccatccatccacccacacatccattcatccatccatccatctgcctacccattcacccactaaacaactcatcaacctctttatacatctatccatctattcgtccattaatccatccatctatccatctattcatccattaatccatccatccgtccatccatccatccatccatccactcactcatccattcatctgtccatccacctccccattcatctactcaccaacccaccaacccattcatctgttcatttatttattcattctctcattgaataaacaacgagcacttcctatgagccaaacacttccccagagagtgggaataaaaagctgaataagacatagttctttaatgagaatgcatggacacagggaggggaacaacatacaccaggtccagtcgtcgggtcgggggagaggggagggagagcattaggacaaatagctaatgcatgcgggtcttaaaacctagatgatgggttgataggtgcagcaaatcaccatggaacatgtatacctatgtaataaacctgcacattctgcacttgtatcccggaacttaaagttaaaaaaaaaaaaaggcatagttcttactttcaaggaagtcatgtttagtaaaggagagagatatgtcaataataaaaaacaaacaaacaaacaaacaaaaaacaaagaccacagagtaaggatctgacatctgcttcaggaaaaacttcaaggaggagttttgaagggtgagttggagtttatcaaagagatgagggagcatttccaggaagagagaagactgtgagatacttgggcttgctgagagctgtgaatgtttgacattcagtgtgtctgaggtacagtgggcagtagcagggggtggcatagaaaggagcccaggccaaaacacgagtggccatgggagcagtagaattagatctgcattatagaaagacactcctgggccggtgtgaggagtagattggaggcaggtagttctggggttcaggatcctgggagcaagtcttccatcagccactttctcctgaggtctcagtctcctgaactattattattattattattattagagatggagtctcgctcttttgcccaggcggcagtgcagcagtgagatcttggctcattgcaacctctgcctcctgggttcaagcaattctcctgcctcagccaaccaaatagctgggactacaggcgtgcatcaccacgcctggctaatttttgtatttttagtagagacatggtttcaccatgttggccaggctggtctcaaactcctgacctcaggtgatctgccctcctcggcctcccaaagtgctgggattacaggcgtgagccactgcgcccaaccctgaactattgtacaatgagattgttatacacagagatttctacaatcccattcagaattttgctgcttcatggagcaaactaacatgaaaccctctatggccccaaattccacctttccacctgttgcttctttcttcttgttgcttgtgactcagcacagtgagacccacatggaatttttttttttttttttttttttttagctttctgtaagagaaagctagctcattaacgtttaactccattttcaggttaggttagttccactgggaagtatttcttatgctgagaacaaaacccagaggtggggtgcgagatgaataaaacacctcatcgaaatcttcccagtgaccttaatttaacagactcatttagaagctcaagtttttgtacatcatccaaattacaacaacaaatttgccttacaattgaaaatgtaattaccgttaagaatgtaattaaaataaacaattttctattaactctccagcgagtcaaagctaaggaacactattacaaaacatactttgagaggtaactaaaaattgtcttcatgtctcttgtctccaagaaaaattcttttgcttgatgagccaattccaatgtgaagaggaagggatgagtggcctcatgtggctttaggctactggtccaattatgttatgcactaaaactgttaatctacacattctgaattctctgttgtttagcaacaaatttctgaatccaagttgtctttcactttttgagaaagattttatacttttataagtatgctacactgatgtcactattttttctctcctttctggaactctgtgagtaattctaataccttctgagaccagtagagattaatagttacagctcagctttggaagccagatcatttgggtttgaatcagaggcttaatctaacaagtgggactctaagaaaaaggggataattacagcacctacctcatagtgttgttggaggactaagtgagacctcccatggtgtattcttagtctaggtcctagtacctcttcaacatacaataaatgctggttttaatctcagacaccaatcttttttcctcccatgatgccatgtaaaggcaatcagactggaaacaaaaaatcttgtatttctgggattttccccatctttaacaccttcctgaagtccccgttgacttggtctgtctttgtgaatgtcatggattgtgcttttttttgtagacctcactgcaattataaggatcctatgagataatgcttgtgaaaatggcttattagtggctggcaggtgaaggggctcagtcaatgggtgttgaatcatcatgatctgaaacaatctaatttctaaatgaaggttcaagattcaaacacaccaagaaatttatgtgtttttatgtttgcagttgctgaggcatactccccagagattttgtcataccttgggggtcttcgatttatattttgaatgtgtcactactagatagtgccatgggttttttgggtagctcatgaattttatatgttgataacttgagttaggggaactttttcttatgacttcaaataattattgagaatacagttttaaagactccatagtattttatgctatggatatactataatttatcctttccctggatactagacacttaactggttttcaatattttatcagtatagaaccaataaaatattgtcgtaccttaatttttgctcagatatctgattaagcttcttgagaaagacttttagaagtgaaattattgggttcaatgacttgaattttataaagctcttgaaatatgttttaaaattatcttctggaaatgttgcaaccatttgtgccagggagcatgggacacttcaccattctctctatagcagcaagtgtttattctgtttgctttttctatctgatgccccagtggtgtttggtcttcatttgctcttcctttagaggtgaaaaaaggtattttttttctggattacattaaacatatcaaaatattcaaacaactgctggtgtaaatcttttgttattccaacagagccagtttaccacctgtccatgcagaatatagtgtgggatccacagaaagtccagtatgatctcaaatcccagtttggctttgatgatcttcacacggaacagatcctgaactcttcagctgaactgaaggaggtacacatgcttgactgcttctcacaccgctgggcctttcctggagactggatctagagcatgctgctggggcagggtgagcgggtgccacgggagaggcagccagacaggagagttcggtcaaaacccgagctccttacgcagaagagacccctactgtctccagcttttctagaagtgtctctttcttcttaccatgtagttttatcccagaatggaaaggcagcttagaaataatatgacacttgattgctctgggaactagcagtgggagaggccaggtcaagtgagggtgtgagattctgaagacagcgctagtggggtccaggtaggaagatggtgcaccagctgtagtgagtggggatacaagtgggtgaatttccaggtaaagagatagttttcattagaagagtaggagctgtacgttatggatgcctgctgggttcaccaaagttgagcctcttccctaactaggtgaaataagggagttggactggatgatcgatccccaagacccagttcactgttggtattgctgaggttctgggagatatcttttagttacagagtcccttttgtcactccagcccatttgtaggcacttctgctttgcatggtgcaggtccaagaactatgcgggacctggagctttggtccatagactccacctccagggttagagcatttctggtgcagctcctaggtcagtgttgagttaggaatgtttggagaggacccactctcttccattaggatctcagtccatgctggttatgtagattttgctcacttttttgtgagttccccacaacctggtcttcccagatagcacttttcacatttcagtgcagctagtttgtgttcagactgttgctttcagtatttagactctggatctgtgctctcagtctcaggggttagatggttgggttgcagccagcagaccctcatgctggcttggtgtttgaaaacccagttctaccaggtaggtttaggcttcaccaaagtatactaaattttgtgcttcttgtatccctggcacaattttattaatcatctcacaattttatgaactatctacctaccacaggacttgaaattgtgacccttgggttttctcatggatgctgatgtagatggaatatgaaaccccagttggctgacttttattctagttttctccatctttataaccccgttttctcattatattatagtttgagtgaactatgtaaaacttttaccttagaatgttcaatatattgagattagaattaaaaggaaagtgatcagaaaataccactgtgtatatcaacagagctccatggaaattgtacatcatgtgtgtgagctttctattgctgctgtagcaagttacccccaacatagtgccttaaggcaactgacattttcttttatcatagtgttctggaggtcagatgcctgaaatggtctcactgggctagaatcaaggtgtctgcagggctgcaatccttcttgaggtcaaggggacatactgttgtgggggaggaaaaattctttttttctctattattccatcttcaatggctggggctcatgaattaacctgataaaagacagataaagaagaggaaaaccagttattgtgtaggtatgtatgggagttcacaaagagaaatgtgtagatcttccctgatgaccattctgtttttcactttcagtatagtattcaataaattacatgagataataaatactttattataaaataagctttgtgttagattatttttccaattgtaggctaatgtatgtgttctgagcacagttcaggtaggctaggttaagtttggttatgttttgaggttgggtgtactaaatgtattcttggcttatgatattttcaagtcatgatgggttgatgaggatgtaacctcattgtagatcaaggatcacctgtattttaaggaagcagccagattattaaggcttatatgccatccaaggctatctatacaaaggaaagggggcttggggtttctgagtagcaaggcaagttatgggaaggtgaggggaggaaatatatggtgaatgagttatcctgttttgcagagaaatctcccaggtgatcagagttatttggagaagcagctctctttttggtaggagacatctttacagatgaaaattatcttaataatgtaaattttctttataaatctaaatttcctttaccaaaaggaaatttatactctatttttaaacagttagggaacggtaagaagtttttcctgcctctgctggttttcagtttgtctttagctcaaaataatccatatgccaaagaaacatactttggggtggcgtattctgttttcttgctttttccagcttccagtggccatccacattccttgggtctgagcctctttctcaatcatcaaagccagcaatggcaggtctagttcttctcatatcccatcacttgggcactgacatttttgcctcctttctccaataaaaacccttgtggttacactgggctcaccaggttacccaggataatcgcccatctcaaagccaggtgataagtagccttaatttcatctgcagccttaaatctcacttgccatacaacataacatattcatgggctcttgggattgggacatggacatcttgggggaacattgcctgcttcccacccttcgtaagtgtaattgcctggtgagctcttcctgcccactgcacagacaaaaccaattcattgagactgcagtattgcagtagagaaagggtttaattaatgcagagctagccaagggaaaaaactggagttattactcaaatcagcctccttgagaactcagagggtagggttttttttttttttttttttttggataatttggtgggcaggggactaggaaatgagtttcgccgattggttggggatgaaatcacaaggatgtggaaaaatgcaaaagtctgaaaaacgtctcaagagaccaatcttgggtttgacaatagtgatgttatctataggagcaattgaggaagtcacatatcttgtgatctttggccccatgactcctgagcagcaagggattatagaaggcaagctagggaccagtggctgattatcatttagctacacctacattttagcagcattcaagccactctcataatcttaatcttgtggccttttattagtcttacaagggcaggttctgtacctgagaaatgaggggattcatcttagggagggactactatcaaccttgctaaaaagttaaactacaaactaaattcctcccatggttagcttggtatatgcccaggagtgagcaaggacagccagcctctgaggctagaagcaaggtggagtcagccatgctagacttctctcactctcataatctgcaaaggtggtttcacagggccctttccatctgcatcagcctgtgagcctaggccctccctggggtctgtctgactcctgaccctgtcactctctgggcctgctgggggcctcagcacatgctgcccctgcaagagaatagtcctcctctttccctgcctctgcctcctgaattggaaaatgatttatctaacctcacatcctctgtggatctcctgtgacctcacttcagcctctgcctctacttcttcaaccttctataatagggcatgtcccagggagcctgatggctgcatatctgcctctcataggctgtgagcatctgagtggggacttggccttatctatctaacatgatacatggtattgttgattatttttaattaagggaaaaaaatagaacaaaacatcagggaccctgtgctttgacagtcacaggttaatattttaaatcctgatccaaaaggaacctaaaagtgaacacatgggactaaaattaagctttctgactattgtcattgtttagtcaattcaggctgttataacaaaagaccacagacttgtaaacaacagaaatttatcttggtgtgtcctcacgtggtagaaggggtaagggaactccctgggtctcttttatcagggtgctaatcccattcacaagtgttcaccctcatgatctgaccagctccccagggccccatctccttataccatcaccttgggggctaggatttcaaaatacgaattttggcggggaggccacaagcatttagaccatggcagtcaccaacagaatctcttaaagatggcattataattgttgtaaaatgatgtaataggggaatgtgcttcattatatcataaacataagtatttacaaagcagtgttacaggaactctgttgaagttctttttttttttttttctttaagacagagtctcactctgttgcccaggctggagtgcagtggcacgatctccgctcactgcaagctccgcctcctgggttcacgccattctcctgcctcagcctcctgagtagctgggactacaggcgcccaccaccacgcctggctaatcttttgtatttttagtagagacggggtttcaccatgttagccaggatggtctctatctcctgacctcgtgatccacccgcctcggcctcccaaagtgctgggattacaggcgtgagccaccgtgcccagccactgtgttgaagttcatgtataaaataaaggagatttggttcaaaaacattaaacagtttctgacccaggacttcaatttgaatctttccaattttatccacttttgatagtcagaaaagaaaatgttcttggcaaaacaactttgttagtccgaagtatgaattaaactgggctgacccatgttcacttttggcctaagaatgaaaagaaacaagatttgatgtcatctccatgtccttggcctggagaaacagctgttcctattgtttgtggatgaaactgaaaaatataactttttttttttaactaccaagtcttccctcaaggtaaatcacatagatatcatcacttacttcttcaatcaagcaaatgtaagaacttttactgtggcaagatcgtggtgttatttttagaagaggaaggttctaggaaaggagctttatgtctaaatattttttcatattgttgtcagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgctgtcccctctctctatgttctgttcaaaggtgtgccagtttgagtgtccaaatccattctcctcccctgccctgccatgtttactgttggattttatgtccctccaaggaaagggccttaggagccccacatcctggccattgagtgcaccttgtcccatgtgcatcaactggctccagctccataggcctaggccctcaacactcatcaccaaacagtctatcctaggcttgcacacacaccttggcaactcagaagttcctagacccatgctctgttattggtgcatgagattgccctggagtactatgaccagctctttggacatttgcatgctagcattgggcatccctctagcactttaagctctgaactggccttgtctcttcactctggttttgaccagaagctctgtgcacaaacagtgactgtgatttcagtgaccataatttaacaacacgaagggaggctctagtctgtctttatagggatgttggtgtggggcagagggcctgagtgattagattgctcctggcctcagaagctcatggagccctggctgtttcacagctttgcgcttcttggggaggttttggagactgtgaggcagagctcccctggcagtcacttcccatttgttttatcaggctttgccgtctctgtctcatgtttttccttaaagaacacacctctttaactttgttctccgctaatatgtgtcatgtataaaggccaaaatctcaaatggtagataaaacatccttaaaaatatataggtgttgtcgtctgcttcgtggcactaaagtcatccggcactaaaataatcaagggacagtgctgaaatgaccagcatccaatggtctagtggacacacttgctttgtgcattatctgggtaacataactcatggttaattaaggcatagttagcacacatacatgtacatcgtgcacctctccatgccatcaggcttgggcaagaatgatctatttttgtgtaatgttgatgacaaaccacagtgctaattgacttcagtatcatcctcaccatgtccgtgtcgtaaaatgacacttagtaaccatgtattaactttggtatatatttaaaaatatgcaaatatatttatgctatcctaaatatgttcgtttaggttttaaattgtatttcatttgtttagaggtgtatgttattcccttctctctttttctcttttgggggaaaaaagagaaataaggcagagattataaagttgtgtgcatccattgttgcaacatgaaatctttaatttctgagtagaaattaaatcatactgcaattgctaacagacattttaatttaccaaaaaataaagattggctgtctgtcatctagagtggtatgttaatatttcttaactaaatactgttctttccaatttgctattattaatgctagtattttggtttccgaatttgtaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatgtaagtcgcatttccctgtttgattattgattaggtagatgacacagaatgttaaagagtgcgtgatgatactgttagaaacacattctgtaaaactacagctaaataatgaatttcttgttagcaaatgggaaatcagaggctttcattgtggaccatcaccagggtagaagtcttggcagcactctggatgcctattcagaggctgcaatcgaccgaatacgggagcaatgtttgagaaggtgtcagtttcctagattttagattttatgtctttggcatttgtttaaaaatgaataaattcatttcggaggcatttttatgtacagaactaccttacatgagtagctcttttcctagaatcttcctcttcaaaaaatatgtttttatatttacttaaagattttgtatagttgaagtgtttacataaggtccagaaatattgtagaagtaggaaatggtggaacttgtttcttcctttttaagataaccacaattgattcaccaaaatagccgactagatctttttccttagtaggtgtggcagtttgtagtaacttgaatcttattatccttctgaagttaaggctgtctttggaaaagaagaatatgatttctcaatattatctcaaaaatgtgcatttcaaaccaggtcacacaaattcttgctctctgtgtaccatgaaggagagttgtgatgacagaattggataggaccatattgtgttcttatgattacttaagaaatagcaattctaaacacttccagttctttcacattttctggaacttttagcaaacaggatcttgcttttgaaggtcctatttcctaacttttacttaagagatgttctggggcctgaggtgcttgcgctaaaggcagaaatacagttccctatccgggccataaaagctacaggaggatggatgcagggagccagcaaggatgccttgaagtagtgttctaggcaaagggcagggacaaaacatctgtcataaatgaacaaatgcagggacattgcactggggatattgaaaacctccctgctggtctgtcacttaatgcacattaatagaaacaccacattaagtcaccgtaattatcctacaaatctcgaatgccccctggcactttagcctaggattttgcctgctctgtgccaggccaggggattgaagccccaggaagctgtacttggctcttagtcctacagagatggggggaagctgaagactataccacactctaggtacaaagctaggatagcccacattcttctgcccccatataaaatttccacacattctcagtgccaggaagatgaggcccaaacactggctttgctgtccatctgctgtttttttttctttgttttgttttgttttgctttgagacagtcttgctctgttgcccaggctgaagtgcaatggcgcgatcttggctccccgcaacctccacctctcagactcaagcgattctcctgcttcagcctcctgagtagctgggattacaggctcacaccactactgcccagctaatttttgcatttttagtagagacagggtttcaccgtattggccaggctggtcttgaactcctggcatcaagtgatctgccctcctcggcctcccaaagtgccggaattccaggcgtgagccaccgcagctggccaccttcagccttatttaaatctttctgagattcacatgcacccttagcagaaaattgtatatcttttatcattagctttggtccaagaaaccccatccctttttcactaccttgtcttcatagccaattgttcatatctttttctcttcctaagctgcaaagttcacccaaaataaatggaaatcacaccagactctcagttttctactgagtttttcgtgtcattacagactgccttttctcctccaggttctttctggttcctgcccacgtccctgcagtacgggtggctgaggtgtgggagctcttcacccaggctctagcagatagcgtggattttggcaaggcgaggactcacagaggtgcctctgcgccttccagcaaggactcacccttcaatgtcgcacgttgttgtgaatgtgaagtgtctgttcacagatgtggggggaatagtccctagggtctggccatgtggtatccttgcttgtcagagtttaaagagacttgacagtaagatccaggttccaagccacacagcatttcttttttccttggggaaaataaaataatctctttctcactttctagctctttccaagtgccactctgcttccttctcagtgtaatccaaagagtcagaacaatgactgacctaagcccagttcattctgcagatggccaattccaaaagccatgtgtccagcttcactctagcatgaggtgtcaggagtctggtcagcagccagaaagcccaagcatgtggctctgatggagcaattgctccgccttgtagggtgatgacgtggggatgggtaccagttcctgctggtgtcttgtaggagaattatcattgggaccttgctcactctctctataccctttacggtgcttgggtccatcagctctccagctagagaatagcagcaactatttatcaagcctgtgttcaaccccaaactatcaagatgccatgaagagactgaccactatggcacagaagtcgaaatggacgccaggcactcaaagcagtgggatggctccagccagtggaacattttgcttgggcttcaagtagctacatctctttctgcttttctccttctgtagcttgcttcgtttatcacaggtgaggattccatgcagttgctcaaagacacagaaagcctggactcacctgctctgggcagttctgctgcccacagtgtggctatgccttgcttctccctctcccgtatttattcccaatttcaggttcttcacattatcaaactcattttctttccagcttctcttctcagttgtttcttccatgtctggagcccgttagtctgacattctagggactatttgtattgagctgcctgggtggtcgttcttcctttgaccttggagaatcctacaggcattgccaattggctcaagttgggaccactgcgatgggtcctgtataccatcacacaccatctctatattttgaaacttttctcaaaatatttttctatatctcattaactataggcttcaaggcaaatgtttttagaccccatgtgaaactttatcctaaccctcacttcttttacacacacctaggaatatactttcccattttggggtaaagagaatgtttaatccatattcagtattgaaagaatctcccaatcaggtgactcaatgcaatttgtcaagaacctggttgtgtgatgaagtgtgactttcagtctagtgaacacacttctcaaagcagtggaatattttcctttgaacggaatttttatttccctaattggcacttcgaactacttttcattttatttcatttatttatttttgccctcagattacagcatctgtggaaattgcaaagcttgctgcaaaacctgccccagtggccggcactgaagagatttcttcagcttgatggagctctcagaaatgcgatagctcagaatttacattttgtccaaggtaagctagctttggtgttatttgtccctgactcactaagagtaaatgtgaaatttattggaaaatggacttgaaactgcctgacacattgtaaagttgggagataactttgctggtgtcatatgcatatttatgctttactctgatgccttctaggggatttaaaatacagcacaccaaggctaaataaacaataagggcacagtgaagagcgcatccttctgttttccttaagcccatgctgtggcctatgacaagcagtgtcctaaggctgggttgactttcacattcacggcagcatctgtggttttcaggctggaaagggaccagagtgcgttgtgaataagcgtatcttttgtattctgttccttctactgcctcctcccaccaatgcttcttggtgtccggtagggagagtgtgttccccctgggtttgcagaatgcccttctttgaactttcttgactatggtgagcattattctttcttccctcttctgaggaagttgggtttggacttttgcccagatgggctgcagccttttcattttctcagggaggagagggaaaaagtgaggggggatgttactttagaagtaaaaactcattctcactagtctttggaaaggacaaaatgatattacaatgactcctgttttcctttctaaggaagagaagaaaatgtataataataggtcaagtttttaaaaaatccatgttttcaggatccagtttattgattcatggccatgtataaaagtcaagcttacttaccttaggtgaataataatcaatttgtctactttgcagaagtcctcatttgcctggagacatcagctaatgattttaaatggtttgaacttaaccaattgaaactggaaaaggatgtgttcttttgggagctgaaacaggtaaagcacaacaaataattataaataagcatttttaataaaacattcaagaagctcatgcaatattcagttttgctccttttgtgaattgtgctagctaaaaaagggaacaatatgcaggtttttcaaaactttatgttgtgtttaaaatgtttatcattgcttattatatttgcagttcttgagcccatgaagagggtatctaagcctctttaaatgttactccttcccactcttattaatcttttagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgtaagtattctaccatcttagctcttctaagggcacaaatttaagattaaattcaccaaagatgctaatatttaacctggagtttcgatgaggaaagttttgccgtaagcccacacacttaaaggaagctggctctctgaactccagctgcccttcaatgctggcctttctgtctgactgaaaggttgtatgccacccgcctggccaaaacctacttgaaattcctcaaactttcaaaacataccacttcttcttttctggcttcctggatccttgatctgcttcattcttggctgcacatgctaagaaaagcagaggagtctctggtgattagtcaatcccagcaaaactgtggctttgagtggttacaagctttaaaagtcatattcctctcatgtaactgcccaggacaatgggctacccctgttcagcgctcaagtgggactgcagaatgttgaacgatttgtttggaaagattattttgtcaagttccagccctattcttcttactgagaattaaaattacaatatttatatttttagagttcatttttctctctcagtattaccttttttttttatatccttatataccatggaaataaaaccagtgaaataatgaaactagtgaaatataaatggtgtctcagcaaaatgaaaattgggatagtaattgaatagtgtgcataattcaatcaccgatttcttagcatctactctgtgcatgacagtatgctgaagggagtacaaacatgaagaagacactatcttggtagagaagggcaaacaacagtgagagccttggagctcagcatctaggagtcttcccaaataagtcaatgagccttagatgaggtgtaagatttggaagcaaagagaagtcaggagaggatgctaagcaggcagaaaattatatgtgaagggctgggcatagtagctcatgcctgtagtcccagcactttgggaggtctaggtgggcagatcgtttgagcccaggagtttaagaccaacctgggcaacatagctaaaccccatctctacaaaaatgaaaacaaaaattagccagatgtggtggcacatgcctgtaataccagctactcaggaggctgaggtgggagaattgcttgagcccagcaggtcaaggctgcagtgagccatgatcacaccattgcactccagcctgggtgacaatgtgagaccctattaaaaaaataaagaaaagaaaataaataagaaaagtgtatgtgaatgcatgcaggcacaaaaaacattacctgtttgcaaatacctttcttgctactagatgtcagctctttcctggcagaaatcctatctcaaatttatttttatctgtaaagtctaacttgtagtctcatacgaagcagggaactatgtatttataggttacatatacttgaggtagccttttggatgatgcctacgatacgtatcactaacaaatcaccccaaagctcagtgacctaaaacaaaacacattattttctcgctcttctgactctgggttgaccagtctccgtggggtggttcttctgatggtcttactgggcatcattcatgtagttgcagtcagatggccgtgagggctggagtctggttagctaggatactgagacgagggcctctcatcctcctctcagactcaagatgtctcttctccaggtaacctctccatatggcctttcagcagggtagccagacttctgacatggctatccagggatcccacacacaagcaaaaacaggcaaggagggagagtaggagctgccagtcctcagagaaggtagaactagaactggcacaattcacttcagctgcattctatgggtttacgtgagccagatctcagcctagaggaattgtggaaggtggtactgagagtgagactctcagggggtctggttcacaggctacttgttgcaactagctaacacagatagctatgacactgagtcccatcctactttattattggattaagttttatttttggacttattaacctgaacatgagtaaagattcaagtctagaactataacttagataattaccatgccatagggcacgatctttgatgtacagtttgagtggaccccttgtttagtgatacagggtcaaggctgcgtctcaaatacccacatctgaattgctttatttattataagcaatatcttcttttcttgttaaggatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgtaagtacatgtttggtgggaaacttataaacaattgggacatcagaatgatttcaactgccccttctacacaaatgatagatcaatatggtagattatattttgaatagaaagaggttcaatttattttaaaaatattaacctactggtactgttggaaagcatctaataactgtaaaatatgaaagagttcccttaatgtttaaccactgacttaatctttcattagaaattgaggatccctggtaagtccaaggtatgcatgtgatggaagttcttgttaattactcagaaattgtgcactaagtacaaatgggaagcttctcttgggagctgtaactctacagaaaattcgccttgattttattttatgactctgtgaattatatgtgtgatcaatttccattttccttgactgctaggatgttcttcgtcaaatatgtcaaatagggaatatatattttcttaatatttaagttcacttcctgttatggcctttaattttcctctttttttgtccttcttgatttattgtcttatattttatgtattctcataaattgcttttccttatttttcaaatcgaggtagaggagtttgtaaacaaacttaaaaaattagtagaactatttgaaagattctatttccttacataagtggactgccatgcatttgcatatatttgtttttagaaaaatttataatgatctgtcatctgcaagatcatttttaaattttaattttctctggattctttttgattgcaggatatttcatacacttgaaaaaacacaatttttcctggaacaagcatattattggaaagccttcaaaaagtttatcaggaagacttgcgaagtggcccaatatgtaaatatgcaagagagtttccagaacagactattgggtaagtcagtagcctaaactacaggaatgggggatgctttccccttttagtgaggtgacataatttcctgagagtccatcctatttaacaaagcggggcttaaaatgggtggctctccaagcacaatttggcattgtgattacttcatataattttttctcatcaattatgacaagacttaccagaagtcctggtttgactgagctacattgttcctgcaaaatttataatagtgactgcttttactctcaagactgtcctggtttgggtgataaatacttctatatgcagactagtcatgatcctactcacaagagtccagattttctgttgtggcccttctcactttacttagcattaagattgatgctcacactggggacaactccccatgaacctatagaagaaaacacaaactgtttttctctatacacacactcaacacttccaacactgctgtgaccatatgtgtggatttgttccacaacaagcaattctccacttctccattgacactaactgggtgtcctacaattcgattcaattctcgcactgtctgcctggaattagcatcagatcctgcaggttaagggctcagtcccacaagattgcccctacttcagacgccaaccccaagtccaggcttcccttctcacttctgatcaattgggtataaatcaggattcccatgaacccctcgttgtgttcagtaatttgctggtacaagtcacagaatgcagaaaaacagcttacttcctaggttactggtttattaagcagatataatttaggaacagtagatggaagaaatgcatagggtgaggtatgtgggggcatggagcttctatgccctctccaggcctatcaccctcccagcacctccatgtcctcatcaacctatgagcactctgaacactgtccttttgggtttttatggaagtttccttatgtaggcatgatatattaaatcactggacattagtgattgactcaacttccatccctctctcccctacctagaggttagaaggcaggtaagggaatgggaggagggagaacctgaaagttccaaccttctaattacagggttggttcccctgacaatcagcccccattctggggctatccagcgcctctagtcaccagtcattcattagcctacaaaaagacaccacttcctacattccaagggtcttagcagctatgtgcctgtcaggaaacaatggcctagaccaaatatatatgtatgtttttattatgttaatggctcacctctttccttatcagcttcataaaaccaaaaattccctaaaatataaatattacaaactcataactgtatgattcacagggagtcctcctgttccccagagatctactttttggaaagatgccagcatgtaaaacttgcacttctgacctctgcttttttactctagagctggttgtctatttccatctctccttgggaattatcttctgccctggttttccagcatgccatgacactgctccatcacagtggggttatcagcttctccttagaaagcctgcatcttggacgtcagggacttggacaggaaatgggagtttctcattccttttctgtggctattacgaccttgccttttcttatttcatgctgttttttaaactgctacttttagaggctgccagagatactccctctgtagctctcagtatcaaatccacatatggtaagatgggcctttgcattttctacagattacactataaaactcttctgtatagcagcagtattgggttgatggtaacttctccaatgagttggccatgttcttctgggttgagtactcatcctacactttaactttctcctatactacctgtcctcattatcacttattattgcccacttttgactcttttcagaaacaggctacagagagtgatatgcaatagtggcaacaggcttgtggttcagaagtctcaatgatactgataattgcaaatatttattgtgctttctatgattatcttgtttaatcctcattcaacctgtgagataggtaccattatgatttcattttcagatgagaaaattgaggctcagaaagattttattcctagcataggtctcaaaagtattaagcatcaaagtcaagaatgcaaatccaggaagtctcactctggatcctgtaagcttaaccactctactttctttggacagacccttgctgggggctgatctctgtgaaaaggcttgcactgtcacagaaatataactagtcttattaagaaacggaatttaaaaaaaatatttttactaaatatgtatattattttattaatttattttttatctttattattttctttcttctagtaaatttagtgtgattgttgttctttttcttgttcttgactttcagattttcttattttctaataggtacttttaagacaataaattttcctctatgccgagctctaggtatatttcacacattttaatatgtcattcaactgccttctggcatgtaagagaagtcagttggtaatcttataaaagctccattgtatgttatgagtcatttttcttttgctgcttttaagattctcactttgtctttgactttcaatagtttcattatgaggtggcttcgtatgggtctctttgggtttatgctacttgaagttttttaacttcttgcatttgtatatccatttagttttcaaatgtggggtgttttcagccgttaattctttaaatacactctctgcccctttctctttttctcgtcttctgcatgtgtacattggttggcttgatggtgtctcataagttccttgggctgtgttcatttttttttctttgctcctctgatttgattgtttcacatggcccatctttaagtttgtgggttctttcttttgcctgaatttctaaattcagttattctattttttagctccagaatttctgtcgggttctttgtaaatacagccatgcatcacttaataatgtggatgcgttctgagaaatgcattgttaggcaatttttccattgttcaaacatcatagagtatatttacacaaacctagatggtatagcttactacatacctggagtatacggttagcctattgttcctaggccacaaacatatacaggttattctactgaatactgtaggcaattgtaacatgatagtaagtatttgtgtatttaagcctatataacagaaaggtaaggtaaaaatatacgattataatcttacgggaccaagcatcattatgtggtatatgactgtaatctctctctctttgctaatattccactttgtttataaaccattttctagatttagttttgtgtttttcactgtgttttctttgagttcattggccatatttaaggtagttgttttaatttatttatcaagtaagtcagaggcctgcatttctttagcggacaatctctggagatttatctggttcctttgaatcattcatgttactctgttttattttggtatgtcttgatacgttctcttgagatttggacacttgaaaaaaatttccacttcccccagcttttgtagcatggctttgtgcaggggaagaccttcattgcccaaaatgttttaaaggctcagggtcttttaaatcttttctgaagatgtgtattccctaagcctaagtgtgtgtttttattccacttccctgcatacatactatctgctttaaaatgtattattcagtctcctggttcatctcaaaagccttggatgtttattgtattcctatgtccataattgattactcctagccgcctgcaggtctgcagactccctgcagctctaacatgccacagtgactgactgctgctttcagtggcctccaacctggcatccaaactatgccacttttctcatctgtgctctacatcaggcaagacagaaaccagtcacttcggcagcccctaggcaagccaaatattgccagcaagttctattttttcccttgtatactgagggaggaacttgaaattgatacacatcttcctgacagtggcatattgtgccatgaaggggatgaagagtgaatgagaaaaatgtcacaaaatttcacaatgagtgtgacattttcttgcattattagggatttacctggttgttgcatcttcttaactgatttctagtgcaatggtgcaatctcacctcactgcaacctttgcttccaggctcaagtgattctcctgactttgcctcccaagtagctgggactacaggtgaatgccacagcacctggctaatttgtatttcttgcacaagtggggtttcgccatgttgcccaggctggtcccaaactcctcagctcaagtgatccacctgcctcagcttcccagagtgctgggattacaggcatgagctacaacacctggaatgtttcttcatatttatccatcttgaggacttaagatgtgtggacttatatatttattgtctttgaacaattccatattactatttctttaaatatttcttttacctcaatttctttttttttcttattaggactgtacttacgtgtgtgtgtgtctgtgtgtgtgttcgtgtgtgtgtcccaaatgtttcttcttttttctatattgttcctcctgttttctttagtctctatgcctcagtctgggtggtttttctctgatttattttctagttaagaaattctttctgcagaatgtgtttaattaagcttactcctttaattcttaatttcagttatatgttctagaattttcattttattttataggttttactaaatattttctgcctgataacttcaataattttattttctgggtgtcagtatctattgtatgcttttcctatttttttccccaattcctattgtttttttatacaactttttttcttttaagaggtagagtctcactctattgcccagggtggaatgcagtggtacaaccatagctcactgtagcctcgaattatgaggctcaagtgatccttttgtctcagtctcccaagtagctatgacaacaggcttataccaccatttgcagctaatttttttattttatttttttgttaagatagggtcttgctatattgcccaggctaatcttgaactcctgggcttaagagattctcctgccttggacacccaaagcactctacataaatctttttattaaatgcatttcagacattatatgtagagataatgcgacactctgcatgatttttttttcctccagaggtgctttagttttgtttctggcaggcagtgagagtggaggcatatcgctttaattcagtcaggaattaaactatttttgagcatgctatgaaactttgtgagagctcaattgtttcttgtcttcttttactactggggtgtagccttctgggggtatcaagctaaatttgtggtgtttactaaaggcaatttttcctcagctgtctgtgaatttcagtttctttcctagtcttgtgaggcttttgaaagttcttattttcgtagcctctcttccctcatttttgttttggaaacaacagttgcccacagtggaaaagtagcttcaaatgttggacttcatctctcctgtcttccctattctgtaatgttggcacacaaattcccagtgcctcagtagctctctgatgccttaaaaatcattaaaaatattgttctcacttttctggatgtttgtagtggaagggttggactacaacaatctagtttgctacatacagaaatttttttccaatttagaattcaaagctgtcatgtcactaacctctgagtgagaaaggctgtgcctgtgactcagtagttcagccttgagaagctttctcagcatgagtagtgttgtggtaaagagcttgaatgctgacgtcagactaattagtttctaatcttggctttgcaacagattagccatgtgatttggtggcaaattgcttcagtttccttatctataaataagtttcataatattaaaggaattaatacttaagacagtatgtgatgatcccatcacccaggtagtgaacatagtatccaatagttagtttttcaacccttgcccacccctctttccctaatctttagctcccaatttctattgttgccacttttatatttatatgtacaccatatttagttcccacttataaatgggaacatgtggtatttgattttctgttcctgaattaattttctgagaatactggcccccagctacatccatgttactgcaaaggacatgatttcattcttttttatggctgtgtagtgtttcatgggagtatatgtaccaccttttctttatccaatcaactcttgatggacatctagctggattccatgactttgctattgtgaatagtactgtgatgaacatatgtgtgcatgtgtctttatggtacaatgatatacattcctttgggtatatacacaataatgggactgctgggtcaaatggtaattctgttttcagttctttaagaaattgccacactgttttccacgatgttgatctaatttactttccctctaacagtgtgtaagtgttcccgtttctccacaacctcaccagcatctgttactttttgactttttaatgatagccattctgactgcagtgagatggtatctcagtggttttgatttgtatttctctaatgcagtggagtattttttcatatacttattggccatgtgcatgtcttcttctaaaaagtgtctgttcatgtcttttgcctactttttaatggggttgttttttgcttgttggttttttaaattccttatagattctggatattagacctttgttggatgcatagtttgcaaatattttctcctgttctgtagggtgtctgtttactctcttgatagtttcttttgctgtgcagaagctctttagtttacttgggtcctatttgtcgattttttgttgttgttgcaataactctgatatcttcatcttgaaatcttttcctgttcccatgtgcagaatgatattgcctaggttatcttccaggatattgatagttttaggtttaacatttaaatctttaatccatcttgagttgatttttttatatgagatgagaaagggatccagcttcaatcttctgcacatggctagccagttattccagcaccttttattgattaaggaatcctatccctattgctagtttttgtcaactttgtcaaagatcgatggttttaggtgtgtggccttacttctgggctctgggctgtctattctgttccgttggtatatgtgttttattttttatttttattattttaccagtaccatgttgttttggtttctgtagccatgtagtatagtttggaggtgggtaatgtaatccctacagcattgctcttttgcttacgattgccttggctattcgggcacttttttgattccatatgaattttaaaatagttttttcaaattctgtaaagaatgtcatcggtagtttgttaagaataacattgaatctgtgaattgctttgggaaatcttaataatattgattcttcttatccatgaacatgggatgtttttccatttgtttgtatcacctgtgatttctttgagcagtgttttttaattctcattgaggagatctttcgccttcctggttagctgtattcctaggtattttattctttttgtggctattgtgaatgtgattctgttcttgatttggctttcatcttggatattgttggtttgtacattgattttctattctgaaactttgctgaagttgcttatcagatctaggggctctggggcagactatggggttttctaggtataggattgtatcatcttgcaaacaaggataaaactatccctgtttggagacttcctctcttcctgtttggctgccttttatttctttctcttgcctgattgctctggataggactttcagtattatggtgaataggagtggtgagagtggtcatccttgtcctgttacagttctaaagggaaattcttctagctctttcccacttagtatgattttggctgtgtgtttttcatcgatgggctgttattactttgaggtatgttccttcattgcctagtttgttaagggtttttaaaatgaagggatgttgaattttatcaatagccttttctgcatctattgagatgatcatgtggtttttgtttttagttctgtttatgtgataaatcacatttactgatttgtatatgttggaccaaactttcaaccctgggataaagcctacttgattgtagtggattagctttctgatgtgttgctgatttggtttgatagtatgttgttgaggatttttgcatctatgttcatcaagcatactggcctgaaatttttgttgttgttgttttgtgtctctgccagggtttggtatcaggatgatgctaggctcatagaatgagttagggaggggtccctcctctgcaattttttggattagtttcagtagggatggtatcagttcttctttatacatttggtagaattcacctgttgcttatttatttattttttttgagacaggatctcactctgttgcccaggctggagtgaagtgatgcagtcgaggctcactgcaccctcgacctcccagggtcaagcaaccctcctgcctcaacctccctagtatctggaactacaggcatgtgccgccatgcccagcttatttttaaattttttgtagagacagggtcctgctatgctgctcaggctggtcttgaactcctggactcaagtaatccttctgcctcggcctcccaaagtgctgggattacaggtgtgaaatactatgcctgacctttttggtagtcttttaaattactgattcaatttcagaactcatattgatcagttcagggatccagtttcttcctgttttgatcttggcaatttgtatgtttccaggaattcattcatttctttcagtttatgtagtttgtctgcatagaggtgtttgtaatagtctttgaggcttttaaaaaaaaattctttggggtcagttgtaatgtcccctttttcatttctgattgtttattgagaccttgtccctttttttctttattagcctagctaacagtctatcaatcttatttattctttcaagaaaccaagctctgcatcattgatcttttgtatgtttttttgtgtgtgtgtcttcattttccttagtttagctctgaatttggttatttcttgttttctgctagcttgcttgcagaaaccatgtgcagaaggggttggtttgctcttgtttgtctagttcctgtaggtgtgatgttaggttatgaattttatatctttctaaatttttgatgcgggtgtttagtgctataaacttccctcttcacactgctttagctatgtcccagagattctttgttgtatctttgttctcattagttttctaagaattttatatttctgccttaattttattgtacctataagtcatgcagaagcagtttgtttaattaccatgtaattgtgtagttttgagcaattttcttggcattagttcctatttttattgtgctgtggtctgatagtgtgtttggtgtgacttttttttttttaatttgctgaggattgtttttatggccaataatgtggttgattttagagtatgtgccatgtgcacgtgagaagaatgtgttttctgttattttgtggtagaggattctgtagaagtctgttaggcccattttgtcaagtgtcaagttcaagtcccaaatatttttgttagttttctgtcttgatctaatattgtcagtggggtgttgaattctccttctattattgtgtggttgtgtaagtttcattgtaggtctctacgaactcattttatgagtctggatgctcctgtgttggatgcatatatatgtaggatagctaggtcttcttgttggattgaacctttaccattatgtaatgcccttctttgtcttttaaattattgttggtttaaagtttgttttgtctaaagcaaactatagcaagccctgctttttttctgctttccatttgcttggtagatttttcttcattccttttctttcagcttatgggtgtcatcgcatgtgagatgggtctcttgaagacacatatggcgtcttacttctttatccaacttccactttgtgtcttttaattggagcatgcatagttttagcctgtttacattcaaggttaatattaacatgtacagatatgattctgatatcatgttgttagttggttactatgcagacttgattgtgtggtttctttgtaatgttaatgatctatatacttaagtgttttttttttgtggcgcccagtaactgtctttcatttccatatttagcactcccttaagtatttcttttgaggcaggtcttgtggtattgaattcccttagcatttgcttgtcccaaaaggatcttatttctcctttgtgcgtgaaagctctgttgttatttccttagcttggtctgttctgctgtgaatacttgcaattgtattatgaaattcttatagtgtgtttttcagctctgtgagtgagatcagttctattctttcttgtaatgaccatttcatttttcagctcctgtatcattgccttatattccttagatttcttggattcagtttcaactttctcctatatctgaatgatctttgttcttatctgtatttctgaagtgtgtcatttcagccatttcagcctggttaagaacatttgctggggaactagagcagtcatgtggaggaaagaagacaatctgactttttgagttgtcagagtttttgttatggttctttctcatctgtgtcagctgatgtttctttaactgtgttgtaatttgaatacagtcagttgactccttttctggatatttttagaggaaagaggctttgtgcagggtctttatttgtagttgatgatagttctgttttaaattctttgagaaatctccaaactgttttaaactgtggctaaactaatttacgttcctccagcagtgtatacctttaccattttaccaatgtagttttatcacatttttgttaattcaatgcgcaggtttagagtgctatgtctatgttaatagtgttcatttcttaattttgtggggaatcaggatcacatattctttcttgcacactgttctatttttcttgagttaataattgtctcatgattttcgtttgacagttttctatgaattaatcaccaatttaacccatacttgtcaaacctgtacaatattaatatggtaaaaacgttagatggtctataaatgtataaatgtcttcttctatttttcctgttgacttaatgctctatggtcttcatgctccatttgtagttttgtggtcccctagagccaggggtcactctctggtgattcttttacttatatccctgaagagtccctactctgcttttctgtgttggaacttgtttcctggattctatgttttatctttcttggtttatactcttgttttagagaagcatatcttccagcaactttttcagggaacactttgtaggtaagtgatttttagagcttgtatgtcttaaaatgtcttttttttttactctcaaatttgattggtaatttagttgggcataaaaacataaatttgaaattagtttgcctcatgtaccatggtatattcaatccagcatgccaatatattgactctctctgtctgaaatttttaggctgagctgatagcttttagctgtgagcaaccctgtctatttactccagtatgtctgaaaagtatttttatttatttatctcctgtcttcaaaaagtttgggaagaactttatttagtttatagtgttcttgttgataaactccttagataaaatttctaatttttcaatgtagcttccccgccgcttttccttctcactgataaactttacgtttcttttttagtccaaatattctgagattgtatgaagacttaagttagtgtgatacttaaaaataaacattttggaaaatgtttttggattacttctttggtaatttcaaaccctgccttgtttttttctttctagaactcctgttagccatcagttgaaccccctgtatgaattcctaactttataatcttttaggatattttttcttctactttctgggatattttctccatttgatttaaaatacttctttaaagattttttaaatcatatttttaatttttgagaactttttcttattctaaatatgttcattaaaatagtttttttgttcttgttgcatcttcttttatcacattgagacagtcctttattttaaagtttatataagcattttcgattcctactggtttttatttttttcttttgtgtgatctgtcttttatgtgtaaactttccccagtttgtaatgattctaggctgttcattcatatttaaaaatgaggcactagaatggtgatggaaagtgccatgtcaaagggggtggcttgtaaagtgggagacatcactctaggataatcgggcagtaagccaatctcccataagatgattctcagttattggcatagttgcacatcttttcttttaggtggttcaatttctccaaagcttacacaatagaattcttgaaatacctgctaacaacacacagatggaaaggaatagacctgactgccagcattatggaaacaaacaaaaaatgaggtgatgaaaatatcattgttcaaaaataacaggttaaattaatccccactatttccagtaatgttgttacatccataccatcagctgtgtctattactggaagctctgtatcagtctggttttatttcttcagactagtcaatctctagctttctactgacataggagaggagtggatgcctggctggggtgatggagagagtgtgttagaattcattcttgctcaaaattttatctaaacccatctgcatatttttagttcaacctctcatgcttatagtcagatgcttatacctctaagtcatgagactttgggggattctgtgaaggaaattaactttaccctcttttgatttctttttcttgaagtttaagcttaaacttttccttctctgctatgccatataccccttgtctatttgctttcttccttctaactctttctcatctgccgttgtttccttttccattcattttatctatgtggttgtatatttttatattatctactctcatttcagtggtgttttggctctacttttcactggatattccacagcttgatagggaagtcctaagaaagtccaagctggtgggaattatacacacatttagaggtgtatgtcagcatagaggtctggtgtacagagcagataacaatttgagttgtttgaaccagaacttgtggaatgagtggaatttgacagctagcaactgaaagaagagtgttcaaatacttgcttgatatagtctcctcacagacatcagacacacaaatctttccatgttgaactttgaaatattatagctttgagtaaatgaatgtatcataaaaatttttcatcatgatacacagacatgggtaaggtgagatgaataataactgaagtaaattaatagactgtgtgttctcttttgcttgtgttgcatgtattgtgcacacctgatttgcttacatctttgctactcaaagtgtgatccctggaccacagtatcaacatcatctggatcttgttagatatgtagaattgtggccccatctcagacctactgaatcagagtatgcattttaagaagacgcctagatgacttgtaagcacaggaaagtttgagaagcactggctgttgttatgcattcatcattaggttatacattctttatttcctccttttcctattagaacaaaacaaaacaactacacatgataagtatgtggtataatagagacatcatttattctagtcaatacattatctgtggttacttaaattcatggagtgcagttttatgatgcagataaagcatgaactgtttggtgttttggcatgggttttggaagcagatggacttggtagcaaacattgcatttgacacagattcttaattacttttacccttggtaaaataaaaatttacatagttttctttactgagttcttatgaagattaaataaaatgatgtttctaaaatgcttagcacagtatcgtaggcacatgcaattaatattagtacccttttcttcctcaccgaaatgagtgtcaaaattttaaggcattacaactaatggccagggaatttgatatggaagattttatttacctattttgtttaaaaaattatttgatactgttgagctttttaaattttttaatttttatggatacatagtaggcatgtatatttatgagtaacatgagatattttcatacaggcatgcaatgtgtagtaatcacatccatgttgacatatacatatatccataaaactgtaatcacaattaagacagtgaaagtcttcatcactcccaaaagcttcttctctattgtcaattccggcttcctgccctgtcaccaggctaccattgctctgctttctgtcactgtatttgagttttcattttgtagagatttttataaatggacatatgcagtatgtacttttttgtctaacttattttacttagcataattaattagcattaattagtgtgagattcattcatgttgtagtgtgttcagtccttttatcactgagtactattccatcatatggatgtatcacagtttgtcaatccattcacacaattcacaatttggttgctgactctttctggctttacaagtaaagctgctgtgaacattcacggacaagtcttgtttggaaatatactttcttttccttaaaattgaaatgttttgattatgtgggagttgtatgcttagccttttacaaaattcacaaactgttttttaaagtcattgtacccttttacactcccattggcagtgcatgagagttaaaatacctccacttccttaccaacacttggtatgatcagtcttttaaattttagtcattccaatagatgtgtagttgtatgctattatggatttaattcgtttatatgagtaataattttgaacacctatcttttcatggacttctatgtcatctgtatttttgttcataaattgtatattcaaatctttcccactttttaaattgggttatttgtttattatttagtttataattttcctgtatatacaggatacaaactctttatcagacatacgctttgcaaatatttcctcctggcctctggactgtcttttcattcttcttaacaaagtaatccaggagaaacattttaattttgatgatattttgtttattttttttgtttgttttcttaatagatcctgcttttggtgttgtagctaagaaacctttgctaactcacagggttgcaaagatttttgcctatatattttttctatgagtttaatagatttatgtcctaaatttaggtctataattcattttgtgttaatttttgtatgtggtgtaggcatatactgaagtttattatgattacttttgcataaggggacctaattactccagcaaaattttttatgaaggctattctttttccattgacttacatttgtatttttgtcaaaaagtagttgtataaataagtgggtcttcttctgaactctgtattttatcccagtgttctatttgtccatctttataccaaaattaactatcttggttatcatagctttacagtaaaacttaaatttaggtagtgttagacctttaattttgttcttttttttaaaaaaaatgtttttaactattctaggtcatttgcctttccatatgaattttagaatctgcttgtcagtttctcaaaattatgctggaattttaaccaggattgaattgagtctatagatgaattaagggagaattaactttttaattattttcaatgttctagctcatggtatatctctccatttattttgtcttctttgtttttccttaacaaatcctgttgtgttcattctaaaagtctttcacgtcttttttcagatttatccctaagattttaatactttaaatgcttttgtaaattgattcttaaaaattttgatcttcaataatttgttgctcatacaaatatatataaatatacatttaatttttgtaaattcatcttgtatcatgcaaacatgctaaatttactttttagtatttttatagatttcatcagattgtctataaatcatgttatctgtgaataaagatggtttaattgtttttgtatgtcttttatttattttattcattcttattacactggctataacttctagtataatatggaatagaaatgatggaaggtaacatctttgtcttttccttgatcctggaagaggcgcatttaatctttggcaattgagtgtaatgttagctataggttttcatagatactttttattaggttagagaaattttcttttattcctactttggcaagagcttttaatcaggaatagatgtcagatttgtcaaatgtttttctgcatctattgagatgatttttctttttaatttttttgaatttagtttttgtaaaaattctagtcatatagtaaattgcattgcttattttaaatgttaaattaaccttgcataactgagataaactccacttgatcaaaatatattacctttttatctattattggatttaatttgttaaaattttgtttaacattttgcatcagtttttatgaggggcagtggtctttagtagtctttttaaaatttgtctttgtcttatatttataggtaatcataacctcatagaattattcagaagtattctcttattttcaattttctggaagagtttgtgttggatgggtattatttctcacttaaatgtttggtagatttcactaatgaagccatctaggcttttagggttttttattagaagatatttaattacaaattcaatttttaatatacattagggccactcaagttgttcaatttagtatcataaggattttttttaaactgtattctattattaacttcttaatttgtatagaatcagtggtaatagcacctttctcatagttgatattcataacttgtgccattttttcttgatcactctgcctagaggcttatcaatcttattattgatcttctcaaacaaccagcctttgatttcattcatttttctctaatgtttttatttttacttccttgatttccactcttctttctttattctacttagttttggtttaactgactcttctaattgctttgcatgggagatgaggtcatcaatttgataccattttgttttctaatgtaggtgtttaatggtatacattttcccctaaatgctgattttagaggcatcccacaaatactggcatgttgtactttcattttcattcagttcaaagtactttctatgtttccttttgattccttttttcatctatgagttatttagaagtgttatttttcaaatatttgggattttcaagaaatatttctgttattgatttccaatttaatttcattttaaccagtgaacattctttgtaggactttaatcctgttaagtttattgggacttgctttatggtctggaatatgatctaccttggtaaatgctccatatgcactggagaagaatatgtattatgttgttgttgggtggcatttttttataaacagcaattacatcaagttgtttgatagtattgtacaaatcttctgtatccttactgatattatgtcttgagcagcattgaaatctcttgactataattgtacatttttctatttcttcttagatttgtattcatttttgtttcatgtgttgtgaagctctgttgtaatgttcacaaacatttagaattgttatatgttcttgattgatacttttatcatcatgaaatgataattatgttatcatctgaaacctactttgtctgatagctttcttttgattagtgttagagtggtatgccttttccatccttttacttgtaacttatgtccttatatttcaagtgcatttcttacaagtagcatacaattggatcttgttttatccaatcttacaaattttgcctttttttgagcatgtaaattatatattaggttggtgcaaaagtaattgcttttaaataaatttatcatacctttaaaagcaaaaaccacagttacttttgcatcaacctaatagtataaagtaaataacataaaccattttatgtgattaatgttcccttctgctagttctatcattcaaactgctgtcatttttgattgattaatttttctcttctttatgggtcatatttttctgcttctttacatgcctgctaattttttattgaattccaaatattacacattttaaccttgttttgtgctaattatttttgcatgcctataaataatcttgaaacaaattgcttgaaataatttgattctttaggatctcgtttttaagatttgttaggcaggactggcaaagtgctcagtttgatgataaatacttcccactcctgaagcaagaccccttttttgtactttactcaatgactaatgaattatgaatatttcagtctggctgatggaaacaaagtgtattgctggtcctgagcaccagaaacggttatctttaatcctttaaaaaaattatttatttatttatttattttgagacagtctcgctctgtcacccaggcaggagtgcagtggcgtgatcttggctcactgcaatctccccctcccgggttcaaacaattctcctgcctcagcctcccaagtagctaggatcacaggcgcccaccaccacacccggctaatttttttgtatttttagtagagatggggtttcaccatgttggccaggctagtctcaaactcctgacctcaggtgatccatctgcctcggcctcccaaagtgctgggattacaggcgtgagccaccacacccggacacctttaactcttttgggtgttttcttccatggtctcaggtagtttcctcaaatgcctgtgttgattattactcatctgaatactcaagcgaagcacactgacaatttccttgccttgtgcagccttctctggcactctgtcctgtggtttctagctgtctttcagagtctaagctttttcccaactcagcacgtccactggactctggtgcagtctctccttcctgtgccatggcctggactcccttaaagcagcaagctgggataatcataggtctcgctctgttgtttactgcctttcatggatcagtatattacattgctcgatggccagtgactggtacctcatcttgtctggaagcacaagtcaaattagaagattcctactcatctttttttttttttttttttttttaacattttcaaccatattaggtgaactactctagcatttttcactttattagatttgtctgttataaccagtttataattaatgtagaaaatgtctttttatttagcttttcctgaggaatctccttgttttgaagaaaacatggattggaaaatgatcagtgataattattttcaatttttgaataacttactcaagtctccaacagcttccatatccaggtaagttatcagaatccaacttctaggtcttgatttaattatcatctgaagataatcaaaacctaattataggatatgcactctttaaaatttatgagcctgatttagatattgacacaatctttcatatgagctgttcaataaatattcctttaatagagtgtgtgactcaagtatcaagttgtttaatagaatgtatgactcaatggattttgaaaggaaatacagatcgtagtaagaagattttccttcaataataacatgatttataatagatgctccaaaaataaggtatttgttttgaaaaattgtcttagctagttacctagagtttaagcaggaaatcaattctatagattctgttagtttcaaagactcctgggagagagaagtggtctttggaactaaatttgtcggactattttctgctgtcctatttcagcacgtgtattgaaatgcagatttttatgtctggttatgaatagtgtgtccagtttaaaggtatactcggttatttgtggggtgtattggaacatgatgggagagatgttttgcataagagcagtaacgctcaaacttgagaatggattaaatctgtgaagactgctaaaaataaaaatgtctgcaccttgccccagtcatatgaaatcttgctctgtgtacaggacccaggtttctatatatttcacacattctataggtggttccagtgcacaccaaagttggagaaccattctgctatatctgtctagaatggggattagtcattcctatggaacttcttaagcccagctattagtaggaacagaagaaaggacaatgggatggatcctctagagaatcaattccttgcttaggtcagatttttaattcctctttcctgaaagcctcaaaaatttaatagccctagaaaaccagcacaaaactagtctatatgtgcacaaggacacatttaattttatatttgtggacccatagcagttggcacagtgtctttcatcatggatagtggtagataattagatgttgatttaatgaatgaaaaatcattgaacattaagtgcaatttatattaagaaagctgaacttgaaatgacaaaacctgggtcgtctcctagtcatgccacataataacagcttgaacctgtcaattaaaaaaataaaaagtttcttttttcatgaaagggaaataatgacgtgtacttcaaaaggctgttgtaggaatgaactaagatagtagttgtgaaagtgctttataaactaaattactaaagtaatataaaaacgtggcaataatactattagtagtactacttctacttcaatttattattctattgctactccataaccctctcagttcccaatacaaataagttttatattctcctctatcaaggcacaatgacttggatggtagttaggcatctattcttagggagggctggatttaggcaaggtttatgttgaattcctaatagaactttcccttttctgatgggattttttccctaggaattatttcaaagaagccattctgtcctaaaaataacaactaactaaattaagaccatatttttgtgtggggtgctcaggtctcagctatcagggaagtaaacagcattcttgcctttgataggtcttatgtctgtcctatgtcagacagtgtgttatacaacaagagcagagggttaaaaaacttaggaagtaatttaccctgtaaggcataaatagccaataaaggtcaaaaattccttacccacaattctgaactcttacaaagtctgaaaatagaggcttttcttatggttgacatcacaactcattcagcaaagatttatcatgaactgatgtgaagcagtttcaagtgtattatcctgcgtcgcgagatcattcacaggtctcactgcgaaagtgttaatacggtgatgatcagggctgtcccagccctcactgagatgcatgaatacatatctgatacctgtatcatgctacatttctaaaggatgaacatcctgaattctgaaacacatgtaaccccaagaatgtcaaaagtggacttgtaagttctgagttagtagaagttagttctgcaagtgtggatttctgttacaagaggggacttacagtgtctgagttgctcttctgagaactctgtattttaaaattaaacacctggcgataagctaccccatatataataatgagtttctgacagtaggatgtatatagtattgttgaaagagcactggaatttgccttccaggactgggagtgcccacaccttgctgaaaccctacaggcatggtttctaatgcactccactatctgtgctacctttacatgccaagacattttgaaatggaattaaatcctaagattcttctggcataaatagcaaacttatctttaataatcatacatattattgttaaatatgccaggggaaaataattgagaatgctttctttttggtggtaggaaacattttaagctaaatatatataacttcattgtgcatttctaaaacactttcaaatcctcacattagtttaatttctgttggaaatcatgttgtctattaaatgtttcatttgtgttttactatcaataaatgagtattaacttggaaatttgataaatcaaatttatttttttattttatactaaaataattctattaatattacagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgaggtgagtatacttttgctttgtgtcatatatgcagttgcgatatatctcaaactactttattttctggagtatagacatgtcaaaaacagtatttgtatctaatacctttgaaagatctttgatgtaaatttgtcttaataaatattttatcaaaatgtcaaggtaaaagaattttgattactgtcatctagtaaaatataaacccagcccagggtaattaatcacgtattattcttacatttttagattatgaaaacaattatgaattctattttatatggatctgaaaaattagttttcatagctgtacatgcatatacaggattgacataatttgaattgctatactaactgtctaatcaccaactaggggcttaagtattctcaacccaatgaatctactgtggtatttgcatttagagacataaaaattgataatcacattatcttcttttcatatatctttaaaaatctcgtttgaagtttgccagtgaaaaggctggagggaaattccaatttattccatgatgtctgctttagtcaagtttcaagcagagtaacaaaaatcatcaaaggatttaatccaaggaaatcagcttacacaattttgggggctggctgagtaagtctgcaatcagtagggctgactgtcaggaagggaggcccacagtaggcaggggcgcccacagcaggcaggggcgctgcgggcatgagtgaaagctccttgtccacagtggtcaggaaggaagaccaggggaagggagagccactgactatgaatacccagcagtggttttgtgcctctaagttacagaggttctatgccctctttcagagttttcctggcccactcaggacagtatcccttctgactaatttaaagttaactgatcagggattttaactccatctgcaaaatctctttatagcaacacctaggttagtgttcgattgaatagctgggagaagatgtacttatattacaaaatggctataactcccatctatcctagaactctcatgagagaatctcccctgtagcccacccagatgagaaacatacaagaaaggggcttcttcagctattgtttagcctagtcatgttgatacatctgtctgagcaatttgctagtacttctaaagctcagaaaaatataaatatgctaaccacttttcagacacttatctcttacatcaagaatcacattgtagtcattttactttctttcctaagtaaaagcccttttaacctttttcataagcaaaagtttgtggctttttaagttgctaggtttaaagaactgtaacagaatttgttcatgaaattcctcactcttttcattatttggcaacaaaatattgagtttcatctgaaattattttagcatgtcatcttttgctcagtattatcttcccatgatgctattataaaacaaataaaataatataaatcactatgtatcttaatatttccactgttaatgtattaaaaattaaattaaaagtatatatatatatatatttacagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaaggtaattaaaaagctgaattcactttgtttttttctctaccgcagtagctataaaatagaaccatgcaggaattacagtgaatcggggtaagtagttcttcttgacttcaactttgtttacactctgaagttggcttcaacatagagcaattcaggtccagtcattctttttcataattcgactcattatttggcattcaaatataattgcagtttattcaaaatatttcaaaagtaagttattttattctcagaagcaaaaacctcttattctattcactcatcccaagactagttgcataaacaatttttctgttcatatcctctggcagccaagggtcctatgactcagtatacacacaagaacatgaagctgcttgcttcacagaaaattatgctttcagttgtagctaaccacaggaaagggccaggcagctgctggcttctgcccttttttgattctgccagacttcacgtggttgatccacctccaagccctcctatcgctgaaagttatgtccatagaaacctgttcttaaaagctccagtcttgctagttgtcatgccttggaagcagtctgttgccttaggttggagaccctgtgcctcttgatgtgcagaggcccagagatgctgcagctgtccctacctgtcctttctgtgggtgaaaatactgttagggtggtccctggtctctgtttctccctgctttcctctctggcccacatggagattggagatgccatgtcaaccctggttcatttgccaggcaggctgacttattttctgttggttctattactccagagatgtaccttgaatccagtcatgttctatgagttggaaagatgtctttagttggtgaaacaggtagccactggcacaaataactattgctacctaggaatttgactgctagttttcagagcttccttcttcatctcctccttgcttctgatgtcaaactatattttgtttgactttagtgctcttctctgaattgtcttttgagctgaggtggtcctggcaaccccattctccaccaatctcaggttttatctcaaatttttcagttctccacagagggagtttataccttagctcttcataccatcatgttttgacaccttttcaacatttacctttgcatttcaaaagaatagaacaaaagaagaaagaaaagcaagtattaagcttattggccacaaaattgatgctttgaaataattctggagacctaaagttttctaaaggtccagaatgtgttatctgtgttttcttatgttcctatgaagaaaatatgattatgcagggagggaggatggttcttacatgtgtgttataacttaacctacacagtagagatgcacatgggttgcacatttttacccttttatgtcattgtatatatttttttgctaagtgttgttgagatttgtgaagttttccagcagactgtgaagccctcagaagccatggagatgctgcagaaagtgaagatgatggtcgtacgtgtgctcaccatcgttgcaggtgggctgctcatataacaagtgctctgcaattgccctgtgccagttttcagaactcaggtgtcagagagatgagtatattgcacttgagtttcttttagaacaaagcacagctgtcttagtctggcaaccaggccttgagggatctgcccctcccaacctcattcccaccactgggcctctactccagccaaattgaacggcccgttcctgcgcctttgctgggttttctggtctctgtctttgctcatggaatgtgcttcccttgtcttcttgacctaaactacagccgtactctgtggcctagagctgggggtgtcttgtccagaagtgttcccccatctcctttactggcaaagaccttgaggagactttgatcacgtgcagtatcgtactttcttctttcttacatttcctccctctgctacagtcaatattttttgaagatagaaactgtgtcataaccttctgtgtgcatttcctgatgggtgctgagtagtccctgcagtaacctgaattccctacagccgtggcacttattgctggtattatagtttttggtgtcttcttttcctgctgcagtctgtaagcttactgggaacaggatcagtctcttgctaaattctgtgtctccataatactcagcatagtgtccagcaatagtgactatattgtaaatgaattaattcatctgctaagatgatacttgccaaatccattcctgcacatttcagtgcaatctcctttcaatgccactgctgaaggagagtcccacgagctgctttagagggtaactagatgatcttagggcttttctgaaaatgtgaacattagactttagagcacacttgagtccatggaatggaccacagttgtttaagtaattcacaggtgcacagaggtgctgccatcctctggcccagtctcctgagcagggctgcccagagccccctcagtgggctactgggcctgagtaccctgtcttagctgatggcagtgggttttgacaacatgaatcgaagcccagaagaggaggggaggcgaggagaaatggggaagccaagggtggatccgatcagatcaagagggaaagaaaaaagtgaggggtcatctgagtagggcttactccatatcctggccccggactccctgccccctagctcatctgatccacatgttcattcttctgcctttccttgatttactcctggatcattattattatttcgattactatcaggttgttatattatgatttgtagattacgtgttatttcctctggaaagcttttcttcacctaccctgtctggggtcacatggccttagctccttgttatggctcttaccaccgtgtgctattctgatgatgaacatgtgtctcttctacagttgtgagaacccagagactgtgcctgtctattgatcactacaaacctggcacatggggattagaacatgggaaatgttgattgacatttgttgaatgaatgaataagtgccagaagctcttctatacttacgtcatgtttcactggaattaccaaatgtgaaatctgttcatgggggagtgctcagcagcgagaagtagtgggtgggctgttggcatgttctgggcctattttgtacgactgagcaaactgtgggggcctggggaggatgttgtagagaggagtctggtttacccaggaaggggcacagtggacgtattcccaacatccactatcagaagaggaagggttaccggccccaggatggctaattggtgggtgtgggccactgagtctgtgagccaggagtatggaccagcatctactggggagcggtatggaggagaaatgagccttgggcagaaccagcatgtcaaatccatttttcaaaacaaaaaagataaatttttctttgtattgataagtgctagaaagaagctaaagtatggccatgagggtgagagtgaggggtggaggagaggagaagaccttgagggtgcagttcagggtgaggacatttcaggtgagacttgcgtagtgaggatgtgtgtctgccatgctcatggttatatcttcccagggtttaggaaacatactgacataggcatgataggcattcaatcaatatgtgtagaaggattggataggtcaatgcatgagggctggcactaggttgggcacttgtgactgcttgagttaatctacacaatcactgatgggcttcagactagtgtgctgggactcgtggtctgtaaggctgcctccttactgtcacgatggggcactcaggattatacaccttcatgactggtaaggctttattgccccaaatatctttgagggcagagtcaaacatgactgttaaaacaagtgatgtcgtgagaagtgctgtaatggaagaagcaggcgctttgagattgaacaggctgagttccttgattcatgctgagtgacacagggtagcttctgaatctctgtgagccttgaagaaaacataggggaacacctatttcaacctatgtgagaggattaaataaaatgagtcacctccaaggggcttatcctaaggagatgccttgaacatgctagttgccctgtcctgcaagttgaagatgcatctccctgcatgccattgggaaaactacttctcagcttagagggctagttcataagtaaaaactggtaatttagggactgtctatcacagggttagttctaatctgctcactcatccctttttttgtaatacaaatggttgtttgaacagaagaattgattggtcattgggtctaagaaacatggaaaaggagtaagaaacagagggagaagtgggacaagcttgatttaaaaatgaaaccccaactgctgtgtaggggttttgcatgtttttttttcttttaagataatctgtatttccaattagatgttatgaacattggtgattaggaatattgctttctgttgtcaaatagaaatcagtaaagtgttacaatctaagtacaagttaggatggttggtacatgatttcagcatttggaagtgtgctcaggtaaaattcaaatcaaacttcttcctcgttcttgaatgcttatcttccatattgaattcagccacgtttgaagacacaattatctggacatttcacagtcagctaatataatggtttttaaatgaattaaacattcattaatgtatgaatttatatttattttgccattctgtattgcagctgctaaattaatatagcatacttgagattacattagtaacagataattaatttttaatttttatattttatttcaaggaaactcaagcataactaacatttaaactgccaccccactgtccttattgaattgttactccatcctgtagaataggagggcagtgacagatcccataaagttaaagggatggggtggaattgaccaatgtgggcaaatagcccctcctctcccatcatataaagggaacaagaataagatctgttattattattgttgctgaaaatgcactatattttcgtcatatcacagagttgagttcagtatctccaggaggaaagtgacaactttccttctcctgatctagtgctttaaagatgccaaggacaatgcaggagagctcatgcaacggaaggagcctcagtgggcagctactttaatcttccagtttccctaattgacgaattgaggcccagagagtgagagtgagtttcccagggtttcagagtgaagcagtcagagcccatttccagttgaagagacctgagagggtccatggggctgaagggaggagaggaaaggggtccagagagcgctggcagatctggaaagccagagtgggtctgaatgtgtccttggagccaagaagaggggccacagcaagtaggaagggctggagccagggattgggagaggcaatgagaggtggagaaagagggtacccgggaaagttggaggagtcaaggctcaaaaccagctcttgttagtgtcgagacagttgtcaagtgtccttgagggtggtgcctttgagggcaggcttcaagacgtgttagatgtgaggcacatggaggccagatggcctgacagcccagcactgcatcccatgatcatatcatccctgacctaaccttgcaggaatgctgggcttggtcactgtcgactccacgttgtcattttacattgaggaagcaaggggctgacacagcccacagcttgcctgatgccatacattacatcagctttttcagggtgcattctctgctcttttaggtttgaacaacataacttataaacacattattgtgtcttcccgagaccagaggatatgtttatgcttaaagataagtgctgtgatatataacagcacattattaccttcatttcaaattttaataagagattacttaagtgacacattttatatttcctacaataaagatacctgtctttgaaattagtaaaataagattaatgagaaaagaaaaacaaataaggcatcaaggtgggttgcttctggaaagcatgactttggatatattgtgtctactctgcattttatgtggttgaaaactgttttagtaattaataaattttatattttagagtagttttagattcgcagcaaccttgaatggaaggtgcagggatttcccatatactcccttccccaccatagcctccctcattatcagagtggcacatttgttacaattgatgaacccacactgacacagcatcattccgagtccacagttcacattgggcttcactcttggtgttgtcattctatgggttaggacaagcatataatgacatacatccagtgttacagtatcacacacagggttttactgcctgaaaaatcctctgtgctctgcccattcatctctcccacccctctagcccctagcaaccacggatctttttactgtctccatagtttttgtcttttccagcacgtcattgagttgaaatcatacaatatgtagccttttcagatgggcttctttcacttagtaatatgctggaactgttttttcccttccttccttccttccttccttccttccttttttcagacagagtctcgctctgtcgcccaggctggagtgcagtggtgcgacctcagctcattgcaacctctacctcctgggttcaagcaattctcatgcctcagcctcctgagtagctgggattacaggtgcccgccaccatgcccggttaatttttgtatttttagtagagacggggttttaccacattggccaggatggtctcgatctcctgacctcgtgatctgcccaacacggcctcccaaagtgctgggattacaggcgtgagccaccgtgcctggctcagaactttttataaaggacttttgagaaacaatttattattcataatttaagagtcaggataacatttttttttctaattaaaaaaagattttatttcttataaaaatgtattttattttctgtcatgaccaagcatctaggaggtacaaagccctgtgctaggtgccacaatgacaggaaggcagtgataagaaaatttgcccgtggcaggtcttgtgcagatggatttatcgtgcggtgggaggtgagcacacaggcatctgcgcagcagggaggggaggggctttgctcagcctgggaaaggtgggtgtctggaggcagaactctaaaagatacgtaggttcaggaagggagagtgatgccttgtatctgatggccttgaggagacaggagggacatagggcatgactgcagagaggtggaggcacctgaggctgcggaaagacattggatgcaacatggagcctttgcacagattcctgtaatgggggatctcctttggggaagagccttgtggatcagagcgtaaggcagattggaagggtgaggtgggagtgggactgttaagagcacagcagtttcctgggcgtgatctatgggtgctggacagacgcacagatggagagacattgggaggtcatgctgagcagatggggaggttggttggctgtgaggaccagggggaggagagtcatgactggcttccaggaagtgacttgtgaggcatggggcatggagaagaccacacatagacagtgtgtaattcatccttcaaactggggcacttttgagaatgacagagggcactgttcataaccatgcaagaataggtgaaaagcaagtctgtcctgggcaaactggggtgaatgggtaccccacttgtaggggatacagggaaaggagccagtttgaggaggtagagataattaatatttacaaaatcaattaggcccagaaaagcaaaatctttattttattacatttggaactcaaaaggcacagctttaccctcatcatctgaatgttcatcttgatgatttaagaaatgtttaggaatttgtatcactttgaatctttaaaaagtgattttgtgagagtggctagttcaggagaggactgtctattaattatttctctgtgtgtttcctctggcagaaaacccttcctggaccaaggacattttgtgtgctactctgagttgcaagcaaaatgggataaggcatctcattttatctgctatacaaggggtcactttggcgcaggaccacttccaggtttgtcgtctttaatatttcagagaatttcatgttcatgactattggcccttgcaaggcagtccagttattcaaacttgctgcttcgttcttataactacagcaatggtgtcatacacagtcttgttgcaagctgggcttgcagaatgactgctcacccttcctccctcttggcctctcccagtggtgtgctgggttgagtggcactgagttgagagatcggattgttaaattttcaggaattttgcaagctggttgttaaacatagatgtcatcattataaataaattatataaacttatgatgaaataaatcatgttagaaacacaagtaataattactcaagattcatcacttcctaattattttagtatgttttactgttatctctcttcctgagatgatttgcttttgttgtatccacatgatggaaatactatgtagtcttgtgctaagtgcagttcttcccttctctacgtttaatgacgttatggtggcagcatgaactgggccatgcaggagcttttgcaccatggaaattggcaagtgctccaaatcagaattttttttttctggagagttagtttttaaatatttaccagcccaacactggctctaactcattgaatacactggctagtaccaaaaattgatggctgaatgggaaccagcatagcaatttcctttttattaaattggacacatgcccaataggctcccatgcagggtctccaactatagctgaatcagacaatgtgtctcttatttgggccccactcctttgtcctagaattaaagacccctgggcccctaggtaggcctgatccccctgacaagcttggacaatggtgatgtccttccaacaatgcagtgaagacctgtctctcttctagttctggttctgaatgttgtttcttgcttttgtgatccatattatctgtgagtatgagattatcacagaaagcagagaaatagatgatgccgagagagatgagagatagccatgccagactcccacagcatggcaagggtgtcgaatgccatgccttggtgaagtgtcaggagggagtgagagctgctgatctctaatcaatgtcttgtggcctttggaggagtggtgcctgtcagcaggaagccctgagcagtccctagcaatgattgactttacaaccccaaatttacattgatttttttagaacatcaaattcttatttccaggttgtgcagatctttgtcaggtattaaatgtggatacaggaaaaaaaaaagccccacagacaatttttttttttttttttgaaacggagtcttgcactgttgcctgggctggagtgcaatggtgcaatctcggctcactgcaacctctgcctcccgggttcaagtgattcttctgcctcagcctcttgagtagctgggattacaggtgccagccagcacgcctggctaattttttgtatttcttggtagaggtggggtttcactatgttggccaggctggtcttgaactcctgatctcgtgatctgcccacctcgacctcccaaagtgctgggattacaggcatgagccacctcgcccggcccctcacagacaattttttagtgatgagtgaaggttataataataaaatagtcaagagactccagctttcagagcaactgactcaaagactgtatttatagttcaaattgttatatgattgtcaacaagtctggctggtaacagttgggttagttttgataaagagcagaagttcctgtctttaatgacaaaaatagtatgttgcttatctcaggatgcaaagcttttaagatgggtctgtggttcaagggcttcaagtatgtgagacttttagaaatacaaatctttttcaggctgtgggatatgaagtcgccaacagagatgggcaaaaagcacaatgccatttgctagttttcagtatctaaataaatattttaaatatagttttctcagtagcaacatggaattcccatttagagagaaagtttcagctgattgaatcgatatgacaaaagtttggggctgtcaactccttaccctcttccaccctttgttccaaatagtagaaagtagcaataaggaaatgaatggggcagaaattaaacttcaaaaatgacagcaagtgcccactgtatttcctgggctaagctgagttggagaatgcagctggaacttcaggttgggtgggggcttcctactgcctctctagatctagacctttgggtccacctgtatacacttatccagcatttcttgattctaggcctgatgtagccggagaaggagagtctgataggtgctgccttttccacgtggtggttttacctgatcccaaaagtatagcctgatgaatttcaatctcaactttggcctagatgcctctgcttacctggagcctggtacacctgtgctgaagaaacttggaatttttcttccggtagtccttgctactggggtagaatgtgcacttttctactttataatcccctctatgtcaaaattattattttattaaatttaagaataacatccatagcaggaatattataaatgcattgaatgaaaattaatttgcatgcagttacaaattacaaactagaggttctttgctataagggaatactccatggcagagccctcatgcagtaggtttaattcaatctatgttctcaggagtgagttggcccctaaggggatactcacctgtatctattgttctgacctagttgtatttctgcattgatatgctacaaaaagggatctctttggagcaaggagaataccgagcctgaaatgcctgggtgagagaattggagaaggtttagagagcttcacactcagggaaaaaaaaaaaaaaaaaaaaaaaaaaaagagaaaagaagaaaaaagcagagtgtgaaagtccaagggcttctgtgcatgttattagaaatgtgcatgtagcttggagtcttgaggctggacctagacatctctctgccttgcagatgctcttcctgagtttgctaccatcctttttctttctgctttgctgtggtgacattcagacatcagacaataaatggggtctgtgcacattaggggcagtgggtgggtgaaggctggaggaggctgtgtctcttctggtagagcagtcagcggaaacctaagtgaagaaaggaaagaagtctgtacccttgagccctgtcacacgttagaaaatggagacgggcttgagctgagcactccttgtcagaccccttcaggtgttactcacacaatgcaggggttcagttgcttggtgggtatcaacccaatgaccacaaccaaggaggatttaacaatgagatttaagtaaggagaacaccagggatggttcccaaagtagtgcctctgagctggggacgggttaggttttataaacgtcatgtaatgtggatctgattgactgggtcctgccatgggtgatgccagagctcaatccagttggatcctggatcctgccatgcaatgtccgcttcttaattcaatccctgctcctcagtccgagcactccagctccccctgtggttgcacactagttcatccaggcatgcccgggttatgtgacctgagggtccatggcaactgaaaaactactcacaactttgttacgtaaaagtcgaaccagattggcctggtgcggctaacatagacagcagacaccactccacctgctcagtccgtcaaccttcacatgcggaatctcactcctcacctccggcttctgagcccggcattgacacagactcagccacgcccatccccacgtcactcagctcccggcactttccctgggctcctcttgcatccttgaccgactgtctccaattccacacctggctcctctatgtggcagaaggacccaggctgtctccagaccctttctgttctcagtctgtgctcacatgctagggaatcttatgcagattcatttgcaacctaaaaatcccaattacttcctgacaacttccaaatttccttctccagccaacacctcccctgaccttcatgctcatgtgttcagctgcattcccactcagatgtcaagcaggcccctcaactttactcatctgaaaaaaaacctcttcatctttccatgtaatttttcccacccctggtgttctttccctcagatgccagggacaacaaccttggcatgcttgtttagtctttgttcttcttatttttttcagttagaaaactctcccttctaccttccaaatgtttccctgatctggccatgttctaccacctccaccagcacctttcagatatgagccagctctcccttccttctccccttgcctcgatccctaatgcggtagccagagtgacccttccaaaacatcatcagatggtgttactcctttgctgagagtgtccagcgtcttccagtcttatttggaataggtgtccgatttctaagggaggccactgctaggtcctgctgtctgggtggcatatctctccttctgccctccccggcactctcttctccacctcgctggctcctttgcacccacctcagggcctttgcacttgctgctcccgcacctgcagtgtgcttccctaatgatgataaggagggttgtacaccttcctcttgcacctccagcactgcccccacccctgccttattttcctccaggtcacctgtgacatgctgaccagtttgcccctacagctgtctgctggtagtgttcctgcactgggttgtgaacctcatggaggtaggagttttgtctcctgtgttcatagctctcagtccggcacctagcctgggcctggcacttggcaggtgctccataagtattttttgaatgaatgaatgaacagtcctataggatttctgttcaagttccactcccaaatcacttgggaagaaaagaaacttataaaatgaatgacaataatagatgaattagagtcaagaagttgcatgctttgtaataatctattggctggtttagttccccccacagtgagattttgtggtttggttgaggcggtggtgacagtggcatgagtgctctgatcatggattaacgttcatcatttcctgagaagtcttcagccccccccccgccacacacacactaaatctacctcagctctgctggggggctccatcttggggcggcctccagagcttagctcccaaccttgacttttcagcagtcttcacatttccttggaacatatatttgtgagcttcctctggccacttgaatgattcatgattttcctttgcaagagaaattgacagtggttttgaaaaaaatattcaaagttttacttcgacagaaatattatctaagtgttgacctacatatgataccttcccataattggtgcaacctggaactatgcttccaatatcagtaagaatatgttgatataaataaaatgtgatgaagcaaataaattctgatgatgtaaaataaagtatttatggtagaatagctgtgactagggaaagtgtatagattcatgtgtatgtttatagacatagatgttatatgtttgtggtgttttctgggttattttaaatattatgttacctatatttgtcatttaattccacatatggtgttttgcattttgtcaattaataggtattattctaaaaggtttttttttggcaaaatgattggttgtttaaaaaactgattgtttctaggaagatacggataagatgtccatgaaatcttagaggtgggggttagagatgtggagagtggggacctacttctggagtctttccagatgttccccagagtcttaggagcctctccacctgcagtggacagaacaggagcctctcaggctgtactgctgaccttcagagcacggcaaatcccggttttatccacctcacataggaatagccacatatgatttctttctaatcattgtgtttgtggctgtgaattttgaaaagcctcaagtttctttaatttttttttcattttcatatttattttttaataatatatatttgaagtgtacaacatgatgttttgataaacatacaaagtgaaatgattactacaaacaaatgagcatatctgtcatctcagagttatctttgtgtgtcgtgcgtgtgtgttaacagtacctaaaatctactttcttagcagatttccagtatgtaatacaatattggcaactataattctcatgctgtatattaattctctagatgtgttcattctacataactgcaactttataccccttgaccaacatcttcattcctcccaagttcatccctggtaaccaccaccctatgctttgtttctatgggttttttttttttttttgttttgttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccgtttctatgggtttgacttttaaaaagtttgactctacatgtaaatgagatcctgtaatagttttctttttgtggctgacttacatcacttagcatatcttctgggttcatccatgttgctgccagtggcataatttccttctttttacagctgaataatattttattgtatataatgtcacattttctctattcattcatctctttagaaacattttggctgattctatatcttggcttttgtgaataatgtaaatatctctttgggacataatttcatttcctttggctttatacccagaagtgggatttctggatcatatggtagttccatttttaatattttgaggaatcttcatactgttttccataatggctgtaccaatttgcatttccaccaacagggcacaaggtttccctatcctgcacacccttaccaacactcgttatttcttgtctttttgataacagccatcctaacaggtatgaggtaatagctcattgtggttgatttgcattttcctgatgattagtgaaattgagcaccttttcttttacctgtttgccattttgatgtcttctttggataagtgtctgttcaggttctttgaccattttttaaattgagttatttgtttttctgctattgaattgtgtgtgttcctaggaacagagcttcaggaagttaagagccaggcgatttggtggagaattgcgtgttctctgctgtgtgttcaagaacaagctgtcttgcttggctggctaacagcggagccaggagtaaaatctgggcttctgtatttccacagccaagggctctttctactactctgcaatgcacagaagcaactgacatgattgttctctgtgtttcctgagactaatgagaataaatcaaaatcttacagataagtatgtgtgcttctaacctatatcattgctatgttttctaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgtatgctctgatattctttcatgccctccccagtacttccattcatagagaggatgtctaggactctttaaaatgtgaatttcagacagtggtctgtataatatactcttaatgtgcatattaatatatattttccaaacatcaaagttttccatgacaatttttgagtggtaaaatgtaacagcagcattaatcagaaggctaactttattggcgataaagatattagatataagaatgtaatccacaacgcttggtggcaaatgcctgtaatcccctctaatgggaggctgatgtgggagaatcgcttgaggctaggaatttgagaccaacctgggcaacatagcaagaccctgtctctaaaaaataaaagcaacaacaaaaaaattagcaggatttggtgctgtgcatttatggtcccaaccacataggaggctgaggcaggagggttgcttgaccccaggagttcaaggctgcagtgagcagtgattgtgctactgcactccagcctggctgacagataaagggcctgtctcataaattaaataaataaatgaataaatttctgtttgaacagcaaatatttttcttttcttttctctttttttttttttgagatggagtctcgctctgttgcccaggctggagtgcagtggcgcgatctcggctcactgcaagctccacctcccgggttcacgccattctccctcctcagcctcctgagtagctgggactacaggcacccgccaccatgcccggctaattttgtttttttattttaatagagatggggtttcaccgtgttagccaggatggtctccatctcctgacctcatgatccgcccccttcggcctcccaaagtgctgggattacaggctgagccaccgcacccggtcgcaaatatttttcaaattaccttcatgtttgatcaattttgcttagtgttctgaaagtgtaaagcaccagaaggggaaataaggaactttaaattctgcaagtgactttttcactgaaagaatgatgttcatctgaccctggctatcctaatttctcgtacgttccatgatctatcctatctattctcttcacagttgtgaaaagccatttattatgcatcctcattcccctggttcatctcggttggcaggagctctgagaaagaaatactggagtgtgggtagtattaatggatattcacatacagatggtattgggagacatgtgggtctaattgttgcaggaactttatggaaatgtgatcttgttatccagtccatctcttgggagctgaggcagtattattcattccaacactgtttctgatgttttagcttgcctaatttagctttaattttctgccattttaggttggccaaaagcctcgaggaaacttggtcatcagggaatcccatcatgacttttctcagcaatttcacagtaactgagggtaagtatgtggttttccaagtttgcttgattaaaaattaaatttagtttctcatgcaaatatattattaaaataaaacatacaacagaaaatttatgctatatgtgatacataatcatttacaacttggctggtatgatgtatttggcatttataaagaaagtcctgaaatcctagggtaccatgttgaagcagaggaacaaagagaagcttctgtggtctggattttgctctggccttgcctcctcggacaagcaattgatgtctgtgtgtctctgtttccttggctgttcactctgtcaactcatgaagcttcttgtagcattaacatgccatgtctgaagaattctggcaaatacttaaatgatccctctcttcttaaaaaagtgagatgagtagatgcatgtatacaagtgagtttcttatagcacttggtcactgctccctaagaagaagctctttctttctttctttctttttttttttttgtgtctcactctgtcacccagctggagtacagtggcgtgatctcggctcactgcaacctccgcctcctgggttcaagcgattctcctgcctcagcctcctgagtagctgggattacagggatgtgccaccatgcccggctatttttttttttttttttgtatttttagtagagacagggtttcaccatgttggtcaggctggtctcgaactcctgacctttgatctgcccacctcggcctcccaaagtgctgggattacaggtgtgagccaccacacccagccagaagaaactctttctaaagtaaatgttcttaaaacatacaggccttagagagagtagaccagtaaccagaaaataccacagaacctggcattttggtttattgtcatataaattatttaagttattcccaggggagtaaggtatgactttatttagtgatttatgggttgaatggtgtgaaagaaactatcctagccaggttgtaatatcaaattttgttttcgcagtcagtaatgatctaaacctttattacacaaatttcttattttccttactttgcagatgtaaaaataaaagatttgatgaagaatatcaccaagttgactgaggagcttcgctcttccatccaaatctcgaatgagactatccatagcattctagaagcaaatatttcccactccaaggtgtggtgctgtttcttgtctgtctgttttgctcatggaaggagccttagcctgaagtcactggcactgtgttgtcctttcttccttcttgccttcctctcctttggctagtgtagtgggttgctgcacaaatgatataattggaggcagaaaggaaacaagagaacaagcaaggaaccaaagggtgtcattgtcccatgccaaaatcttagggtttttaattccataatattttctttatttggagttagaacaaagttggtgattatttattctgttgatttccagccctgatgcatgacacctgggaagggtctcggcttgattcagcaggtgttgcaaaattcttaaaatacccaaaaccaaaaacagctaaaaatatcttaagaatcaactatgacttcctctgagtggagagtgactgggcacagtctgactatgtgctaccgtagtgaatcactgtgaacgcaaatgagtaatggcaggctgtgtcatctccaagctgaaaaatgtgataaaacaatcaaagagctactgcaacaaaccaagggatgagtaacacatacgggccacatggggtatggtttctctgtggaaaaggggaacggggacatctcatgttttccacagcagatatcacctggatccttagcaggagattttctgagacagctttcagcacttctagttggggttttatcttcctgtacagagaaccttccagaagtagtaaccgtggagctgactcgtaagtgaacgttgcaattgaccatcaactgggccccaacacacgtttaatatcatgtcaattctggttaattggggcttattgcaagcttgacgggtggactaatgaagaattaatctaaattaaaaagagattagaagctgggaaaccaaaattcaaatgacagtgtcaccaagttacttataataaggcacttagtatttatcttcaaggaaaaatgtcaaattcagcttattaaacatgcaagagccaaggaaagcagggggcagtgctgaaattgtctcttccctacctcgcatgatgccttatagagaaacaatgaagatttttggtttaaaatctttagttattgaaacgagtaataggggaaagaagcagtggaaggagtaatcggagcagctacctgggaatgttttaagaccagggtcagattagctaacttctggggtccctttcaaattcagttttatgatactttttgggtttgggctcaactgtttttgatgaccactgcctgatgaaacaagtggccactgggtgtcactgctgttctattatgggagggctgtgcacagagaaggctcctgtggtaatgtggtattgtcttgtgtagatggttctgtagtgctttttttgcactctgtgtatctttctctacctctttgtcagtatgaatcattatgatcgcctaaacagctggacagttaagtaattgggaggagtatttaaaaagttgcattcttgcgtttcaaataagtaatgagattatttgctttgatggttaagtatatccataaatgcacatgtatctacagatcctaggcaaggaattaacattaggttaggaggtgacactttggatacttgttttttctagattgtcaggtttttagcagcaccatattatttctagtatccttttcttatctttcttcctgggtttctctaccatagctttagtcagtttgcaaataatcacatcagattcttagtccaggctgttggtggcatgcagggaatactcttcagtggtgctaaagccctggcaaaattgcagaaatcttcattcattcatttcttcctttattcacttaggaggtttctgcatgacaggcatggtcccaaaaacttgggctcaaagcccgtgctccaagggagccaatgttctgtgggggatgacacagtaaatatgcaaacaaaagaaggtcagtgttaagagaccagaaagttctatcatgcaaatagaacacaacaatgaggacaggtggtccctggaagcctccctgaatcggtgaagatggatgtcagactggaatgatgatctgcatatgaagagctatatgagagtcacagagctggggcatttctgtcaaaagaccagagacaggagtgagcagaaggaggcaaatgcagcagatgcatggataccatctcatttttctttcctgccctcttccctggctgcagagaacctgccatgggcacccacccatgggaatttcctttttcttgcagagctctattctctaatatcagcatcacccaattaaaaccacaaatcacaggggcttcctggacactggagcccatctagcccagccttctgtcctgggtttgcatcctgtccacctgccctgtgaagcacccatccacttcatgctgtgttcctatgttttaggcacatgttcaaatcaacaatgacttccttctttgtgttgggccaaatttttattcttttaaaattagcaatgaggccaaagtgtcaggacccaaatagattgagagagcaatcaaaagtcggccctctgtccctttattttctgtggtaaacaattaggcagagttcagaggacttttgcttggaagatgaatattttttcacagtcctcagtggattcattctccccgcgccacaaatcttaaggaggaagggagagggcattccctgaaagttccaatctcttctgggaggctccttcaaatggaaaggtattctgaattttttttctttctgtttcttttgagcagaaatgattgagtttggtgaatctggtcaaatttccttatctcacttggggccggtcctgggggctggttctgtcggttgcgacattaacagagctgctgggcataatttatggagagggagagattccttttaggagtttggaaacattacacattccacttgttttaatacatgaagtttgtttcctggaaagctccaacagatagttcttggtgaaactcatttcagagcagacactggtcaaaatttgctcattcttttttttttttctttctctgaagacaaaaagtaattaatgtgtgactagagttatgggtttctgggatcatgagaagtttggcctgaagtttcctggaagacaccatctgtcatgtgcagagtctcattctagagaaagtccttcctaggccttagactgcttgtctggctctgtcaccacatcaggagattggggtttgtggtccttgtaatccaggattcacagaatgaagtgcacacacccatccaccaccatctcattctctggtgttcttagagtagggcttttctctttgatttgtttgatttgttgtcctaccagagtattctcagtaaatgtggtaggttctcattaaacattcactaaaataaagtgaaattccagctactctccttccattaagtcagctagcgtttcttaggtttatgaaagccacgttaccttatttgctcattaggaattctgagaaatgagtattgtgctaagggcatttgtgtctcatttaactccctctgagcagggcatttctcttctttcacagatgaatgtgatgctgtggaagtcacagctgggagagggcctgaaatcaaacccacgtctttgaacttgaactgtgttattcttccatcacatgatgttattgcttcaatttgttacaaattaatagttctaagaaaattactgcttgccgatgggtttcctcttctcctacttgcacttatgtaaatatttttaaaccttaattccccaattggcattgatctctgcaaaaatgcttcttgctaattttggcaaaatattttttcctttttatttttaaaaattaaacttttattttaggcttaggggtgcatatgctggtttgttatataggtaaactcgtgtcagggggtttgtagtacagattatttcatcacccaggtattaagcctagtatccaatagttattttttctgattctctccctccttccaacctccaccctcaaataggccccagtgtgctttgttcccctctttgtagccatgtgttctcattatttagctccaacttatatgtgagaatttgcagtatttcattttctgttcctgtgttcatttgctgacgataatggcctccagctccatccatgtccctccaaaggacatgaccttgttctttttatggctgcatagtattccatggtgtatatgtaccatattttctttgtccagtttgcccttgatgggcatttaggttggtttcatgtccttgctattgtgaatagtgctgcaatgaacatacatgtgtaggtatcctcatggtagaatgatttatattcctttgggtatacagccagtaatgggtcaaatggtagttctctttctagttctgtgaggaatcgccacactggtttccacaatggttgaactaatttacattctcaccaggagtgtataaatgttcccttttctctgcaacctcatcagaatcggttacttttttgactttttagtaataatcattctaattggtgtgagatggcatctcattgtggttttgatttgcatgtctctaatgatcagtaatattgagatttttttcatatgcttgttggctgcatgtatgttttcttctgaaaagtgtctgttcatgtcctttgcccactttttaatgaggttgtttgtttttttcttgtaaattttttttaagttctttatagatactggatattagacctttgtcagatgcatattttgcaaaacctcccgttctgtagattgtctgtatactctgttgatagtttcttttgctgtgcgtaagctttttagtttaattaggtcccatttttcaatttttgcttttcttgagtttgcttctggcatcttcatcatgaagtctttgcccattcctatgtccagaatagtattacctaggttgtcttccagggtttttatagttttgggttttacatttaaatctttaacccatcttgagttgatttttgtatagcataaggaagaagcccagtttcaatcttctgcacatggctagccagttatctcagcaccatttattgaatagggaatctttccctattgcttgtttttgtcaggtttgtcgaagatcagatagttataggtttacggccttatttctggactctattttctattagttccataggtctatgtgtctgtttttgtgccagtaccatgctgttttggttaattggatattctttcaaggtgttttttgatatcaaattctgatactttaatttgcaaagtatcatttttttctctcaacttcatcagtcaccaaaagatgagagtatcttttatattttcatccaagtcgttagtgcagaaagattaccatggcataggaaggtataacctaacacctatttatttgtttgggctcttaaatcagttgcaacatgtctgtctggggtgtcttggtaatttattagcctaataatttcatcattaaaagaaaatgactttatattgacatggctcattgatcatgactgtatcgacatggtttccagcaattttctttttcttcaagggcttacacataatcttttggataatccatgattagaattcttcaagaattgacattattatctattagtaatttctaaagtctactttacaaaataaaacctggatagtttttatttccatcacgacttcttaaaaactgtagatagtagaactgtcactctttctgaaggcatgaagagggaacagggagagagggaactggaaatggagacagagaagttggtggagaaggtggccagacagcagccatggcctcactgaagaactacagccaggctgaatggtagttctctttaggttctttgagaaatccccacactgctttctgcagtggctgaactaatttacattcccaccaacagtgtataaatgttccctttttctacaatctcacaaacatcttttattttttgactttttaataatagcctttctgactggtgtgagatagaatctccttgtggttttgacttgcatttctctaatgatcagcgatggaacaatagacatgggggactactagagggggactaccagatggggaggatgagagggggaaaaagagttgaaaaaccacctattgggcactatgctcactacctgggtgatgtgatggttcatacaccaaacctcagcaacacacaatttacccaggcaacaaacctgcatgtactccgtaaacctaaaataaaatttgagaaaaaaaggaactgcagccaaatgatgcctgccttactgggcaaggacaccattggcactgccctagaggccagctgccaagatgcttatccacagatctcctaggcatcctgttttacccttccagtgtgaagatgtttctctttaggaatatgaaaaccaagaaggaattaattagttctcttaagtgtaatcatcatccttaatcaataaacccacctaattcttattcatcttttcccttaaatatcctgtaagtcaaaactgtgcttttgctggcagtgactgataggcttcttagtagtaacgtcatttttgagcacttatatacactacccctgagctgaatgctttacatctcatttaattctcccaacaaccctttggagccctttgtcttttattgtcatccctggttgtatagacaaagaaactgaagtgtgtagatgttaagcagctttcaggaagtcagacggtaagagctggagtcaggatccaccaccttgccacagtgtggcttcagtccttctggccaggttctcgcagccttctcctgccctccgatgctcatctcttgtacttgcctctttatcctgtgagcagctctgagctcaaatgggtccccaatggcagagagccacactgctcctctctgaagggcgtagggcctatttttaaatacctgcgctcctttcattgtcttgtcttacaaattctaacttggcagactctctctccccatcatctccagttcccttgaatcactgtccgtgtttcccttccggtcacaactgagctgagggcagcctttcctcccatgctttcccaacctctgagtctacaatgagcagctgggcaacatggaggccatctctggtgctctcctctgaatgcgattcgggtttcagcagatgtccaataaacaaagctcttgctaaaaatgcaaatgcctctcctaaggatcattgtcatttttaaaccacataaatactcagataattatctaagtggccaagtgtgtatgagccaggctcgcagggcagagaggcatcgccctggatcctaagcccccttacagctttccaaaccaaacactgacacacaggaaaatcagcaggaacttggcattctgtttctgataatttgcagcattagcctatgcaaagcccgagataaaaggtgcctgttttactttgaatagaaatcacacaagatatttccaatcaagcacaactcagtgttgtctttgcttttctaatcttcctcccctcctacctactctcaaacaggaacaacgaacgaacgcaatacaatctttaaaagataaatagtaatatttggaaaaccacaggaaaggagagggagcaaatgtgctgctggggctgtggcttctgtgcattgtgactgcggagcttccacatgacagggtgtgggatcctctctatttggtaaaaagagatgtaaaaaatttcaggacaaatattttttgtcctgggactagactctaaaaaacgtattaaatatgatcttgcatggggaccactgtgtgacatgctagaaagtaattaatacaaatgttctatgacaaatgcagaaaggactctcattgggccagcttgggttgatgctcatgaaaagccagggtgattcccctgaattgggggtttggatgaggtccattttgagggatagtttcatgcaaaagcctattttgtgggactgatcaaagagaggctcctcttgtgaaagcaaagggtagatgcctatattctgctcccaacctcctcctgagagcttcccctctgcccagagacagcatgattgaaaacagtggcattaaggaaaacttcaccaatgtgtgtctgcacaatgccagccctatatgaaaaaaggtctttttggtaagttagtgatgaaaatacttaatatcctttcttaaagactcaaaatgcacactagcatactagagtatcatagccattggtgatgattaattttgtgtgtcaacttggttaggctgcagtactcagatatttgttcaaacattattctaaatgtccctatgcgggtattttttagatgacattaacagttaaatcagtagactttgagtaaagaagattactcgtcataatgtgagtcagccttatccaatcagttgaaggcaaaaaaagtaagaaagtcccccaaggaagagtaagttccatctccaggtagtccgcagatgtgagctgcaatgtcagctccttcctaggtcccaaatccgctggcccaccctgcagattttgggcttgccagcccccacatttgcatgagccaattccttaaaataaatctctctcaatgtatgtatgctatgtgtcacttaatgactaggattcattctgagaaatgcatcattaggtgatatcatcattatgtgaacattatagtgtatacttacacaaacctagctggtacagcctgttacacacctaggctatatggtatggcctgttgctcctaggctacaaacctgtacagcaggttactctactgaatactgtgggcaattgtaacatcgtggtaagtatttctatatcaaaacatagaaaacacaagaacgtattttactatacctgttctaaacatagaaaaggtactgaaaaatatggtataaaagataaataaaatggtatgcctgtatggggcacttggcatgaataaagctacaggactgaagttgctctgggtgagtcagtgagtgagtggcaagcggatgtgcaggcctaggacatgcctgtacaccactgtagactcaataaacattgtgtgtttctacatttataaaaaaaaatttctttcttcaatcatagattaaccttagcttactgtaactttttttactttataaactttatttatttatttatttttttaagacagagtcttgctctgttgcccaggctggagtgcagtggcacaatctcggctcactgtgagctccacctccttggttcaagcaattcccctgcctcagtctcccaagcagctgggattacaggtgtacgccaccatacccaactaattttttttgtattttaagtagagacagggtttcaccatgttgaccagactggtctcaaactcctgacctcaggcaatccgcctgccttagcctcccaaagtactgggattataggtgtgagcaactgcaccctgccgaacctttaaaattttaaaaaacttttggactcttcagtgataacatttatattaaaacacaaatacattgcacagctgtacaattgttttcctttgtgtccttattctataagcttttttctattttaagtttttttacttttaacttttaaaatcgtatttttaaaaattaagacacaaacacacagtctagtctaggcctacatgaggtcaggatcatgaataccactgtcttccacttccacagcttgtcccactgggcggtcttcaggggcaataacatgcgtagagctgtcgtctcctgtgataacaatgccttcttctggatacctcctgagggacttgcctgtggctgttttacagttaaattttttttaataactagaaagagtatactctaaaataatgataatatagtatagttagtacataaaccagtaatatagtcatttattatccttgtcactattatgtactgtacataattgtgtgtgtgatacttttgctatgaatgggagtgcagcagttttgtttacaccggcactgccacaaacacttgaataatacgccaggctacaacactacaatggctgatgtcactagaagataggaattttttcatctccattataatcatatttttcatctccattataatcttatgggactaccaccgtatatgtggtttgtcatcatgtaccagatagcgatattttggtcaacaatggaccccatataggatggtggtcccatgagattatactactgtatttttactgtacctttttactgtaccttttctatgtttagatatgttcagccacacaaatacttaccactgtgtgacaactgcctacaggattcagtacagtgacacgctgtacaggtttgtagtctaggagcaatagaccataccctatagccaaggtatgtaggaggctgtatcatctaggatgctgtaagtgcacactatgatgttcacacaattaaacaattacccaatggtgcatttcccaaatgtatccttgtcattatgagacacatgactgcacacacacacacacacacacacacacacacattctcttggttctgtttctctggaggaccctgactactacaccattatttatatcttactgtattttgggaacattttatggcatctgttgagttctccgtgctcttcttcagagagcatggttcctattcacataggttcatgcacttcggcctcagttggcctgaatgtttcacagcaatcatacccatcaggagcaaaaacatggagcaggaagtatggtttttgttttattttgctttgtaatttggcatatcacaaatgtccttaactgaaaagcatacccaaatgaagaggtgtgtcaaagcctttaattgcgatgcatgatagtaataaactagagactaatataagttgtcctcagtgcctccttctgagtgtacttgctttaaaaaaatatataacaagcttggtaatcctgttttcaatctaaaaatgaaggagcaaaaaatatcagcttcacactgatgacggtgaaaagtggaagctgataaactgaaagccaagggtaagacttaatatcagacaaacgagacacagatgctaactacgggggtggcatcggagggtgggggcttggtgggcattcagagtgagcctcgtggagagcagagggacagagtttcagaagggtgatccaaagacctcaagcgagggcaaattttataagaagtcagagaatgatgtgcgcacttcagaaacatttccatcaaaatgttgagaatcgaaccccagtttgggctccccgcatctgcaggtcagtcccgggagttgggaaatccactcttgggcgactccctgccgatgaagctccggtctgaggtggtgaagcacatgacgtcataggtatactcacctctaatctctgtgctttgaaacaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaaggtatggagagcatgctggctgggggcagtcctctgcaggactctgctgtggtggctgcagataagtacagtagtcctaggggtgcggcagtgggagatcagcacctggccactctgcagtggtctccaccagcctctggtgtcacctgtttgctgaatccaaggtggggctcaagaagactttgttgtaataaagggatgttcaggagacccttcagggggtccttggaaataagtgtcagggcattgggacagagttggtggtgatctccatgctcattgtggaaggacccactgcaaaaacacagcaccgcttcctaatgccaggtgttctctcctctgtaagggccacctccctggagcatgtttgaggaggctgggattgtgcatggtccactcctgagcggcccgagttaggtgctgctccctgcacggtggccctatctgtcagcgggaagcatccagctctgccagggcctgccctggagagaatgtggaggggtgggcagcacaggaagcccaatcccctgtgtgtgccggctctgacaagcatgatcctctgacaagcagcagtgtgagggcagggagggactggaggaagctaaagatgatgaagtctgcaggagagagtggagagtgggaagtgaggaggagctggggcaagcccaggcccagcactttccggacgggcccagaacccatgtaggggcaacctagctccaaaccacagctcactgctctcaagctgccccttccagaagcttctcctccttctggcctctactgtttgaatctttacttaagtttccagaagcttcccctccttctggcctctactgtttgaatctttacttaagtttccagaagcttcccctcttacccttaggcactgatcttgctccaagtaccattgttttccctttagggaagtatttcacaacctctgggttcattagagaggctgcagggtttgtactatggtaaggtggctgtaggcaccctgagtttgggtgaacagttttatagtcagcaaagggtagatttgccatttcagccacgcatgatttccttagtttctattacttcaagagtccagggagtaaatgttggaatgaacacacacacacccacacacacacactccaagaacaaatatttgttttcagaatgattacattttaaacccataaggaggagaataaacatttcttgcatccccataatttgcaaacccacctctatcttggtggaattcgtatttttcgctaacatgcttatggtttagctctgcatttgctcaccacagcctctcttccaactttacagtttgccttttgggaaacagagctcccattggcacgatgctactttagtggccactttgttatgtgcacaaaggtccccgatttgaagtaagtgcttgtagaggcccacataattactgtgacaagggccatcatctgtaccaagatttctttgaaggataagatagtgggttggattcagtctcccagacacaatgaaaatgacatcatcattaataacaacagctcttatttatcaggtaccttctatatgaagggctctatgaaagttgattaaatacaagatatggctcaggatgttagggcagcccgacctccatgtgagggccacgtgcaggtgcagctcattcccaagtccatgtactttctgattcactcagctgacaatgaatttctgaagccttcagcaaagcacagtttgctatattaattcggcacatcaatctggtctcttggagctgcgctggatccctgtcactccccaccataagtcaggggccagtcactgtgtgccacttttttttaaagggcagctgcaattagaaagatgagtagaagaagtgacaaaagctacacaccatttctcctgctagagttgtctctatagtatgaatggacagaattctgtcattataagcagagtgcctctgtgaaggatggagctgtgatcccggagccctgaaagtcatctgcagagctaacagctaaaacactaatgagcaaaaataagaagcagtgacaactgggttcctctgccccagcctggaaaacagaaaattcaatatccaaatgacagacagtggaaattagctgtgattttccctgctctgtgcgaagagctggcatttcctcatttatccattcatccaacaaatatttattgagcaactaatatttcctgttgctattttatgcccagtagctacatgaaagatcaagacagaagaaaagccttgcctccagtgtagaactgagaatatgaaaaaaaaaaatcatgtaaaatacagagcatttcagttggtgatagcataagtaagcttcagagggcactgacatttttaaagaatccaggttaaattcacatccctgaacctttctaactgttagacttcaggaagacttttaatctcctcaagccccagttttctcatccacaaaacgaacagtataatgcacatccccaaggtattaggaggattgagatgatgtgtgaatgctatgaatactgtaaagcagtagataaatgtaaattgcttcacatataaggactgctcatattttgagcctcttctcaaatttccaccttggtcacctcaaagatacaaagaaatatttggcaaatgatttgaattttaatgatagatcacatttgtttctggtttacattttaacaatgctagtgcaattcagtgtgctccaaaacacatgagctatatatactctaatgaagataactttcatatagtaccgcaaaggcgtctctgaagttcaagagagaataaaatcagataaacaagttttcacagctcaaaagatgcttctgagtgtaaaaatacagtgttggttatttcatgttgttttgtttttgttttgtcctttagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtgtgtgtttcatctttgtccctagggaaatattcaaatttgccccttctttgtatttgcccctttttgcctttatcttcccacatctaaaatttgcattagacagcaaaatacaggaatgaaagtaccttttcatatctctggaagcaacagcataacatagaataaggcctggcatctctctaaaaactgcatgaaactgatattgttgatctacattccaccagtgtggagattgggatagtacatgcattatctataaagtaagaaattactaactcagttattgcacagatgagatttcaagggcctgtttaacttaattcagagagcaaattgctttcaaaaaccttaaaacatatatttacttataaataattggcttacaagttacagatcatttactgcaaatgcaaacacaaacttgatttagtttagtgacttgatgttaggttttgtttgaactctttttgcctgggatggaactgactgggcacgaatgaggaggagtgtggaaattttagggttggacgtgtaggatgaggagcaagataacaatgttctcagaactgccttggagacagaatgtaagtccatcatgtgatagataatttgtatagctataaaatatctggatatcttggtagcatagacatacattaagactagtaattagtctgaattagtgatattttatggattaataatttattactggacaaatagtgtaaggacttatgtgtgtgtgtgtatgtgtgtgtgtgtgtgtgtgtgtaggtatgacatttccctcttctaccaggtatgttggccagaaaagttaccgtagtgtttcaaatggtatcccaaggacagaaaactctaaagcagacattccattcttttgacttgttgaatatcttgtacattcagtggaggaaggaactagactttcagaagtgtgtgaaggaattgttttaagtcactatgtaattgcaatttagttttcttattttctcaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaagtaagacagtagtaatatatatatatgtgtttagattcgtttgtatcttgataattggccttaaattatagtaagtattctgtctgtgtataaggttgctatatactggcatagaatcttctgcttccacctccccaaatgctggcatggcagctgactttgaacggttctagtgcctttgagcacagacaaatcctctcacctgagtcactaaggaactgtgtcaccaaggaaatgtctaaaacacctgaaaccccagccccattggtttcccaggctaaccagtattggtgagggtccaggcataaagaccatgagcactgctttggtccatgcaaatggctatattataataacgaagagaacttgtctgtggccacctccaaatttgctctctatgaagctcaggtacaagtgaatatgcatgataggtacaaacgaatatgtcacgatgggtacaaatgaatatgccacgataggtacaaatgaatatgtcacgataggtacaaatgaatatgtcatgataggtacaaatgaatgcaaattaatacataattttttggccccaatttaagtgaagatgtttttattagaaaggcagaataaacatgctggtgaggttttggagtttagacggttcagctccatcagttgtgcatttttggacacattgttttatgtgtctgcatcatgttggtttcatttataacgtagaaacagtagcacctggctcataagcttattgtgagatgcaatggatatgaggagtgttggtgccttagcataagggtataaatgtatcctagtgtattcgttttctatgctgcatgacaatcattgcacacttaatggcataagaaaacacacatttgtcatctcataatttctgtaggtcacatgtcgggatttctgagttaacatttttagttttgtacatatcgtgactatacttttttctgcaataaaattgctcctgttcatattaagcttgcaatgtaaagagtaggtcattaaatttcagtaagaacaacttctataattaatggcttaaaaatgtattatgtagtcatattcttttttttttttttgagacggagtcttgccctatcgcccaggctggagtgcagtggcttgatctcggctcaccacaagctccgcctcccaggttcacgccattctcctgcctcagcctcccgagtagctgggactacaggtgcctgccaccacgccggctatttttttgtatttttagtagagacggggtttcaccgtgttatccaggatggtctcgatctcctgacctcgtgatctgcctgcctcggcctcccaaagtgctgggattacaggcgtgagccactgtgcctggcctatgtagtcatattcttcatttatactttggggaaagtatttctatcaactttattgtcaaataatttttttcctttcaaatgggaagtttgggaagatgaaagtaacatttaaaacaaccacaacaatcataccttgagtatttataaatcatagtatcaaatctaagataatattttcattttattcttataaagctaaaataatattttcattttaaatgttctcttgatgagtaaagaaatagttatactgaagtattcctcactagcttaaaaccttataagatttagttcctactcattatggtgatgaaatctctaccctcatcaggtgaccattgatttagacaatttagttaagtaaatctttaattgaaatcaactagcatcacaagactcatgagagccaccaagagggattaagtacttgcgtgaaaataaggcaatttaatatgtcaaaattcgtaagtttgatggttctgcacgggctcattaaagacagttcagtagtaacttgtaaagctaacttcataaaaaaagctcagttccggtctcaatattgtgactgttgaaatgagaattttcttgatgaaaaaccagatttattttttgaattgtcattttcattttcaagtgtccatgtcattatttaatactctttttgattacttagtttgaaaatgtaagtcattctttcctgcctttgaagtcacttaagtgaacatagcatgaagtttcttatgagttgagagctgctgaaaactataacagggaaaaaaaatcttattttacttcctgtcttggtttatttggtgttgctataaaggaatatcagacactgggtaatttgtaaagaaagaggtttgtttggctcacagttctgcagactatacaagaagcatggcaccagcatctgcttctggtgaggcctcaggctgtttccactcatggcagaaattgaaggggagatgccatgtgcagagatcacaggacaagagaggaagcaagaggggggaggagggagatgccaggctgttttatttacttatttttaaacaagcagctctcttgggaactaatagagtgagaactacactcattactgtgacaatggcaccgaaacattcatgagggatctgcccccaagatctaaagacttcttgttaggctccacctccaacactggggatcaaatttcaacttgaggtttgggaggacagatattcaaactatagcactcccaaagttcagagtggtgtcagaaaaaaatatggctgtcattgaaaatgaggcatcctggatatgtgaatgaatttccctattaacctaggcatcgtgtatcattagcaactttttttttctttctaattgcaacagcaccgttttgcttgaagctttatcaggaaattctacaattgccaaatggtgctttggtgtggaccttcctaaaacccatattgcatggaaaaatactatacacaccaaacactccagaaattaacaaggtcattcaaaaggtaagttaaaataaatgagaatcatatagaccatacatacactaaatcaggaaggaatctttaaaaatgtctgacataattattatgcgccttggattatgtagaaggctcttgttttgaatctacttcattttagcctgagtgtttttcctgtcattgttattgttaaatctggatttgctgactccttcccttagaggacactttgggggttggggttgttatttagaataattaatgcagtgaacttacagaactctaatatgaaaagtcaaggacagtgagacagagaggaggactgtttggagtaattccaggaaaacttcgagaacaaatgctaatctgttttgcttggtgcatccaacaattacgaaagaatcagacatgatacatacaaactgatgtattagcagttagttagtattttggttagtgatgtttctgaattcactgtaaggctttgcttcaccctgtggagaataaggtgagatgaagacaccaaagcagggtgtatccaggaggaattgagacactatgtggctctgcttattttcctttccttacattgtttaacctctctaatctatttactgcaggatttgttattattaatatttgcactttctttttaaataattgtgttgtattttcctggagtcttttcttgcctactagggggcctgtaagcctacaggcacctggaaaggggacattttaccaaggacacaggaataatttggtcttattgtcaaacacagaagagaagatacctgcactattcatgataagcttccaagcctcaaatagcattaaaaatttggaaactgtgatcatatggcatgggatcatatgagcagttaagtcatttttgatcaaacttgccttcatgagtttcatgcttctgacccatggttgctgtgtgaggtcacagcactgtttcctgtaagttccctttcccactttgccacctacctcaggggctgcatttacctctgcctactctgaatggtatttaaactttaaaacatttatataatttatttaatttttgttttgttttgttttttggagagacagactctggctctgtcacccaggctggagtgcagtggtgcaatcatagctcactgcttggctgaagcagttctcctgcctcagtctcccgaagtgctgagattacaggtgtgtgcccccacgccctgctaactttttagtttttttttttttttgtagaggcatagtcttgtctacttcctaaaaaaaaatcttgaaagtgtcctttcagaggggtatttgccaaaagtctgcactctcacatggaacgacattgatctccgtatatcctcagtgtgagctgttctgttgggcaggaactctggcctcacagctgccatcccaggactggagcctctgcgccattactcgaatttccttagtgtagtaagctttttagggttttggatatttaaggaatttcacagaaaatggctccatatcacagctctattttaaattcaaaatttaaaaataggccatgactttaaaaaaagatgatatgctatattattatgttaatattattaatatatgactatagcattgcatattatgatgtattctgcagtataacaattagtgtgatgatctctgcttttaaagagctcaccctattgtggggaagagaaggcaaatagctgaagaaataagttagatatactatgctataaagaccattcagtgcagcagaggcacaggctgtggggggcagctggtctccctggaaagaaagattgggcaaagcacttggaaggatgggttttctaagcccctgtgaggtggagacgggaggattgtgggcctggacagaggtgtggggaggtgccaagccccacatgtgtgttctgagaatgatgagaatttttgaaaaatcaccaaagatttcactggtttttgcttagcccctttttagatattgcaggcagtattgagagctgatgtcttttttacttatttaaaatggctagcaactttgcatgcaggtatcctggttttgcacttgtaaagctgattttatggcattgtacctgggatgaattatcctagcagtcagccatggctatttggttttatgaaaattgtttctagtcattagactcatggtctaaagtcccacagagctgggagacgcttgtaggtttgcctcttgggctatgcgaagcaatattatctacagtgttggagtggcccatgctataaattatttaagacgtggtctttttctctccattacttcttgttaggtggaaccatctgaagttgccatttttgcaggaaaaaaaatctataaaagttggtaatttcatttggtttaacttgtaatagcacaggtgacacccagaagcatgatgctgtggtaagaaacgtgtgtatgtgtgttggaaggctggattttggtcccccttttcctaactctctgtgaccttgggcttattgcattctctttgaaggactcttctcctctatctgtgaaatgaaagacttgagtagatccgtgattttcagtcatctgggagacggctcttcatgggggatgcatcagaattacccacggacccttagtaaggccttccgcctctgggctctgatatccccatccctgaacacttgtacccctcacacccatccatatccttccacagagctgtgtgcacctccatctatcagccttaaagacagtggaggtcaagcattttcatgaactggaaaaaaaatgatggccaaaacttctagagagtgttaaaaggtaaacttagggacattaaaatttcaacaagtttatttgagcattcggttattcatgaattaggcaatgccagacaattcaaccctccactgactatgttgggatgtgggatgtggggtaatagaagaagcttgtatgaagtgtttgctgcagcaacagggagaaaatatattcgttaaagtcaaaagtccctagttggaggttagttggaggtttctgattggttaattttaacttttgttttactgtttgcattgatttgggttttggtttgcctacataggaactcaaggtgctatagctgtcttagcctaacagcctcctgatcaactattttaacaggagttaatttaactcatactctaagggtgtcagactcagtatttgcaaagaaattgatgctatttccatgtcattagtcaagagattccaatgtattagtatgctctttttattttataggtcagagtcgtgttcagttttggccctaggctgatgaaaaattgaagaacaatgtgtagacacaatgtgagcttgaagggaggctatgaaagaaaaacagaaaaaagaattatattgttttcccaagaataagtagcatgcctgaaatgatacttcagtgagaatcaccaggcacattctaggccactggtgcacaaagtaggtttagtctgggcttctaagggacgtataagcccatgaaaacagaccgtcttattttcatctagctctctccctttggctaaaggacagagctttgaactgtcacactcagtgtcctcctttgtgaaactgggctaaatcataactctcagtgccatttggaagtggaaaaaataccagaaataatattcagaaaatagtaaaccaatgggatctcctcccctacaagtgttattcccagaaatgcattctgccattgttgcctctggggagtggggaagacagatgtcacctcagaaagaggaaagagatggtggaggccagtggttcaaaccggggtggggttggagaaattttacccaactgggcacatgtgacagtatctgaagatatttttagtgtcacaagtaggaggcgctgctggcatctggaggctggaggccagggatgctgctatacatcctacaatgcacaggaaagcccccacccccaaacaaataatgatctggcttacaatgttagtggtgctgaggttgagaaaccccagcataaaggggtatataatgccagacgggagcgggtgggagcccctgggaagagaaggatgaaagtagaggaagctggtggtcaggtgggcatcctggcttctcctctactggtgatggtcccaaacaggggctgtgggatgatggaggagctgcaagctgagggccttggccctacccatgtgtcttgggggatagtccctgtgtaggccggccctgagctagcatgtggtcctagcagtgtggctgagcagaggaaggatacctgaattagtgtctctgagcatggagtagaagggagccagatttccctgacatccatgtcctgagccagtgtgtcaagtggaggccttggggacctgctatgagccggctgccgtgagagcgaggtggcctcagcaccaagctggcctaggccaggctggcagaggagatggctgaggctcagaaagcaggagccgaggtgagaaggaagcagcaagggagaaggcagtgccagaccccaaggttccaggtaagatgtgggctgggcaggccaggccctggcagcaccacagacaggcagacgaggcacatggctgtgggagtcctgggccctccacccctgactgtcaccaggctgcccctggagaacatcagggggtttgagcattcaccccaaagagcctgaatcactcagaggaagctgtttgaacagggagccactgtcagcaggcaattttgagactttgttctctcttcaccatccccagtgggtaaaaactggatcagctacaggaaatagagaactaccttttctttgcatccccaagcagtgaggtgtcagatatttggctttgtagcatcatctgtctgtatgcataacatcaatcaggaaacagagcaggtcccataaaatggcagccctacgttgggaacctggtgatcctctgtctggaagccgcctgcagaggagggactctgatagttatgtttgtttccaagtcttcccatgctgctcaagatggcaaagtttttcagtaaccttgtgtatcactccagacatggcagcagcccacacatacctggaatttaaatgccatacttccttgggatccagtgtgccagagacgcatgtcctcacctgaccactgtgttggagaggtccttcctcctttcaggctggcctcagcaggtggcagagatcagagagaggccaccagcggtgatccagacagccacgccatgtctctccctgttcccactctccctgtcctctcaatgcccagggcagccggtgctcctacctccagttccagctgtggggggctccagctgtctttctcttgcctttgttcctggagcttatcctccaaccttcttaagaagtatcttctctcctcaggcacccccaacaggcactgtgtgtttttgctttgtttttaaattaacatagagtaagttcggcaggctttttttcggtcgacagctctcacatttgtctggatcagtacacagaacagttccattgcccgagcccacaccaaatccctcattttgtcccttggtaatcacactgtcttcccaccctaaacccatctgttctctatcactataggtaggttttctttgtgagaatgccctataatggaatcatcatctgtaacctttgaaagtggtctcttttgctcagtacgagggctgtgattcacccaggtcattgtgtgtatcagcagttgcctcctctttattgccaagtggtattctgtggtgtggattcactgcagtttgttcgtccattcacccactaaagggcgtgtgggttttttctagtctttggcgattatcagtggagctcttaccttgcttttatcactacttgaaattatctcattgacttacaggcgtacttgtttattatttgtcgcctgctgtaatataagcttcatgaggggcaggagcttgtctgtcttcttggccaccgtccccagtgcctagaagaatgctaggaataccttcagcagtggctgttgaataagttaaagaataataattatttggctcttgtacccatttgagccaaagacattctggtgttaaatatacaagggagatagagtagactgtatgccaagccctctgcccgctgccagagccaggccttagctttgcagatatgcagtagctttgtctgagtttagcagtggtgggtgccatcaagaagattatctcccaaggtcattaatttcatttactgagcttgggccaggcaccttatgtggattatctcatgtatgcctcacaaccaccactgcaggtaggtactaatatccccattctatagctaggaaaaccaaggttgaaagaggataagttagcttgaccagggtcacacacctatcaagtggtggagctggaattcaggcccagtgtattattttgaagcctgtgatatggtttggctgtgcccccacccacatctcatcttgaattgccataatccccacgtgtcaagggcagggccaggtggagataactgaatcaccggggcagttttccccatactgttctcgtgagagtgaataagtctcatgagatctgaagattttataaatgggagttcccctgcacaagctctcttctctgctgccatgtaagacatgactttgatcctcatttatcttctgccaagattatgaggcctccctagccatatggaactgtgagtcaattaaacctctttcctttataaattacttcgtctcaggtatatctttattagcagcatgaaaacagactaatacagcctgtattagttttctcaggctgccataacacagtaccacagattgagtggcttaaacaacagaaatttattttctcaacattgtggaggctgaatgaccatgatcaaggtaatggcaggactggtttttcctggggcctctggcttgcagacagccatcttctctttgtgtcctcacatagttgtccctctgtgtgtgtgtcctaatatcctctttttataaggacatcagttatatggattagagtccaccccaatgacctcattttaacttaattgatgatttaaataggatctttaaagacctatttccaaacaaggccacattctgaaatatcgagggttaagacttcagcatatgaatttgggaagcacataattcagccagcccacaacagtgcctctttggaatgatcttttaccacttgtaaatggaaataattagagctctctatgaaacttgtgaaccctgtccttatggttttgcagctggttatggaatcacattgaaaaatagtagcccagggaggctagtttgctaattactacaggaacgtaggactgcatactaaaaacaaaaaataagtaggaagcacttggaaaccagttgcaggtcatctctcagcagccacctgtcctcgggacctatatgaattccccactgaaccttggatgctcacatgcatggcgtttgttccttgggaacgttccagagcagggtccaatctcactcatctgtgttaactacctagcacggtacaatgatgcacagtgtttgcttgtaaaaagcttgttaagctgcatttatgtatgaagatttttgttgcaaagccatttggaggaggagaagatgtgcttcgaattgctttcttaattaaaaattttccctaaaaattgagctaaacgttacttcccccttccctttggtcactagagacctcctctgtcagagaaccaacaatgtcttttttactctgacaatagtttgctctcaagttactgaagcagtaacttagacatgcctatccatgggaagcctgctaatttgtgcctgagcaaatttttgcagactaaggatggcttgcagctggtggtaggaaagctgatccataatggccaacttttagttttccctgtggtccaggtatgttctgtaaataggacttggtgctaggtatatgagccaaggactgagaaccaggaacctattggtggctatgaccaccctgtggctattgtgcagaaccctaccttacatgaggcatcaaagcattggcatccctgcctcaacctccctcatgcccttagattagcttgtgtggcttcgtacctttgccagcatcacatcccaagaggcttttttttctttttcaaaaaatatcagacggtgcttaaaactgtagcttttggtactttcagtgatcttgacatattgaagaaatctgattactttttctttttgttcttttcatggcatctgcatttttttgctgtttcctgagtgcagtgtccattttgttattagccaatgtatcagtcaaggttcaagcagaaaagagaaaactggttaagtttaatatgaataattattactataaaaaggcattagagtaatggtggattggttatcaacagtgaagagatctctaaagaatgcagcaatggcggatacagggaataactcttgcccctagagctggggcagagaacccaaggaagaaacagaactacaagtgacttccccatccaggcttgaaatccagaccctactgaagttagcacaaccatggcccttagtatggcagagaaaatcactgaggtgagtggtaattgccatgaatctgcactctagggtatctggagaagttctacacttttcaaatctgcaaggctataaaagggcatacctgaggaagtcatctaggtggacatgccacacctgcagaaatccctgggacaccactctttgggatgccatggatgttgcctatgagaaggtgccatgtgctgctggttatgcgcattgcaggagctgaggtttagagaagctagatgtgggggaatccaggagcttgctccatgggagccttttggaagcagcacactggaatctggaagagaaaatccctcttccttcactgtccctccagagccctcttctggcaaagcttaacagtgtatcaactggcaagggagaatgtctaaaaggcccaactttattattgcagaacaggcaatgaagggtgaatttcaagttgtgagaaggtaaattaataactagccggctgtaaattggtttctttgttttagactattgaagtacaaagagtttccataaagcacatgagttcttaaatgtaagttttaatttatcaaacatatattgagtagagggaagaattacttgctctaatcctgacaccgctaagagctaatgttggttgcaaacctcatttatgccttatacctacaataggggttggcaattgtcatacacgttttgcaggtaaagaaagtgagtcttaggggtaagtaaccttatcaaaagctgtcaacaggaggcagagatgggatttgaaacaaagtctgtttaactctaaggccaatgttttattttttctgttatattttactgtattctccaagtagaaattcacatgtgagtatatctatttctgcctcagaggaactgcttgtggtatgaaggagatgtggagtcccagtgacaagggcatggggaagactgcttcctatggaaggagctggccttaagctgccaaattggaatatcgggttatgatgggcagagatcagctctcagtctcatctatctggtatagtggattctgattggatctggagcaacagagcaggacagatagagagttttacatttgctcatagttccagaactctaacaccaataatttcactgttttaaatgcagattgaatcactctttattgagcacttacttctgtaaggttagaggaaccatcatgttcactgtattagtccgtcctcacactgctatgaagaaatatgggaaactgggtaatttataaaggaaagaggtttaattgactcacagtttcacatggctggggaggcctcaggaaacttacaatcatattggaaggtaccttttcacagggcagcaggagagaatgagaaatgaacaaagggagaagtcccttataaaaccatcagatttcgtaagaacttactcactatcacaagaatagcatggggaaactgcccccgttatttaattacctcccaccatgttcctctcatgacacgtggggattaggggaagtacaattcaagatgagatttgggtggggattatgggaagtacaattcaagatgagatttggttggggacacagcaaaaccatatcagacgctttcccaagtcctccctcatttacttctcacaagaaccccagggagtagacattgttaaatccattttatagattaaaaaagtagtaagaattgtgaatgtttatattcccaagtttattagatgataaacagaagctcatggcttgaatccaaatttggcagactctgcagccaatttattttcattggccatatttacagtattagttataaaataataaggatcctgtatactaaagcttctttcactatcatcagtttgggatactgggtacctaatttacctcattttaaaaaataactttgtgtagcaatgcatggcatttcacccatccccagaatcctgactgccttcacctttgggaggatgagaatgaagtaatacagtttaaagatatttatttgtttgtaagcagtagagatgggaaacagcttggccatcaacacagaatttggtgaatcagatatagactgatcttcaggagaatatcaggcaaagtgaagaataagcacaggctattgctagtgttgtcattaaacggacacaaagcctgataactaacttccatagaaataaaaattcttggttccatgataattattaaaggtgaaaaatgccagtgaagtggaagctgcccaagcctggagtctacataaacttgtacgggctggaagtgcacaggctctgcacatatgtggggctatttacatgtgcagagcaatggggaagggcactggtgggacctttaggcaggtcaaggtctttcccagggagccctacagagagaacaaaatccattgcaatccactttctgactgtaggcatcaaatcagttattggaaagcaagttgtccgtggtttggtgaggctctcagatgggtgaaagtggccaatatggaacattttatcaaaactcagcaaagttgcccagagtagaagtaattacattttacaagtggccttgtttgatataacctcctataaaatagcagttctctaagacagcagtatcagtagaactgtgaatgtactttttctgtgagactagataatatccaaaccctcagatgagcatagatgttgctcttttactgaccttggatacctgcaattttccatcattcgttttcctgtctgcttggaaatggtggtctatttgatataatcttaattaatttattagtgaaatagcacattagaacatgaggaaaaattataaacatatagttcaaaaaataataaaaaaacccaagatgtattttaaacaaatgaaaagatgctcaaacttaatagtaagagaaatgcaaatccccaaaatgagatatccacaaatgagatatcatatcaaaatgctaaaggctcacaatttgatatattttgttgtttggaggtattaggagagagtcactctcatgcattgctgttgggagtgtattcgtgtgaagtctttgaggccatgttgggaatatctatcaatactacaaagacagctattcgcacatgcaaacaaggatatttattgtgccattgtttgtaagcagtagagatgggaaacagagactggacatcaatacagaattaattgaatcagatacagactgatcttcaagagaatttcaggcaaagaaagaacgtggatagtatgagtgaagaaaaacagaataccaacataatgcatctgtttttgtaaacatatagataaactcagggggtccacattgaagaaccaataacgatgcttcttctgcatttgaaactgggcttctaggggacagagtagaacccttttgaaggcttggaatttggtacagtgcgaaaagtgtatacaagataaaatcccaggaagtcttttaagctagttatttcatgttctattgaatttgtgtgctatattgaggacatagggcattataattgagtgttagcatcctagggggctggctgtgtgccctctaaatgccctgtctagccatgtcctctgtatgggaaggtcagggcacaagtcccttttgtttcaggggcaacagaccagcctttctcttttcctcccatccgtccatccatccatccatccatttatctattcatccatccacacatccatccatctgtccatccatccatccatccatgcatccatccatctactcttgcatccatctatccatttatctatccataaaatcattcatttatctgtccatccaaccatccatccatccattcatccatccatccacacatctatctgtccattcatctatgcaatcatccacccgtctatccacccatccacccattcattcatccacacatctattcattcatccatctatccatgcatccatccatccacacatttgtctcttcattcatctatccatccatccacccacctatccacccattcattcatccacacatctattcatccatccatctagccttctatccatccatctatccatctatgcatccattcatctatccatccatccatttatctattcatccattgatctatttatccatccatccatccatccatccatccatccatccatccatccattcatccatccatctatccatccattcatccattaatttatctatccatccacacatccatccatccattcatctatttgtttatctctctgtctgtccatccatccgtccattaatctatcaatccattcatccatttatctattcatccattcacatatccatccattcatccatgtattcattcatccatccatccacacatctatctgtccattcatctatccattcatccatccatctacccatacacccattcagtcatccacacatccatccatccatccacccatccatccatccattcatccatccatccaaatctatctatccatccattcatttatctattcaaccatccacacacccatctattcatctattcattcatctgtttgtccatccatccgtccatccatccatccatccatccatccatccatccatatatccatctatccatttatccatttaaatccatccacacatccatccatccatccatccattcattcatgcatctattcatccatccatccatccatccattcatctatctgtccatccatccatccatctattcattcattcaaccatcgattcatctatctatccattcatccatcaatccattcatccatttatctattcatccattgacacatccatccatccatccatccatccatccatccatccatccatctatacattaatccatttattcatctatcctcccaaccattcattcatccatttatccaagatggggagaaagcaggctcttattagtatgaagtgcattgaggggaatcgggggatgctgtatccgtgggtttttcccttcctgattttggccaagtgaaaaagaaatatttttcttttatctactctgaatatgtctacttgtttccttttcaaatcttcaaattcctctgccccattcccctttgatgcaataagaaaaaggtctgaataaggagggaagagggtgatataactaagaaaataattgatataacaaaaaataatgaatacaacagaacaaataaacccagagctaatatcttgtgctatgacctagtcacattcttttaatattttcctctatcttaaaagaaagaatagctgcaagtaagagaggaataaatcattttctaaaattaaaagttagtaggtggtgtataaatgaaaccaaagcccaagacatttctcctaattaaataaaatggaaataagactttaatcacaggatatctgaaaatcctgacacacttttagttgggattatcagctctgagcctcattagttccctataatcttctgaaggtgattaattaaacaatatgattatgaattcatagatttaaacgtgttaaatgtatttcagtccattgctgtttttatttatttttcttgatgctcaaatgatcccaactgtggtcagtgggcacctcttcatttagaattccatgttcttttaaaaattaactttttaatttggaggcagttgtagatttacatgcatttgtaagaaaaaacatggaaagatcggtgtacccttcactgggtttcctaatggtaacatctcatgacactacctataatgcagtatcacaaacagtattctgccattgatacagttcacttgtcttccaatttcccattttactgtgtgtgtgcgtgtgtgtatttagttttatgcaggcttagcacctgtgtaggtttgtgtattcatcgccagcactgaagcagaacaaccatatcacagcagggtctcttgctttacctttcataaccacagccattaattcctacaccactcccccgcaagtccctgacccctgccagccaccaatcaggtcttcatttctataattttgtcatttctagattgttgtatacatggaattatacagcatgtaaccatttgggattgactttttaaacttagcataattccctagagtagtatccatattgtgcagatatcaggagttcattcatttttattgctgaataacattccctggtatgcatggtccacagtttctttaaccatttacacattgtgggacatctgggttgtttccagcttttggctattgtgtcttctgtttctcttttcttgccttcctgtggattacttaaacattgttgagcatcctcaccctaagacatgattttaggatacccattctaaaaaataatttattgatactgtctttgagtgtatctttttgcatgatgttcttacaaagaacgtctggctctagatattacaatacagacatacacacgtggcttaccacagttcattggcattgagattttaccacttcaaaccaggtatggaaatccacttcgacttaggtccctttaccttctctgcttttaaatatcatcatcttgactatcagaaggtgttatgatttatgttttaatcatcaaatacatttcataaaactcatggaaaacagtatggtctgttgtattcacccacatttctgctctgttgtttttttcttccttccaaatgctccaagattccgtttcatattttcattttttaaagtttttcttcatctgagaatgtctttattttatcttcattcctaaaagatatttacattagattcagaattcacaatgacaattcttttcttacgtcgtgataaatgttaggctactttcttctggctcccagggtttcagatgagagatttgctaacctttgagtgggtgttccctagaggtaacatgttatggttctctggctgctttaaagcttttactgtgttcagattttagaagtttaattatggtgtggtttaatgtagatttctctcagtttatcatattgagtgtttgctaagcttcctgagtctgtaggtttttgtatttctacaattttaggaagtttttcagccattgtttcctctcatactctttcagttccactcagtttctcctctctttcagagactctaatgacaccagtatcaaaatttttattattgtcctataggtacttgaggctctgttcactttcctatcaatctcctttctccctgttgcacagattgggtaccacacattgatcagctgtcaggttcagtggttctctcctctgccatctccattcttctactgagaccatctagtgagttcttgtatttgcgttattgcattgtccatttctggagaatccatgtggttcttttttataatttctttttattcattgagattttctgctattttgtttgcttcaagacaatttgtaattgcttgttgaagcattttttaaatgatgggtgctttaaaacactagccaggttattccaatatctgatgtgtctcaatattggcatcaattgattgcttttcttaattctagttgtcttttctttggttatttttataatgggtggttttcaattgtatcatgggtattctaagcaatataataggagactttgagccctatgtaaaaatcttttatttttgtgggtagtcattctacttaggcttaacacacagatcttggcccactttgtgtgctgtggttccaataagagtttaattttggtttatctgatgcatctgggactccctgatgctgcagtatgaaaggacagatgagatttctccagtccagctgcctccatgttggggagatggagcctccagcagttggagaagaaggggacttcttaggagcccaggtctttgttgcatcaggagccatcctgctgtggggcagccagtgtttccaggccaggtcacttgatattgtggaatactccttgccctgtctcctgggtgcttgttgtggttcctctaccctcaggggaagaacaaccatttgcctggctattcattaccagtgtcatccgagctgatccccctgttggtgttgcaggggcagcttggtttgttggaaggactcctggtccctccagagaggcagcccagctaggctgccttctgttactagaatgttagaaatgtgaggtattttggctggggattttaatgtgtgtgtacgtgtgtgtgtgtattctctatttgcagtttttaaagattttacagatcttctacatgtgttgcattaataatgttattcaacctttgcatatctgtatgcatttttggttagtatagctggcgtttactgagtatttgctatgtgccaggcctggtgccaaggtattggaatactaatttgtcttaatacttacaagagtctctatccctatttttttttttttttgagatggagtcttgctctgttgcccaggttggagcacagtggtgcaatcttggctcactgcaagctccacctcccgggttcatgccattctcctgcctcagcctcccaagtagctgggattacaggtgcctgccaccgtgcccggctaattttttgtattttttagtagagatggggtttcattgtgttagccaggatggtctcaatctcctgacctcatgagccacccgccttggcctcccagagtgctgggattacaggcgtgagccagcacgcccggcctctatccctatttttattgaatactgaagctgagagttcaaggtttttctctgtttgctgtgctggctgcttttcagctcctgtgccattgtgagggtctcctagtgaccctagggagatgtggttagactctcaaaccctccttaagcattgtccctttggcatttagactattttcagtattaaatgtaataatattgcaatagacatcttcatggaaataactttatattttatttaaactatttccttaggatagagtccttttatcttgagagagtaaagcatgtgcatttgttatggatcagtgactgcatttttctgataccaaattattttataaaagtcttatgccagtgtactctgccagtagcaataaatgaaaaaatataccaattttattctatcctcaatagtgttgggtaccattaaacaagtaagtattagttgagaatgtatctttgaggaagaaatgtgggcaagcattgattaatttggtcagtatatactggggacatatgctgtacccagcagtgactctaacactggcgagacagcagtgaacaggcaggtagcccctggatggacagagtcaaggagagaggtttcagaggactcacctgtgatgtgagagcattggaacttttcatgttattgaggaaggcattagctggcctgcaggcagatctttgctctggtggccacatcatatacagtccttgttggaagatttatcttaatataacagctgaataagagacatatccaaatatgcttcattttgcaggctaattacaccttttatattgtggacaaactaaaaactttatcagaaacactgctggaaatgtccagccttttccagagaagtggaagtggccagatgttcaaccagctgcaggtgagtggttggtctttgccaccgagggatggggagctactgctagggcatgtccgagacatcagggctgccctgtagaagattctacagagtcacatcaggcatagtggttctagttgactcatataattgacataaaactagagatgtgtgaaaactttttgtgaattttcagtattttacccatgcaaaatggtatcgttgtgagaatgattaataatttaatagtaactttttctttaaattctttattaagcttaatgctttttagattgtttgcatatttttgaattgcaggtctattcaacaatcaatgatcatttctgcatattctgtattgataacttaatatttttaaaaggaacgacttacagtttagaatggcctgactccattagagtctgacaatcattaatataaaactttaattcaggtagatcacctaataattttttgggcatttgtgtagcttcaacttaccttaactctgataggatgagaaaatatgcctgcattttaattcatgtttagtttttttattaacttaccaggtaagtagttcagagtatggactcaggagctagaatcctttgagtttgattcccggctcaacccctgccaccagttgtgtgatcttgggctagtcactgaagttctctgtaccttgagtttcttccctgagaaatgaggaagcgatagtagttatgaggtataaatgggtcaggatacatggagcccttggaataggttttgacacagagaaaatgctactgtgtgagtctgagttttccaagaagcagatgccaagacaggattacatgtgcaataattttattttgggagatagctgctgaggaaaggaagaggaagctagacaggttggaagcaaggttgtcagtggtgatgcaagtctgaccctgaggaaaggagagagggagagggtcgggtggaagcatcctggtgggccctgcaatttaatggaaatcagataaggccgagagggagtcacagagctaaagtcagttatcaaggtaggggtcccatgtcagtggagtcctgtggctcctgggagtgggcctgatgtggtggtcattggtgagagacagcccatgggaggcgtggcctcagggcaaagtgccatggattcagagtgcagcagtgggccctgccatttccgtttcctgcagttggaggtctgcgatgttcattctcacagcgaccatggccatatgtattagctagtattgtaatcttctttaatttgtttgtgtatggattaatttgttaatacagacatcagcaaacctttgcagttaatgggacagatagtattttagactagataaggtctctgctgcaactatatataatctcatgcaatattataagcaccaagtcgagaatgtacaaatatctaggagaacataaaacagtgcctaactcggcctcaaaaatagggcagctccttgtgaagtctatggtgtacctgagtactacttactaagtagccatgtcagaaatcagtcacatgttcaaccagttgaagaacttatcttccaaaggataagacggcgtaagttgttcctctatttcttagctttgggatcatgctcaagggaactcgcagtaccttgggtttgtagtagtcgatgtgtatgttgcaggcctggttctgccactagatggagtggttagagtctctgaggaaagccctaactttgctctgcttccctgttccatcagtaaaagacaacagtaccctcctggggatgttgttgagattaaatgacatgatgcataataactaccctgcacattgactggcaaatagcgaatgcccagtgaaggaagataaataagattccaaaaaagaaaagcaaacaccaaactttcataataaaaccttgtcatccttagacaagattagttaaaactatcacatgtaataaggtgaatgtgagaaataaaagagctaattacaaagggcacatattacttgagaattcctatatggacctcttgtgctattaggttatgtgctggaccaaaatctggatagtgtacaaatattctccaagaaattggcaaattccaaaattaattcccagtcattgatcctgaggcagagcctggatacatcagtatctttccctctcagcttcttgttggttgttgtatgttgtaagtgtcaggcagtgcaatgcaagtacatggatatcaatggcaaaataaaggggcaagatgtcatgaagttgatgaaaaaatcttggagaactctccacagtaaacaatttgtctccaatcattgaaaaatgaggcaaagtcacaaccatcaataataacgagagaagaatggtacagatgaagcaatgaaagatgcttccgaagatgaatagccaaacattgagagagggtttgggaaattctgaaatcctccttcagagttttcataacaatgaccctctgtttacaactggcctctgggaaaggccatgcaaaggaaaggaatcttatagaaaggttcattatataggttcgtttgaaaattttgccaaaaacaaaccacttaattcattctttgtttttagtattaacacataattacaactacaacataaattttcataattgttgattttgtttttcaaggtaagcttctaataagatattatcctgttatttattgtggtgttttaaaacttcttttaagtggattcagtttatgtgccttgttcctttgtaatgaaactttgaataagtctaataagtattattcaataatacgaaataatgcaattatttttattaagctatattatttttctttaggaggccctgagaaacaaatttgtaagaaactttgtagaaaaccagttgcacattgatgtagacaaacttactgaaaaactccagacatacggtaagtgtgctgatgggcatggtagtgttcttctgcccatatggctctgccacttgggtgggtcctcccccttgggccatggcattgctaggtgacttccagcaagtcacttttcctctctcagtttctattttcttatctggatcctgaagggcttgaactaaatactccccaaagtttgtttcatacctgaagttttttcgattcactgattcaggacttaactagtaaagaacctagttaaaaaggaagttttctgattcaaacacaagaattgtgaattacaaaacaagtttataaaagaaattattattattattgagttaaaagtaacttgaaagccattgcatagatttgaaaatgggaagctcagataaaaacattacctatcagtaaacatttattgtacctctgcaattgatgtatctgtgaattcatttaggtgttttaacaaacatttgctggacacacgaggagagccagttccatgaaataatccatagaggggcataaaatattcctgttccaccatgcagtgcagagaagaagatgaccatgcttagaaactgcaacactgtggcaaaatcagcgatcagggccctgccagagaagctctcaggagcctaacccagttggtggggacctggagtcagagggaggatgggtgtcaggctgttccaggtccctggctccctcacactctgcttgtacatgggaaagggtttcggatctgccttacatatgaaagttagaggaaggcaagacattttattcggcataatatagtacttccctttaaaaaaatttctggtgaatgcaatacttaatattttacttcagaaaggttaatcatattttaaaatgtttcatattttaaatgcattacataattttttcaattaattaaaacacctttaaaagaagaagtagcactggaaagtttataataatagtgtccccatcttctgttgctggaaccaaggactgacatgggtctgagagatttcctgtgtggaacgcagatgtctcctgagtttgcgtctaccatggtgctagtgttaatgcagatgtcttagagtgtgaatcgtacctgagccacatttgttcaacatgttgctgcttagccaacagtacatttgaataggttttcccacatgtaaacttctattgtaaaattaagagaaagttccccagaaatttagaacttttcctacaagtgtgttgggacacagaatatgagattcacatggaattttgagatccatgaggtgtgatcctctcttctttctgcttccgcctgacgctagagattgaagaccatatcatccaggtgaatgttggttattttccatccgaccctgtacagccctctgggagcaggcacagagtggggtcaggcattcacgggtggggtggcggtgggggattgatcactgaccagatgcaaatctccttttgtaactatgctaacaaatgaactcaccttactgcatgcacccttttaaaatttatacctaggtcatactcacttttcttcatcctataaacagtacctggaaactgaggtgactatttgaagatatactgatgcaacttttgggaatatttgcccaatcatgctgtcatttttattcattatataactttcattttatttttattttttttagacaagagttttgctcttgtcatccaggctgtagtgcaatggtgcaatctcagctcactgcaacctgcgacttctgggttcaagcaattctcctgtcccaccctcctgagtggctggaactacaggtgcgcaccgccatgcccggctaatttttgtatttttagtagagatggggtttcaccaagttggccaggttggctcgaactcctgacctcaggtgatcctcctgcctcggcctcccaaagtgctgggattacaggcgtgagccactgcgcctggcctcattatataactttaaaaaataactttttgctttattacaaaaagtatatatgtctgttgtagaaacattagaaaatacaaataagccagaaaacaaatccacctataatcttatcaccacagatagctattttaaaagcctcggagttcttttttaggtgaatttatatgtactcatatgaagataagaatatgtattttcacaaaaatgattatactgttcacataattttgttacctgagtctcctgagtttgcatctaccatggtgctagtgttaatgcagatgtcttagagtgtgaatcgtacctgagccacgtttgttcaacacattgctgcttagccaacactacttttgaataagttttcctattcaaaaattaagattattataaaagtttttcatatctataaatattgactgttactaagaaaaagtcccttcatctagctctgccttccatttcactccatagtatgaatttaaaattacttaggaatttctttgggatcggtccttatatttctaactgatacacctacggcagtatttcttgatttatttgttacaggaattatcaattgatttcttgttctgaaagatgcagatttagttttgtactacatcatttccctgatcagttgctcccactatggtaatatgaccattttagtagttataaaacagtatgaggagataaatgttgttcagtgcagagtcaggctatgcattataatgacattcccttatttaccatgtttcccttttcctagagtttcatgctctcttgctactacatgaaacacctgttctccattgctcccagctctgtgtgccaacacatcacctttatgttgagtcattttgtctgtgcagacgccacccagaccccctaccatgctccacctgggcaggctagccgctcctgccagcacccagctgctttcctaggaattctctgctctgctctcctggggtggataccatgattcctgggctctaggtcctcatttttgttttgttgtcatgttttgtgggttcatattaatcagtgtagtcttgaaaaagagaatgagagaaaaaattcctgagtgattttactcagtaaagtaaaattacatctgaatgatatgtggaaatatcctctatttcattaccaataattttgcatctcttctttctctctcctttttgcttttaatcagtcttgtcagagggttatcaatttttattagtcttaaaaaaacccaccgtttatggccttatatttcatttgatttcattgatttctgctctctattggttttttccttttgccctgtgtgtgtgtatgtgtgtgtgtttggtaacttcttgagatgaatacttaaattattcatgtccaccttgtcttcttttcttttctgatatatatatatatctttctgatatatatatatatatctttctgatatatatatatatatctttctgatatatatatatatatctttctgatatatatatactcatatatatatactcatatatatatattcatatatatatactcatcactagacacttccctctggcattaccttaactgcatctcactaattttgatatcttgtattttcactctcattcagttaagcatattttaaacatgtggtgtaatttcctttttttttcacctttaggttatttgaaagactatagcttaatttctaaatatttggtattatttatttatctttgggttaatgacttccagctttacttcacagtggtaagataatgtacttcgctaatacgatttcatttgcttaacatttatggagactcactcaatccttgcacacagggtcagttttggttcctgcattgttgggtgccgtcttgagcatcctcactgtctccttgttccatcagctcttaagaggtgtgtgtttacatttctcgttatgactgtgggattgcctatttctccttgaggttctgtccacttaggctttatatactttaaggctgtattgtattttctgttgaggacttgtttgagacatttatattttcctttgtttgtatttaaattatcttccagcctctcccccttcttttacttctttatttctttccggaagtttttctgtgactgacttagttatggtttcttatgagaatcctcttttggctctgtagcatttcttgaatcagtggccaaatatcttatatttggggaaagtcttggctactatcttttgaagcattgcttctgatcacttctctctctgctttcctctgcaactcttctaaacaagatgaaaacttttcacagtgttcaatgcttcttatttccttttctatataatccaacctattttctctttatacttcagtttgtgatttcttttcttactagttttttaatcgacaaattctctcttcagctgggtctaatctgctattaaacataccaatgaagttcttcatttcagttgttgcattttccgcttaaaatttaaattttcttattttaaaatagtttttagctctctggtgaaagtctattttcatctaattttggacacaatactcacataagtctattttcatctaattttggacacaatactcacattttggaagtgcatgtttgtgagctttaatacttgtcttttgtgggtatttttttagtctatttttctcttgcttttttttttggttatttttcttgtcttgtctccaggaatattaaggattaaaaaaattgaaaccagacattataaatggaaaattgtagaaataaatttgagtctcctgatagtgctatattcctctagataatgttattttcctgcttgtggcagagagctagggcagggccacgttttcctaatccatttggggatggagtggattgatggaggtagacttcagccttagtagggaaatttccagtttcctgtactcctggatagattccctatttgggtggggtggggatctcacctataaagctgataccgattagggcccatgtagatccagagctcaaagtcccgtggaccactggagactcagcctctcagtttttggcaggatcaaataccaggcttcccaaggttctcttttctcttgcatctctgacctttgagcttttgctgccttggtagctctttaaagtctttatatagattttcttttttttttaatttcaatagggttttggggagcaggtggtggttggttatatggataagttctttagtggtgctttctgagattttagcgcagccatcacctgagcagtatacactgtacccaatgtgtagacttttttaaacttttaaactaaagtctttatatagattttttaaaggccattcatattttctggttgttcttggaaggaaacttcatctgccccacattgtcctccattactctaagtggggtttcctcaatatgacctttcaatctgaagacgacagctcttcaattaaggggagttttcttgtcatcatttctttgatatttttacctctctataaaaataatgctattttaactttagtttattttaaaattactattactgttttctatttgtttattttgagttctctctttcatgttgaagggttcacttaaatgtttggtgatattatgtgtgaagcattaaaaccagactgaaagtgatttggtgagtagaagttattgtgactcagttcatatcagtagttctcaactgaggatgattttgtcctctaagggatgtgtggttatgtctggagatatttttggttgtcacagctggtcacagctactgccacctaacaggtagaggctaggggtactgctaaacatcctacactgcatggaacagccctccacagcaaggaattatgtgcccaaagtgtctgtagggcctaggttgagaaactctcatttagagcaataagatggagtcacttcttgaaaacaaatttcaggaggagacacgttggaatgtcaaatcctctggtctgttttggctgatgcctgccatgtctggggtcctcaggtatatacactgaatggtgaacaatcgttaacttgtattattctctggggcttggccccacattagtgtagaattttatactatgttgttttatgtccacctatatgtgaacctcagtattgtttttgccctttcagacttaaagtagcctgtgtttctttaccacatagggtttcacatgggccctatgtgtttttcttggctcatttttcctatatattgtgagatgaagcaacccaataagagctgtgattctaggactcttaccagaggctttgcccattcgtgtcctgtcctctgtaatccatctttctctcatagcagtgccctcatcatttaggttggggagtgtactcaaggtctccaaagtgatggaacatgcagttaatactagaccacattttatttttattatatctagtccattgtgcaggaactattacccaacaaagatattgcttctttcctcccagaggagggagatctgcccagtgtcctaagacctaagagtttttgtgtggagctgcttttctaagttgtagttaatgccacataataacattttagtcaacattgatctgcatacatgatgatgttcctataaggtcataatgagctgaaaattcctactgcctagtgactttgtagctgtcagcacattgtagaacaacacattactcacttgtttgtggggatgttggtgtaaacaaacctactgcactgccagtcatataaaagtctagcacacacaattatgtacagcacgtaatacttgatcatcgtaataaactactgttattattggtgtatgtgtttaattcaattcagagtgtacttcatatatatatttatgagttaagtgtaaagcagcctcaagtaggtccctcaggaggtatccagaaaaatccattgctagcacaggagatgacagctctgcgtgtgttagtgccctgaagacctccttccagtgggacaagaggtggaggtggaaaaaagtgatattgatgataatgaccctgtgtaggcctaggctaatgtgtggttttgtgagttagtttttaacaaaaaatttaaaaagaaagaaaaaacctaaaaataaaaacaagctagctcatagaataaggatgtaaagaaaatatttttgtacagctgtacaatgtgttttgtattttaagctaagtatgattacaaaagggtcaaaaagtcaaaaaattaaaaagtttataaagtataaagttatagtaatctaaggttaatttatttttgaagaaaaatttaaaaaataaatttagtgtagcttaagtatacagtgtttataaagtgtataaagtttataaagtgtacggtaatgtcctaggccttcacattcactcactgctcactgcctcatcagagcaacttccagcctgcaagctttattggtgagtactcaatctaagtgtatcatttaataccatataaaatctttcatatcatatttttattataccttttctatgtttagatatgtttagataaacaaatccttaccatcgtgttacaattgcctacagcattcagtacaataacattctatgcaggtttgtagcctaggagcaataggctatgctatacagctaggtgtgcagtaggctgtaccatctaggattgtgtaagtccactctgtgatgttcacacacgatgaaattgcctaatgctgcctttttatgccgcatttctcagaatgcatcctcatgattaagtgatgcatggctgtaagatgtacctatgtctcccaattatatgcatgataagaaagcttaaagccttctccaaagcagttccagttctgctactggaagataatgaaagtcacactatagtgagaccaagtcactcttcactgtgtttaacatctgctgttttatgcagttaaattgtttaaccacgcttgctaggcaagcttatagtgcagcctattccaaataacaaatggtcagcaacacacagatacagtagaaaaatgtctccagtttgccctacaccgagaaatttaacaatctccacttctccattaaaaaaaaaagccccccacaatgcacaatatactttttggttttctattttctagttgttatgcttactttcatgcagaaaagttaattaaagatattcagttggagcctcgctctctccttatagctgttacatgataatagttagcacttactgtaaatcagtttatagtgtatatataaacttcaactacatttacttttcacagcaatttcatgggtaattttgcttttcttatgctacagatgaagaaagtgaaacttttatagattaaataactatctaatgtgaaacaagataaatagtgcaattgccatgggagcaaagccatgtcttgtcagctttgaagcaccagtgacctgcactcctggagcagtgacagcaggggtcaatgccacttctatgttcccaaaccaggttaccccagcccatgtatttagtgggtcttgctttttgatgcctcccatggctataattgcccataagaatatccaagtttagcctcatacccacactatttagaaatcagaagaaccctcaagggagttttcatcacagccattgcataccccataagtaccagtcattacagtagcatttcacagcactgctgtctccagaacctgatacctcaatacttctagcaggtactaggtggtgttccagggcccatggaaaatcatggaataaacatgatgaaatgtccaaaggaatcacttttgcagcaacattttggggaaaatgagacataattttatatactgaaacaaatgagtagactagtacaatataacattttcacacacaaaaatcagttatttcacggaattttcaccttctcaaggctcatccaggatcctgtcttcttctcgcacacccttgtatccaccctcctccctgggtggagtaatttgagaagtgcaatgcaacaaggcaccgtcagcacagtatgctggagtcaccagccaagggctggttcagagatttggtgccatcttaaagaaggaaatagatagagaaaacagacaagaaatgttaagaactgctggtgtcagcactggctccgcatcagccagtccaggccagctgtccagccccagccctctgtgttcccacagcagataaattgggatgctgagtgtttcattttggttaggtggaggtggggctggaaatctggaaagtcccctgccacacaggacattgctttgtgctgtgctacctgaactgttattggagtcttaaagcaagataaaggcagtggagtttgtctcctcctctactggaaacaattttatatagtgtattaataaccgttatactaggaaatagttattgagtgctctctatgtgccagacacagtgtcaagcatgttacacattattctacttcatctttggaaaaagaccattgagcagatgattatcatttcccttccataaagagggcgaggattattcagcctcagatgcccactgaggggtggtgagcaggcacccaactccatctgacccatagtccacaaggcccagtagacggtggagatcctgtgtccctatctccaggccaaatgggcaccatgccaagataaattctttaaaccaagccacatgacctcttgttgagtgaggtgggctggaccagactgctagccaccctctaatccttccacgtcagtgctgagggaaaggcctcactggtgggccttacagtggctcggaggctcagaacttttccaaggaactctgagatgctgtgtcccagttgggggactccggggactcatgacactctgaggcagaagactcgacgctgtggatccttctagctcctctttgattgtgtcatccaaacagccaaaggtccttttctgccttaaaccttagaaagtgttgactataaaactaaatgagaaatgaaaactgctgtgcaattacatgtttctgctattgacgccatttgagaactctggcttgagctattttcttctcactgatttttccaatgagcgtgttttattcttctatgaattcagtttgacggtcttaacttaaccaggcccttcaggctctaccaaattgggaattacaggaggatttctatgagatgtgtgtgtgagctctgatggcaatagttaattgatcttatttactaaatggctttatgccttttttatatcttttatttctctctggaaaacagtaccaagattttcattctttctgaaatatagatgataaatctcaggcttagagactggctctttcagagccctacaatatttggtggaatcaagaacccaattctttgaattctggatcatgtaattcttctactatgtgttaggcagggctgtctggaattcctgatgtttgaatatttttaacacacagtaagcagaagtttcatatggttccactcaatataaatgcagcctggtgtatttgtaagaaggtggacccaaaagctagatggcatgtgtttgaatcatggttttgaaacttactggttgcttatactctttgtgccttaattcctatactttaaaatgaacatgccactagcaattccctatagatataagggttcagtgagacaatacacaagtgcccagaattgtacctggcacaagactgacactcatacagtgacacttcactattattgtagatatttagcaaaagcttaattatcagaaatccagccttcccaaatccttacactcatgtcttggcctgagatcggcaaattactggaacataataacagcagttacaacataatgaataacagtcttttctttgagaaactgtgcaatgtaggttgaggggatgaagggcagaaggagcccgacacttcttgatgttgtttggcagcttacatgttctcatccatctgaagttggcagatggaaactaatctttccttaccagggaagaagttgaggccaggacatgtcaactgatttttctacagacctcaggatgatggagatgcatcttcatgtagtttcttattcagggctggcccccctttacagagccccaacacccctttcaaacatgggctgggtgccaagcaagcaaaacccagacttaatccagaaaccttggaagccaggaggatctgggagcagggaaaccagtagaggagggaagcaagcatgagaggcagaggcagctgtcagtgggtactgatgctgccatgtccggggacaaatgcccacaggatggcaggtaggctccaagcttcgatggagggtggaaatgagcacagggagcagctcacatcatttggaaagttgagtgttcaggaggtcagtgagatacaggagggccagcaggaagcagtgactgcacacagggccagggatagactgttgtctgtcaccatacatctttcctgctgctttccctctggaggtcatgttctgggcattcccacgctgccttgctctagatcatttggtttttccagctccttcctgaaaccagagtgaaaatactgagatatcctcagccttttgccctgaaaatgtttgatgtcagcattcatagccaaggtgttgcgactttactctgctgctctatttatgtttcgaatgcacagatccaggacaaagactacacaaggatttggtttcctcagtgtccatgctccttgataattgcttttgcaaaattaatttaataaaatgactttcccaaaatgactgcttcagggaaggcgtgttttttttagaattgcttgactccaggttggaactttttttttcccctgaactctctgtgagagggtctttcctatcacatgtagactttccttctgttgtttatcctgttgtctccaactgtgtttccttaggctgctgtattaccctttgtgctttaactgtttttttttcatgtacatgtatcagtgttacagagcatgtgtataaaagtgtagagtttacactcagcaagtaaatgccaaatttcacatatgaccaaaatttgactcttttgagcaattttttagtggaagaattcatattcattttcaaatccatttgcacaatctccactatatgagtggtaagcactggggggatacagaagttgatgtgtcctaatctgttcactttcctcaggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtaagtactcaatgaaaaaatatgttcgccaagatgccaactcctgtaagttgtcattttgggagtttctccctaaaggtgtcttatgatagctcagaaagaaaagaagtcctttccagataaaacataaaataaagcagaactgtttaccttggataaaacataaaatgaagcagaaatatttgccttggttaatgaaaagttgtaccttatgccatagtgactaataacgttttcaccatcctaggaccaatgctatttactgcatctgcttttacccttttataacatcatgttctagttaaatctcacaccataagttatattattcccgattaaagttatactctaatttcctgcatcacctttccttttatcagagtatcttgatatcctggttggggcggagagcaggcaatggccaactctgctccattatttaattgttcacccattcaagataaatatggtggtgctctcatattcttttggaatacacattgaattatttttaattgaggttttgtattagtttcttaaggttgctgtaacaaagtatcgcagactaaaacaagagaagtttattgtcttagagtgctggaagctagatattccggatggagacatccactggtttttcctgcgggctatgaggagagaatcttctctaggcccctctcattggcttgtaggtggccatcttctccctgggtttctgcacctcatcttccctctatgtatttctctgtgtttaagtttccctctttttataaagacaccttcatattgagttagggcgcaccctaatggccctcattttaacttgattactctttaaatgttatctccaaatatagtcacattctgaggtactgggggttaggacttctacatatgaatttagtaagggacacgatttagctgtgataggctttatgcatacaattcaaagaatccgtgtggcataaaatagaatccatgtatttaagttatgaatgataagtaaccccaaagagatggattctgcacattgagttaacatctgcaatcaagagaaaaaaaccctgcaaaaaacatctgacaaataatttctttgtgttgattataccacagtttgcttttatgaaaaatacaaagcagcactggacagggaattaagagatcttggtttaggcttaccaccaattgcctgtgtgactgaaagtcagctttgccactgcgggctggggctctgagtctgcaggagtggagggctgtgagtctcaggctcctgcaacttttcctgtctcacccagtgtaggcgtggtttgagccactccctacagtgtggtaatgcttcgtttttccttttctgccactaggtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctgtgagtagcctggggcaggagccaccgacagtgagaagggccttgcatttgtctagctgaggagagaaaactcagtttttctatggttatttcaaaaagcactgttaaaaaagttcaccccccactttttaatttcgtaaggttcattttttttatatgcttgtactcttcaggtagaagaaatataatggttgagataatacaatcaagtgaagttttaaatttgacatcaggcatcatctatagttttaaatacacttaaaataaatttgatgaataacattcacaagggctgtgcatgtccaacaaaagattccacttacctaaccttgggaaaactgagggaggttattttctctgcagtgcaaatccttagatataggctgtatactggacagggtggtgaaggattccatacaggccttgaccatggcttgggtacccatgaagtaatatgagaacatttaggagtttgattgtgtaatttggctgctgacatctataggaagaggggaagctcagtgaagggctggagcagctggacaagaggacttggaggggacatcatggaggcattaaaacagccatcagggaggccaggcaggggatgtttgcagagaggacgggagactatggtcggactggggctcagtgaacctgagggtgagcttggacaccttggcaggttcagacaatgaacagacttcaaagctcaccaaagcggggtgagccgtattgctgtgggctgtggggctcagcctggatttcttactttcctcatggtgcatactgttctcataagcattctgctcccacagctggcctggctctggataatgtaggtcattcatttgcaatccctgcatgctggctctgatgcagggcctcaggaaggtaccaccttcctaccctctctcaaaagcacactaggaagtaagtggctgaacatgaggctactgaagggaccggtttgcgtgttctcttagttatgagaacagggacaagtactcatccttcatcgaaacactgccagtaacaactcatggcacctcccacccctgactggggcagagccatggaccaccaagcagaagtcaggactgcctctccaggtgactgggcgacacacacgtgaggataggtgacttgatgtcttgacccctccttcctgtctagtgataggctgcatacataatagcacatccacacattttttatgaaaatgctggttgtacaggaaggactttcccacagtgggaggataaaaggctgaagaccacctgattgaactcatcttgggatagcctagtgtggtgcggtgaacaaaaggtcaggaagaaagagactaaggcgacattttcactcaggggctgccttgttaggcagactgttagtaagcctcttaacttctttctttgtaaaatgatagcttttctttcttttcaaagtgatgatatttttggctatgaacattttcaacctgtgattttctgctcctaaagcatgtttcttggaggtgatagcagcaggagcagaaccgaagaaaagtgctgttgttggctagttgtcatgcacagacacttcatacccagtgcaaacacctgagagctctgagaattagtgatctgtgttagatactgggagaagccgaagttttattatgctcattttctaaaggcaaacctgaaatctattgcattctgacaatctccttctagctccaaagtatgctatgatctccacccatgaaagagcggggttgtgcttacgtggatgggaacatgacaattccctctgctccggttcacaggaggagactgggggtttactttgtccactctgacataggatatttcccaagaaggcacgatgggaagaacagcatacactcctacaaatgtattgatggaaatccagaaatggcctgagtaatcagttttcaattcctactgatcatagtgtatggctaacagacattgcaagagagctagaaaggaggaattgagggacatggatggagacatattttttcaccccttgaagataaattctgatgtatgagaaacattccagcctaaaacgttggaatgagtggaatacccaggtatgattctgatctcatggaattacctctcttattctactactgggatacagcaatataactcctcagaagtattgctttatttctttgagaaagatgaagaagtattttaattctctgaaatatttaaatctttgagatttctcactgtgctatatccatcttttatctcttgtttcgaagtctccctttcttgagggcttagagtacctgcagtgattgaaacacagtctgagatctcgaaagaactcagtcacttgagtaaaaatcctaaagcacagtttgtactgtagacaatgtttgttaaaatttttttagcagtttcctcctgcttactgaatgagctacatattcattaatttatgaatttattcaatgacttttatgtactatttgtcagtctctagactgaataagtaaagaaaataagtaaatcagtaaagaaaataggtgaatcagtaaagaaaataggtaaaaatccctgctcttgtgagacttccagtccagggaagcagaggtgccacaaatacaattaagaagacaattgcattgaatgataggaagcaggaagtgccgtggagctgggaaataggatgagcagggtcagggacactaggaggggaagatggaattgttaatgtggatggggtagaccctatcaggaaggtagcattttaacaaagacttgacgggatgcagaagcacaaggggaagtgtgttctagggcagaggaaccccccatgcaaaggccctgtggtaggagtggcctagggtatgtgtgaagagtcaccagagcagagtgcacaagggcaagagggtgggagatgaagtcaaagagctgattgtagattgcatggttgcaggtgactggagtggtattaaaagactgctggagagtttcgagcaggagtgatgtcatcatctgacttatactgtaaaagtcttgctcacgctgttgggtggaaaagagcttgtaggggtatgtgtgggacagagaaatcatttagaaggctgttgtaataacccaggtgagagatgatggtggcttggtccagtgtggtagcagagaagctggtaaaaagtggtctgattcttggttgcattcaggaagtagaggcaacagaattgccaaaagatttgatgagggcgtgatagagagacatcgaggaagattcccctattttggtccaagtaactggattgctggaattatctctaactataatagaaaaactgtgggtagaggtttggaggataaggatagaaactcagctttggacatgtctagtaggcagatttgttcaggaggctgggacaatgtatggatctattaatttaggagtctccccgattttgatggcatttagaactctaagatattaccatgggaaggagtatagatagaaaaatagagagggccgagaccaaatgtggggcccctcccatgaagaggtaaatgagaagaggagattgagaaagtatcattgaggcaggaggaaaacctacagagtgtggaatcctggaggtcaagctgagcaaaagactccaggaagaggagtgatcaagtgtgtcatatgtggctcatgggtgaaataaggtaaagacagataatcgaccattggatttacaccatccaggacttcatagagagtagcttccatgatgtggtgagaatgacggccaaattagagtggacagaatggagacttggaggggtagaattggagagtgaactcagacagctctcaatgggaagaaatgggaggtgacttcttcttcttcttttggaagaagtcttttttttttttttaaatataagatgctacctggggaatagtccagtaagatgggaaaattggtagtgtataaacgggggggacagctgtgtcctgaattagtcaaggggaagagacctcaacaagtggagagacctactataggtgggaacatggcaattcacctgtggtaacaaaacctgtttaactctatttaactaaaaattttccacttttcttgcacacagatctctctctctcctccttttatttttcatgtagtatctaccagcagctcatggaactaatgtcctgaaaggcatgcattggaaaatgttgctggagactgtagagatggataggcagcagcagtttttgaaattgcatgttcctatcaaccccctgattcataggcagttatcatagaataattttatgattggaactgtagtgtgtacttcatgaatataaaggaattcaaatgttaatgtgttgcttcaaagaataagccaacttaataaacaggttttcagaaaacaaaaaccacaacaatatcctgggattgttttatatgcacaaagaatatttatttgaaaggtcacctgttatttcctctattgctttttggctgcttcaattcccaccaccctggggtgggttcaagagaaggagaaatggagcgtgctgggtcaggctgagtgatggctcccgtgaggcgttgcatctggactttgatgtgtcttgggcaaagtggagagtgaagggttgacagccactcatgcttgaaatgttgaattcctgcttaaaaaaaaatcagcttgatccacaacagaccagtgagaggacctctcattttatttattttgattgtttctcttccttgggctctacttcaggtaactttattaaacacctctctcttccatttagtcaatagtcattgttctcagcagaaattcccattcttgatgaccctcagcgctcagagctgctggaagccccctctgttgcccgcaggctctgtcctgtcccaccaacgcaggtaatttgttggtgataccaactgtagtgggaaggagaagaaaaaccctcattaaattttacaattcttcactttctcaagccccacacagctcttacaaacttatctccttgctgggcagaggaggatggtttctcattaaaacctcagcaaatcgtttctccaatttgtctatgttctttccctcaacagcagcaaagtaatctcttaaaattgtatcacatttaaaaaaatcatctcacttattctctaaaaaccttaaaagtacagtggaagaaattgagacgctgatagggtaagttatttcccccaagatctcacagcatcttaatacccctcactccccaaataaactattaattgccacttgctacttttaagcactttgtgcaggatgcttggtcacttggctgccatttcactccattgtatttgaaagtctggtatgttttcggccgggtgtggtggctcacacctgtaattccagcactttgggaggccgaggcgggcagatcacaaggtcaggaattcgagaccagcctggccaacatggtgaaacccggtttctactcaaaatacaaaaattagctgggcatggtggcacgcgtctgtaatcccagctactcgggaggctgaggcaggagaattgcttgaacccaggaggcaaaggttgtagtgagctgagattgcaccattgcactccagcctgggtgacaagagcaaactccgtctcaaagaaaagaaaagaaaaaaaagaaaggacaggacaggacaggacaggacaggacaggaaaggaaaggaaaaaggaaaggaaggggaggggaggggaggggaggggaggggaggggaggggaggggacaatgcctgcctggcatgttttcttatatcctagccagagctcagatttgagcagtagttcttaaccttggttggtgggagtttggaagtgtatggggtgttttgatggtaacagtggggaccagtgtatgtttagtgcctaagggccagtggtgacaattgttgtgtgataaatgacactgtagtgtgcaatgaagaatagtcctagccaaattccaaaacaccctcatttagatccactgtttgctctgcctctggtaaattatttcaagggccttcatcattcactcatatagttattcctctattcatctatgtagaaacattttgttttcatattcactgtatgacacacattctatgctgggatggatgcagagatcagcactatgcagttcttgaggtctagaaactcactgcttaatgcagtagttagtgtacattcataactaataaggggcgaaaagggagatacagatactgtaaaagtggcagcactgggttgctcacaattgatttcatgccttcctctacctagtaaaatataggagaatttcttggtagaatctgtatgacctgagagtctgaattaaggtctcaaagtctccttctttagacatattggatcttgacagtgcatctcaccttctaagtttatccgatctctttcgagcttcctggatccctttagagtctcagacttgacatgatgacagaactgggatgaaaaaactgcatttgggtgccagctttgacacttgctggttcgcaggaccttgggccagttttgcgccagctttgggtgtcggtctcctcagctcatacggggtattaactgctgtctgcccagtgcattggcttgtagtgcgcagtgaattatcctgcttgaggagaccttgagacttgtgaggggcaacgccaggcactgtgaatgggtgggatgctctgagtggcagcccactccattcttgggcagcttcaaatctgagaaagttcctccacctactgatgcagaaggtcaatctgcatgactctggcaatggctgagtcaggaacactagagtcttaaatgccccttacttcaccttccctgacctccactcacctccaattcacaaatcacgtcagacttcagctggctgtgttgtgcggaaggcagcggagacagagctagcaagtgacaggggcaacatgagtgtgcctctggttccatgaaaaggaaagggaggataaagggagagagagaaagtggaggccaaatgcactggtccttctcttcagcagttgcccccagctatgtcctgtctccccatggttgatgtggactggtcctgggcagtagtggtgatggaggccggtggagaggggcagaagcagggaagggcagaggccgggctgatgtgagaggtggtggctggaaatttgcctcctccctgcacttgcctcaaagtcctacatcctgagaaaacaaaacaaaaaacagacaacaacagcaacaaaaaccagctgatttctcagggtggttctttctatagtaagactttggtccaacacgcccatgacttttctgtcattgcactcactgatagtgctgacagaggcaagtaacagatcaaataccaggagcaaggcttactaaaatggaaaccaaaaagtccacctgcagaaaaagcaatggtgacaattagtgtttgtgaagatcagagtatccctttagaaaggcttaaagaagtaagagagtttaatttccttttttgtttttacttttattttattttattttttattatactttaggttccagggtacatgtgcacaacgtgcaggtttgttacatatgtatacatgtgccatgttggtgtgctgcacccattaactcgtcatttacattaggtatatctcctaatgctatccctcccccctcccccaccccatgacaggccccggtgtgtgatgtccccactctgtgtccaagtgttctcattgttcagttcccacctatgagtgaggacatggagtgtttggttttctgtccgtgtgatagtttgctcagaatgatggtttccagcttcatccatgtccctacaaaggacatgagagagtttaatttcctaatggtataatttatagatagttctttgatttgggttccagagaaggggaaacatacagagaatattctcgattcttagtttgattcatgctctcctgataagaggaaaatcctatttctgaggttactgagacatccctgacctttgtgtgtatgttttttatttttagttctataaacaagtgatattcaagagtgaagaaaatagagaaaataattcacacttaatatcctgttccaaatagacacttatttgtttatttatgttttcttttgggatgagtccctcattctttgtcgttgtgattcatgttttacaaactagaaatcgcaaagtcttgccaagagttagcctgaaagtttttgtgctacatactcatttgggaactatttacgcagtacttattatgtgtcatgcactgtaatcgcatgacatatgtagtagggaaagatgtagtcctgccttgaggaagcttggagagcagggattgttatgaccgtattaagatgagacaaccagcctggacagcatagcaagaccccatctctacagaaaataaacaaaattagctgggcgttgtggtgtgttctgtagtcccagctaattgggagggtgagaggggagaattgcttgagcccaggaggctgaggctacagtgagcccagatcatgccactgtactccagcctgggcaacagagtgagaccctgtttggaaaaaaaaaaaaaagacaagaaaactacgaatgacttaaatctgctctgctgtgaccccgctctagtggagactgcaagggacgagaatcacagcacctctttaaaacttggtactcagtgcagttgttgttggtgatacataatacataatgcttcaactttaaatatgaaccacttccaattattaagatcctagaagagagaaattaaagtcaaaaaatgaaacaattttcttctctccctttctccctactcatcctccttcattcctctctcggtgtggttactcctcttttaacatgctttttccttattttaaaaattcatgatgtgcaagttatttcattcttttcttatttgacttctgttttctcaaagaaccctatttggacttcatcaattctctcttttgtctcatctaactttttctgcttttatttttattacttccttacttttctgtatcttcaatatattcttttataatttgagactaaagtttaattcattatttttagtttttttcttaaatatttgtagttaaatatattatgtaggtaatatatttaacataaggtaatgactgttctttcaactcctaccttatatcccatagatctcatatgtagctaacaatttattgttttctagatgcatgcagtacaggtttctattttctctttgacccaagagctgtttaaataaagcttcttttaatttccaggtgaaaattctcaagaattttaaatatatgaaaaactatgtttacacagcttacttgtaataagaaacatacaaattaaatctgctttgtaatagtatgtttttacatatcagagggacaaaatacaaaaattgcattatatactaaattgccaagttctgttgctaaatcttaatttctgaattgcagtcaaaatatgattcttattatttctgttttggtatcaagtaatatataacccacttttgtgaatgatttgtagacacttgaaaagaatttctaattccctattttagggcagagaatttggtctgtgttatttttgttatgtaggatttttctatccttaatttatgtcgtcttgatctgtcttagactgggataggtaaattatactcccttattacttggttgtccttctctctttttcctgtggagtttggcttttggatatttgtgctttgttactgtgtgcattactatgaataattgtgtcttttaatgctttgtggacataactctaccttgtttgatattgaaatggtgaactctgctttttttcccttctcttcactcttcctcttcttcttttttttttttttttttttgccttttggtgtttctatttgcttgatatgactttgcccatcctttcatttaaattttttctgaagcattttgtttcaagtgtgtctcttgtatgcattatatagcttcttatatatgtggccttaattctttgatagtataaaatgcaattataaattatatatagtcttgcctctatcttgtgtttcttatgcttataatttttcttttaagctaatatttaataatgttttattattattgtagtggttaccttataattataacattatataagtaatataaacccttgtttttttatcacaagcaataaaaacttaaaatatgttctcttatttcatcatatattttctcttgtccatcatgcaattttagctggtattgttaatcttacttaatgttgccttttgtactgttaaagacacttatactaatattctacatttgccaatattttaaaaaatagtatttgagtttggcatgcaccaactttttcttcgtctctaactcattccccattatccttccatttgtttttcatatcatttctgcatttcagggaatagtagcatttccaatctgtcttgtaaccttaattcctgtttttgttttagtcttgcttttacaggaaaatgtactcattgcttaccatcagccctttcactgtaatttaccagtcatcatttggcgggatgaagtttgccatctagtaatttccttaagaagctctcataagataatataacctgaattcctacatacgtaaaactctttgtagcatttatatttgaaggacatcttggctgaatagaaaacccttggttcattccttccttaagtatcctgtaaaaattgtctttggtcttaaatgttattatggagaaatctggggccacattgttattttctcccttttatataacttggtaattttggcaagctgccagtagcttgaaaacgcaataaattttataagagtatgtttcattgttgaacattctaggacaattttctatgatgacaagacaagtcctttggatgtgtagattttaattttttttaatggagactcttgatgtattctagctttgcaaatttagaaatacttagtttttctttttcagggagtttaattgcctgcgtttcttttccctgtgtttctaatcaatagatttttacattttaaaaaactctattcctgtttcctttagttgcatttcttgcacctattttctacatcccttactgtattttgtgcagtatcaatttggcctgtgtttcttccaattttattctcctttgtctgatggctagtttttttcacatattttttctaagttcttccaattcccattttatatctttctgctactttaccatctcattaactcaattctaatgattgtgctgtgtggtgtttcttatagaggggcttgccttgtttaaattgtttaaatatatttaaattgttgacaaaaagtatgttcactattatcatctgttcaatgagaccaactttttcgcatgggtttttcacttgttaataattatgcaactctcaatctctttttatttcttgcccaaatgttgtgctaaatttttgttaccgtgattgttactcatctggaatgaattggatattcctgtccaggtatctgcaagagggtcctggtggtggtgaggaccaggtgccattaatgaccttacagctcaaaagcttacttttccattgccacaaagatagagtgcttcctgaaaacatatggatttctcacatagcctccgtcttctgtttccctggaaatagggtctaggagaaggcttctcacgctagtcaatgtaacttttttttgcttttttattgatacacagtagttgttcatattcatgagttacttgtgataattggatacatgtgtacaatgtgtgataatcaaatcagggtaattgagatagccatcacttcaacaatcatctctttgtgttaggaatattacaaagcctgtcttctagctattttgaaatatacaagttattgttaagtacagttcccttagtgtgctattgcacactagaacttatcccttccctccatttgtacacactaaacaacctctaattatcttcccctcccctttacccttcccagcatctgggtaactcactactctactttctacctcaatgagttcattttatttttagctcccacgtatgagttagaacatatatttgtctttctgtgtctggcttatttcacttaatataatgtcctccagttccatccgtgttgcttcaaataacaggattttttctttgtaattgctaaataatattccattttgtatatatgccacatttctttatcttttcatccattgatgaacacttaggttgattccatatcttagctattgtgaataagtctgcaataaacatgggagtgcacatatctcttcgatatactgattttctttattttagatatacactctgcattggaattgctgggtcatattgtagttatattttttagttatttgaggaaactccatactgttctccacagtgtctctactaatttacattcccacctaacagagtgtgggttttcccttttctccaaatccctgccagcgtctgttattttctctctttttgatagtagctatttcaattggggtaagatgatatctcactgtgggtttgatttgcatttttttgatgattcatgatgttcagcatatatttgtataactgttggccatttgtggtcgtttatttttgagaaatattgagtcagatcttttgcctatgttttaattggattatgtgggtttcttgctattgtatttgtttgagtttcttgtatattcaggctattagtcccttgtcagatggatactttgcaaatattttctcccattctgtaggttgtctttacactttgctgattgtttcctttgtttgcagaagctttttagcttgatgtaacatcatttgtctatttttgcttttgttgtctgtgcttttgaggtcttacacaaaaagtctttgtccagaatcagtgtcctgaagcagttctctgatattttcttcttgtagttttattgttttgagctttacatttaagtctttaatctatttagagttgatgtttgtatatggcaagagataaggctctagtttcattcttctgcatatggttattcagtttttccagcatcatttattgaagagatagtccttttcccaatgtatgaacttggagcctttgttgaaaatgtgttggctacaaatgtgtgggtttatatttgtgttctttattctgtttcattggtttatgtgtctgtttttaaccaaagaagtgaaagatatctacaaagaaaactatgaaatgttgatgtgatgtgagaagttaaagaggacataaaaaatgaaaagatatcctatgcttattgattaaaaaaattgttaaaatgtctacattacccaaaacaatctgcagatccaatacaatccttattaaaataccaatgacattcctcacagaaatagaaaaaaatcctaaaacttatatggaaccacaaaagacccagaataaccaaagctatcttgaggaaaaaaaatgaagctggaggcatcacactacttgtcttcaaaatataatacaaaaccatagtaatcaaagctttagtctccattttatttatttctgctctaatataaagtctttcatcaaagaaaagcccaggacctgatggcttcactgtgacccgtgttctgcttgctccaacctctggtccttgcccttttttttcctttgcctggagcagtcttcctttagatacctgtgtgactcatttccttacttcatccgctttctgcttgagtatttttttcccgctgtcagctcagctaatcaccctgtctgaaatagcattccttctcacttttggttaagctagttcttttttactcatagcatttatcactacctgatattatgcatctctgttttagtcctttctgtgctgctatcacagaatacccgagactgggtagtctgtgaagaagagaaatttatttggctcataattctggcaggaagtccaagatcaggcagcctttctggtcagcttctgctgagggtgtcatgccacttcaactcatggcggaaagtgtaaggggaagagggtgtgcgctccatacatgagaggcaaccctgcttcataacagccagctatctcaagtacctggaatctatcaatccagtatcctggaaactcaacttgtctcatgagaactgcattaatccattcatgagtgtggagaccccataacccaaacacctcttaaaggctgcatcacctctcaataccatcacatgggcaattaaatgtcaacatgagttttggcagagacagaacatagcaatctctgtgtttattggattattttatgtcccctcccaccttgccgacacactggaatgaaagatccttaatggcaggacctttttctgtttggctcattcatgtatcaccagcccagtaacacggcttgtaccttcagttggtctcaatgttgaataaataattattatgtggatttagagctcagagagtatgtggtgagaagacagagggtccagcttgaggtaggaatgcctacatttaaaggcaggtaaaggagaagttgccaagatgtgggtgcaaagctgggagttgttctggaagctaagagaaaagagaggaggagggaatgaccaatgccatccaacatgtctgagaactcaagaaggaaaatgactggataattctcattggattttgaggcatgactgtcattgatgccctagataagagtcatttcaagtgtatattagaaatggagcccagttagagtgggttgaaatatgagtgttaggaaaatagaaaggaagactttcatttgccaattttcacgtattttgtagatgataatctgtgatcaattaatatcaataattgaagatagataatggtcccaattaaatgggggaaatggcaggcatggattaatgacctgctttgctccaacctgctctgcctatggcaggtgtcagagagtattgtggttgggctatggctctctgagagatctcgaaccagttgtgtctccttcatgggttccttcatgaatttgcatacctacaaaatcagcacaccaatcatggccctcctacctaagtcacaggcatgtagaaatgaccaaaggagatatcactcctgaaagagctttctaacttggaagaaaaatgtaaaaaattagtagagtcattttgcttgtctccggatgctgactgaattatccccttacagattcctgaacaacgttggtttcttttttccactgataatgatgctgacgtggatggtgtctgtggccagcatggtcagaaagttggtgtatgagcaggagatacagatagaagaggtaaatatccttaaaccttgcctgggagacaaagatagggaggctggggactttggaaatggatcttgtcccataaccaacctgagcctctctgttttgcttccctctcctctgctggggttctggtgtacaaaatagctgagtccctgttccagaaagaagattttatgttgaagtctgaagcaatgccagatattttccactgacatgaaagaaagccaaagaatagccacatgagattgcaagaacaaagccagtgttcctcattcagcaacttttttaaaacccagaaaaacatagcagcagacttcccatcttaatttatgcttagaattttttatgtagagaccctgctattttttttgtaatactgttataaaacttgaaactatcataacttaaatttttttatttccataggttttttggggaacaggtggtgtttggttacatgaataagttcttcggtagcgatttctgagattttggtgcacccatcacccgagcagtgtaccctgtacccagtgtatagtcttttatcaatcaccatccccaaccctttactctgagtccccaaagtccaaagaatcattcttatacctttgtgtctcatagcttagctcccacacgtgagtgagaacatatgatgtttggttttgcattcctgagttacttcgcttagaataatagtctctaattccatccaggttgctctgaatgctattatttcattcctttttatggatgagtatatcccatggtgtgtgtgtgtgtatgtgtatatatatatatatatatatatatatacacatacacacacacatttatatatatacatttatatatatatatacacacatatacatatacacacacacacacacacacagacattttctttattcactcattgattgatgggcatctgggttggttccatatttttgtaattgcgaattgtgctgctataaacatatgtgtgcaactatctttttcatgtaatgacttcaggagtgggattgctggttcaaatggtagatctacttttagttctttaaggaatctccacactgttttccatagtggttgtactaatttacattcccaccaacagtgtaacagtgttcctttttcaccgcatccatgccaacatcgattattttttgatttttttgattatggccattcttgcaggagtagagtggtattacattgtggttttgatttgcacttccctgataattagtgacgatgagtatttttccatatgtttgttgaccatttgtctatcttcttttgagaattgtctgttcacgtccttcacccgctttttgatgaaattgtttttttcttgcagttctttgtagattctggatattagtcatttgctggatatatagattgtgaagattttctcctgctctgtgggttgtccatttactctgctgattatttcttttgctgtgcagaagccatttagtttaattaagtcccaatatatttatctttgttttcgttgcatttgcttttgggttcttggtcatgaagtatttgcctaagccaatgtatagaagggtttttctgatgttatttttctagactcgttatggtctcagggcttagatttaagtcttttatccaccttgagttgatttttgtataaggtgagagatgaggatccagtttcattcttcaacatgtgggttgccaattatcccaacatcatttgttgaatagggtgtcctttccccactttatgtttttgtttgctttgttgaagatcagttggctgtaaatatttggttttatttctgggttctttattctgttcgattggtctatgtgcctatttttataccagtaccatgctattttggtgactatgtccttatagtatagtttgaagtcggataatgtgatgcctccagatttgttctttttgcttagtcttgctttgactgtgtgggttattttttggttccatatgaattttaggattttttttttagttctgtgaagagtaatggtggtgttttgatgggaattgcattgaattgcagattgcttttggcagtatggtcattttcacaatattgattctacccatccgtgagcatggcatgtgtttcctttgtttgcgtcatctgtgatttcttttaacagtgttttgtagttttccttgtagaggtggttcacctccttgtttaggtatattcctaagtattttattttattttttgtagctattgtgaaaggggttgtgttcttgatttgactctcagcttggtcactgttggtgtatagcagagctactgatttgtgtacatgaattttgtatcctgaaactttgctgaatttatttatcagttctaggagctttttggatgagtctttagggttttctaggtatatgatattatcatcaacaaacagcaacagtttgatttcctctttactgatttggatgcccttcatttctttatcttgtttgattgctctgactaggacttccagtactacattgaatagtagtggtgaaagtgggcatccttatcttgttccagttctcagaggaaatgctttcaacttttccctgttcagtataatgttggctgtgggtttgccatatacggctcagaccatagtgaaataaaattggaaatcaactacaaaaagaacactcaaaaccatgcaaatacatggaaattaaataacatgctcctgaatggttgttgggtcaagaatgaaatcaaggtggaaactaactgaactgaatgataatagtgatacaacctatcaaaacctttgggatattgcaaaagcgatgctaagaagaaagttcacaacgttaaatatctacatcaaaaagtttgaaagagcacaaatagacaaccaagggtcacacgtcatggaactggagaaacaagaacaatagaaacccaaacctagcagaagaaaagaaataacaaagatgagagaataactaaatgaaattgaaacaaaaaagtacatttaagtctttactccatcttgagttaagttttatataaggtttaaggaaggagtccagtttcaattttctgcatatggctagccagttttcctggtaccatttattaaatagggaaccctttccccattgcttatttttgtcaggtttgtcgaagatcagatggttatagatgtgtggtcttatttctgagatctctattctgttccattggtttatgtgtctgtttttgctccagtaccatgctgttttggttactgtagctttgtagtatagtttgaagtcaggtagcatgatgcctccagttttgtttctttctcttaggattgtcttgactatacaggctcttttttttggttccatatgaattttaaagtagatttatctaattctgtgaagagtgccaatggtagtttaatgggaatagcattgaatctataaattacttagagcagtgtggccattttcatgatattgattcttcctatccatgaccatggaatgtttttctatttgtttgtgtcctctcttatttccttgagcagtggtttgtagttctccttgtagaggtccttcatccttcacttcccttgttagctgtattcttagacattttattctctttgtggcaattgtgaatgggagttcattcacgatttggctctctgcttgtttcctgttggtgtataggaatgcttgtgatttttgcacattgattttgtaacctgagacttggctgaagttgcttattagctttaggaacttttgggctgagacgatggggttttctagatataggatcatgtcatctgcaaaaagagacagtttgacttcctctttttctatttgaatacgctttatttctttctcttgtctatttggcctggccagaacttccaatacagtgttgaataggagtggtgagagagggcatccttgtcctgtgccagtttttaaggggaatgcttccagcttttgtccattcagtatgatattggcgacgggtttgtcatgaatggctcttttataaaaatttaatttaattttaagttccaggatacaagtgctcatgaaaatcaaataccaagcttgaggaggcaatgtccttcccagggcccttcacagggctgaatttgcaagcaagcagatttacctttccactggtccaccttctttctcctaccatctgatttgttcttcctcaagtacgcatgctgtggtaaccttgggttttttctctttttggtagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctggtaagtaagttgttttgtaaaaaaaaaaaaaaaaaacaacaaaattgcaatctatctaacaagacaaaatcccaccactctcactttttcaatttgtcatgttcatatctacatgggctttctgatatctgctttttaaaatcttacccacaaatgcaaaccgttgaaactgcagggtttttgctggacagcagcccattaagaatgtccagtttttacataacagagactttctgcagattctggaaaataagcaacattcttaaggaagcatataactttattttctctttcatgcacagaaaaaagctagatttctaaagcaattttagaagtaaaaaataagcattttttcttgaaacattatgaattacatcacattaagtggaaaaatctctctgttagcaatgtcagagtcactcatccatttaaaatgtacctcctaaaaacgtatgataacactttcaggtctgtaacatcaaatacgtagaacataaaaaagtattcattcttttatggcaattgctggcaagcgcagtgcctgacacatagtaggaactcaatcaaagcgagggtgaaccatcactattaaaatgatctgtttcagagagccagtggcatcactataaacacttgcactgtgctcaagactttattctctccagcaggtcaagtgacttcctaaaattgcagtctgttgagagataagacagagtcattaacagagactttggggaggtgtcaaggagacctagattacggggctgctcaggggtatttaaaggcccttaaaagtcctttagtccagcacaggattcatgacggccccagtgcttcactcacttattgggagcaaaacaccttctctgctcatttagggcctagagtaaaatatttctatgaaagccaagtgatttgtcttcaacttcagtaaacgattcaaagctgtctggtttctactagccatatgctcacaacaaagatatacatacagaatgaaaaagtggttatattccatcagtgttttatctattggtatgtgttcattggtcttgattagcttatgttacatttgtaaaaacccataaccaataacttcctgttagtgttaattagctgttttcagaataattaacacaagtgggaccattggtggtccttccccatatactccttgtacatagaaaaagagtcatccatgatctgacctgattttcagatggtgttatttttaattttacttcagtcattatattcgtgggttctgtgcacataaaatttgattttctgtttacatattcaaatgctttctagcaagtaaaaaatatctaactctggtacactgtattttttaatgtaagatatttttttcaatggggtttcgttctaacataagacttctccactgagatacaataacatttttcttcaatacaccttctttctagtgtagaatagtgtatgcattccatcagtcagcctgcagtgtgctccagggcattcacttaataataaaaaatagtaaattactctattccagttttcactgttttgtgttacacatttctgtgtatgatacattggatttatgacacttcaagcatctcggtaaagagaaataattccttttaacgttaaaaactagcttgttatcatgcttttcagagtgggctgacattccgctaagattttcagatcaaaatatttaaatgactgcctgaagcgatggttgggcgtcatcagaatgaaaagttgtcatggcttcgctccttgaattaagtgttgtggattttctgtggtcccaatcaaaacactaacgtgcagtttttctccatcaatctgtgggcagtgccttctttcgacaaccgcctttggacaaggggtattttttattacattcctggaaggacaagagacaggtaagagcatgcatgtgtaaaaagtgactctcagtgaatcacgtttttggaaattaatagttatattgcaagtgatccagtaggaagtcttcattatcaagtagagcattcagaatgaggtttggatatttgctttcactgttgtatacacctcccactatctggtagcaccagttttgagaacaatcaagaataatcatggcatcccttgcttcagacactatccaggtcaaccacccagccaatgcttgggtcttccttataccacccttgacgtctggtctggtgagtgaccttctgaaccttccaagatagggtgtgcaaatgtgtccatctgttagatcaggggtccccaacccctgggccatggagcagtccgtggcctgttgggaactgagccttacagcaggaggtgagcagcaggcaagggagagaagctttgtctgtatttacagccactctccattgctcacgttatcgcctgagctccacctcctgtcaggtcagtggggccattagattctcataggagcctgaacgttatgtgaactgtgcatgcaaaagatctaggctgcatgttccttatgagaatttaatgcctgatgatctgtcactgtctcgcatcacccccaggtgggactgtctagttgtaggaaaacaagctcagggctccccgtgattctacattatggtgagttgtataattattttattatatattacaatgtaataataataggaaaaaatgcacaataaatgtaatgcacttgaatcatcctggaaccatcctctatcccccggtctgtggaaaaattgtcttccacgaaactggtccctggtaccaaaaaggttagtgaccactgtgttagatgattgttgacctgggatctgtcttcctggatcctctacccatgttttctagttcttcctttctaattatccctttcacatgaccaccatctacatatttgttggctctcatctttactcctagatttactagattgttcctgaagatcaagatccagaaataggtctaataagcataaaatagagtgcaattatctcataccaatgcaggctaaaatgattttctaaaaatctattggcagcattttttgcttatattgagaatttgacaactaaaattctaaaccagaacagacatatatttcatagatatttgtatggttttttttgggggggggtgtttttgtaaacagaggtaaaaccatgctataagtaaaatttgactctagctattgttgtattagccagttaatttgtactggtctttgagttcttagagtttttcaataagatgtattaaaatgttcttttacagatgagtaatcttgaatgatttcttctaactgatctttagaataaattgaatcaaaatgatagaaacaaaaaatggaaactgttagaccatttgaatattttggtctaaattccaagtacacaatgattaaaatgtatattttattgaactgtagcctggtaccatagggaaatttagaaaggggaatatttttcttaagttgtatgttaatccagaaataaatcacaaacctattgtaaaaaaataataataatttcccaccctagttcttatatatcctattatatattttccaagagcacagagagttacacagtttagaatttgggttctcaaggagactttaaaaaatttttttgaatgcttattttccttaaatataaagtcctttctactcaggtaaataaaaccagatatgagtaaggtgacctttaaaactttttaaagtattagatattaaaaagtagttaacaatccccccacctgatatcattgaaataggtgtaagattgcacaagttaacatttcatgaaaagttatggccagtgatattgaccttctttttgttttagttctgttcaacttcacttgagcttccagaagtaatgaactcatcatgacaaaatctaccataaaagagcttgtgcagttctaactctgacctttttcttcctgctagggattcaatggaataatatgtaccaggctctggaacaagggggcatgacatttggctgggtttgctggatgattctttttgattcaagcctttattttttgtgtggatggtacttgagcaacttgattcctggtaagaattttgccttttgtaagataacacaataaattttaaaaacagtttgaattaatatgcataaatattagaataatcacttattctttaaggaagatccagaaagggaagtcttaggatatatatttaaaaggagctgtacatttttgagaaaaaatgtgatgcctttgtttcccaagtgaaaggtaaaaggccatgtgagggaatagccaggatgaaattagcatgaaaactcaccaggcccaccaagcagctccccaaaagtgggcttcagtctacacagaaaatatcctggtttctcagagagtgtttggggagggcaggcatgagggggtgagggtgggggtgctcagagtgccttggccagaaagtcactcctagtggggatctagggaccaagcgctcagccagtggcaggtcggtgcatggcaggacctggggagaagcaggcagagcctaaaggcagctggacagggtgggctgggagtgaggggccatgtccaaccacagggctttcactgttgtcacggatatggggtttcccaaatgtggtggtgcccttcttccctggtgtggcaggcatgccccagagtctggaggacaagtatatcaatggccaaaaaaaaaaaaaaaggccagtaatggtaatgggttttcctagctgttttgggaggaaaagaggcacgcatacctttacctttttggttcaggcccgaaagagcagaaatagcactttaaaattacttattttattttttagagataacactttgatggtggtgtattttcttgctgaaattacttggcaactctggttctatgcttttcaaagcaaatagtgtctaactaaattaaaactaaaaattaaaaaaaatgattctaatcttatacaaatgaaaatggagggatagaaagaaaacaaatgcagttcattctgtttgtgaaaacacattccagacttggagagctcatgaatcatttagggatgggtaaacataaaaataatatgggccactgaaaagatcattttacacaaaagtaggaatatatggccctcaagaggtagagagagaacataaattggaaatgtgatttatttaggaaaaacttagactgcattgtcttggtactttgaataaaatttaagaaaataaaacttaagaaataagattctaggaaataaaggataaaacaaatgagttgagaaggccaagggttcaaggaaattggatgagaagcaattgactattgagaagaagcaaaaataacataagaaagtaatgttacaaaatacatttgtgatgtccatctaaaatacaaagaccagcaacaaagtctactctctgcaatgttgagatgaagataaaatgtgtcccgggacccagaatgatctgatttctccctcaaccatcagcatctaaggctagaggctcttggggcaatatttttctacattatggtaaagcaaaggaacattgtattcagctgagactttccctctgaatcccactgtggaattctaaattgaaaagttttaaaagagactgagccttgaggtggatgtctggtgtgcagagggctcactgtctaggtcatatttgaagggaagaaaagggaattgggagtagactcatggaggaaggtaattgaactcagaaaagctgagtgatggtgagaatgtcctcaccagtgggacagtattgagtcgttccttatcctgtgggtcaggggatgtttggctaagctggtggcttttaagaagaaattctttctaaagttcaatgaggtcaacttgaggctcagaggaaattaaaaaaaattgttttcctcaggggaccaggagattcaaatgctagagttggtaatcttttggaagtaccttggccatctgaaccatgccacatttggaactcacgtatattcgactgaggaaaccgtgatctcctgttccttctttcatctcctcctgtccttccattccttcagactcctaattccctgccctcccattaggtgaaggttaaacaaacaatccaccatcttcatacactcacactgcaatcctgcagtctcacaatatggctcatgattaacatctacccaatatgttaaacttgagctatttcagaatcagctcttaccctgccacatccaactggagaaaaagatctgctgattttacttcacaagtctcccttaagttcacacggatgtaccttttctagggaatgtctccatgttttcatcaagccatacaaagtattctgtgacctctaatgagttatgattcccagatacactggatcctacaccctgcaaagggaagcaaatgcagtaggacctcaatccacctttgaatggcagacactcatttcaacattttgtttagtgaatttagagtgggaggttttatattttctctttgtgattgtgacactaattttagctaccagctagttaggaaaaaagatcagagtctattacagaatttaaaaaaaatcaaagctcgcacatatttataacacatatttaaaaatacaaaggcatagagctgaataaatatgtcaataaatatttttgactttatcacaaaattcagattcttttatttcaaaagctaaaaataagagttggcaatttgcatattcttaaattgcacaaagtatttcttttccactttgacaaagtctgccaataataacaaagaatataattgccagacactactgatgggctttcagatccataaagagggttataatttctaggaggtctcagacccaataccttctttttaagagaaatattttatattacctcctttactctcttgaaatgaaacttatggataatgaaaactacctgcatatgagtcttaaaattaatgtaatttaaaaattttaatataaaagagaaatagaaactaatttatagtaagttctcggtgctcaggcatgaatgcatcggaacacagaatgagatattcagttgcttatgcttatgtggaataagttcggatttaaaagaaggagaaaggtcagaagccatttggcactaaaaggaaagaaaatgcataagtaaagagaaatgtagatactagaagtaaagctaatattaagtagtactagatcagacttattggtatgtgattataaagatgaaaataacttcagttgaagtaggaaaaacgtgggaagaaatattatacatgaatgaagtgaataaaagaatgatatttttgtaaatgacctgggtctttatttaaaagtaatcaggaaattccctttgttaacacatggggcaggtaatgacaaaacataacagaagatccattttctgtcttacaattctatctcatttcagtttctccattcagcctccagtctttaaagacgttggagatctattctttagtagtgacaggaaatagaggactgattggacaaaggaataatattaataatataagagggttttatagagaagccaaggggtgaatatctgggaacagcatcaaaataagattgaaaactaatagggagcctcatgttaatcatctcaatgtgtaattttcaccaaatggtcttattgtgctatacagttttaaaatatatatatcaaatgacaatgtaacatagttactaacccttattaatacaatttagtgcattttctaaatttctactattcaagaatatctggttttaagtttgttaaaagcaatcttcacatcttttgtcatgtgtttgtatataatggggcagaatgaagattgatacagacatactgcattgcaaactcaaacgcagtgagtgacatcactattgatggcgttgttttccaaaacaatggacaatttctgctttaaaaaataatcttccactagtttacacagtggttgaatttctgaaaaatttagtgtatactgaaactgcacggaaactttgagtttatatgtcctaggctcaataaccatgaaacactttgcatttgcacggctgtgtgtgatcaggctcacagaaggcaagtcaaggacatttctttgttgcactttgtagggtatcaactaacccaggcatctgcacactaaaggcaattgtaccatccccattgtattaatcatacttttttattttctgtatttttgaggctttgactggggttgaaggagtgcagttactgaccctagagggactgttccttccagggatagccagttcctagccatagtaaaggactcacctgtggatgtgcctttcacaagcaaaaaaccaatccagagcccacgcccctaccacctgctgtacggggcgatcacactcggggtcactgtccacctggcctgatcagcccagggcaaggtaccagccaactagggacagactctctcccgaagagcctgatgaaattattcacagtagttaattagaaatgtacttgcccttcctcacatgttccttcccttgaaaaccacagtaaaggctcttgttcacattcccacagcacccctccctacttcccctgtctcctgactgacactggtgcttccctgtgtgaccctgtgtggtgtgtcatgcctccttctcttggggtctgtgagtaacaaagtgtagtttcaatgacagttatctcctgatttgttggcatcatcatacttgagtaataataaaatctatattttaaaacactgttccagagtctcctgtgggtaggagggtgtctccagatgggaggtaggaggcaggaggcaggtgagaaatttctctcttttgctctctgtcacacacatacacatacacacacacacacacacacgcacgcacacaccccatacctcagacaaatacttttctctcgattttctttctttgttataaagtgaccctgtgagtatgaccccagcatttctcagccccggtgtctgactgggagactctgtagatccagcatcagatcatttcctggcctgcggggctcagcgtcaactgcaggtctccacgctcgagtcaagagctcacaagcaaacatctggtcctctcgaagagttttcattgcataaactctttttatatgcttccaattaaatttgattctgctcgatctgtctaatttcattgacctcttcttttatcactgtcagttttggggggcaatgctgattagtttcctggcctgcataagccagcaggcagttccccttgaggagaaaagctctgtgtaaatggagggcctttgcacatattaatgtgcccaattacatctggtaatgtgagcaggttgtatgtgcttctagagtgtgcacgtaaaacaaatttgaatttataagcaaaagccgattgcagaggcaagccaaagagctgagcggcttccacgccagcttgcatttggcagctctctgctttagttagattagtagattaattagggggttttaaaagtccagacagattatggctgagatggtttaattagcaaagcaacccttaatattcaatttattttttcataactctggaatgtctttcacgtttgtttctacttcccatccctgaagccattaccttagttcaggcctcactgtgcctgatctggacttacagcgagttacagtgcctttgtaactccttcctactcctctaggtatccccgaccccagcacctcacctctgcatcctacctgcatgttgacacaaagttatctttcttaaaaatagaccaaatagaccatgtccctcccctgcatgacagtcttccccaactccaaaatgtctagagaataaataatatcctcagtggctctcaggccacccgaacctgctctgctgcagattcacgcccctctctctattcccgttgtgctgatggggagttggggggcagtcttcaatgtgcccagcacacccacacagggtaggcagataaaatacagggcacccaggtgaattcaaatttcagataaactacaaataatttgggggacatattcatactaaaacattaattgttgtttgtctgaatttcaaaattaattgaacatcctgtgtttgtattttctgaatctagcatccctcccagcatctctgtcttttcattctcattcctttttcttgggttgaagggcctgcttttgttttgcataggtggaaacctatgatgacaatatcatcttgtattcttctctcaatgattttttttttttttggtcatctgtactagaatgaaggtcataagaaggcgcagtctctgcctgattcattggcgtgtccctcgtaccactagagggtgtgactagttgatttctgtttgatgactgacatcttcctggaacaggaaggtataatccggagaacagaagggcaagggatatgatgttccagatctaggtgacttctgccctgctcctttgtcactgtgctgaggcctcacctgtcctactcattcttgggctgacagctggaactgtgagccctgggagatgagccagcatctctcctcatacctctgtacaaaatgcttagttattcatttctcaacaaagcatctcccacagtaaatcagggctgcaggaaggtgtcatttcccaaagactcaagtgagaaaacaaggatacaactaataaagagtaatgtcttagctccattgcaagaaactggtgactcctgacattgttgcagttgtctatgtgtgcacacttgtgtctgtgtacatgtacatgtgtgcatgtgctgcatgaatatgtgcatgtgtacatgtgtactcgtgtgtgaatgcctgtgtgtgtgcatatgtatgtgggtatacgtatgtgtgtgcacacacacacgtatggtgatcttcactttgagtcatggccctaagtttgaaatcatatttatctttgtacgacttccacttatatcgaagtgaagcagagctgaggcttgcttcaggatttccttgcgtacactcaaaatgtgaaggtgttcaatgacttcatttggaacaggcaaattgtgccttatttcacctttagaatgtgcatgtatgaaatattcttttctcccctatggttctgaaaaattgagctataatacatcagatggatatgtgtttattgtaaaatgtttgaaaagtttatagagaagcaggaaaaatttttgaggaagcaggaaaaaattcagttatctccaatatcaccaaccagaactaacatttcccaggctttttccagacagttttctgcacctagttgggttcacactgtatatgtaaatttccctctgttttaaaaaaatatttttatcataagcatttatccacatctttgaaagtactgttaatggctgctcaacatttcattaaatgaaagtaataacttcctggacctttctcctactttgcaagtttaaataatttctgctttttccccactataagtaatgctacagtgaatatatttatgttcagatgtgtgtccccactttgtcattgtgtcatctagaatcctagaattttaattgctaattcaaatctataaacacttgaaggcatctggatcccattgcctactatccttgctaagggtggtgcccacttaagctgcgactgagtgtggttgcctgagaggcctctgagccgaagacctgcagctttgtgagaataatcttcctgatgtgtttgcttgctttctgtctcctttgatttccacacactcattgttcacgtatgtgtcaacaggggcttttcgtgtaattggtactggaagaaactgtgcttctttcttgttgtaaaaggcaacccaaagcatcctcatgactgcacttgcgtgttcagacaggcaggagctgctagaggagaggctaaccagtgtgtagcttctggagccatcagctgcgcgtcactgggcaacccttgctgttcctccttttcttattgggaaggtagaggtgataattttacctgacatgttggtggtcacaggactgtgtgaattaatacaaccagataccctggacagtgcctggaacacagtgagtggaatgctggctgtgatatgacctgattatccagctgctactcatcctcttcctacagagggatggtttttgctttgcaaggttcttggaggacacctgcctgcattaattttctcagcctgccataacaaagtaccacaaactgggtggctcaaacaacaggaatgtgttgtctcacaatcctggaggctaaaagtctgagatcaaggtgtaggcctgtgtatgtgggtatatatatggactggtttctcccaaggccactctccttggcttgcagatggcattgtctccttgtgtcattcctgtgtatctgtgtccaaattttcttttatgaggacaccactcacattggattagtcctcgctcttgtgacttcattttgccttcattacctctttgaagaccgtgtctccaaatacagtcacattttgaagtacagggggttagaacttcaacatatgaaacctgcggagatacaactcagcccacaaagaaaagtcagtgctattcctcacagcagctgaacagcttcccttcactttatgtatttatttttttgtaacttttaagtgcaggggtacatgtgcaggtttgttacataggtaaatgtgtgtcatggaggtttattgtacagattattttgtcacccacgtattgagcctagtacccatcagttattttttctgatcctctcccttctctcacccttcaccctccaaaaggccccagtgcatgttgttccccgcagtgcatgttgttcatgtgttctcatcattcagctcccacttataagtgagaacatgcagtatttggttttctgttcctttgctaacgatgttagtttgctaaggataatggcctccagcttcatccatgtccctgcaaaggacatgatctcattcctttttatggctgcatagtagtagtccatggtgtatatgtaccacattttctttatccagtctattgttgatggccatttaggttgattccatgtctttgctattatgaatagtgccacaaagaacatacatgggcatgtgtctttataataagatgatatatattcctttgggtatatactcagtaatgggattactgggtcaaatggtatttctatctttaggtctttgaggaaccaccacctgtcttccacaatagttgaactaatttacactcccaccaacagtgtataagcattcctttttattcacaacctcaccagcatctgttattttttgaccttttaataatagacattctgactggtgtgagatggtatctcattgtggtttcgatttgcatttctctaattatcattgatgttgaggtttttccatatgattatcagccccatgtatgtcttcttttgagaagtgtctctttatatcccttgcccactttctaatggagtgtttgttttttgcttaatttatttaagttccttatagatgctggatactagacctttgtcagatgcatagttaagcattcctatacagcaacaacagtcaagcccagagttaaatcagtaacaaacttccattcacaactgccatacacacacaaaatatctaggaatacacctaacaaggtgaaagatctctacaaggagaactacaaaccactgctcacagaaatcagagatgacaagaacaaatggaaaacgtttcatgctcatggacaggaagaatcaatatcattaaaatagccatactgcccaaagcagtttgtagattcattgctattctcattaaactaccattgatattcttcacagaactagaaaaaaatgtttcaaaattcacatggaactaaaaaggagcccgaatagccaagacaatcctgagcgaaaagaacaaagctggagacatcacattacctgacttcaaactatgctacagggctacagtaaccataacagcatggttctggtacaagaacagacacatagactaacagaacagaatagagaacccagaaataagaatgcacacctacaactatgtgatcttcaacaaacctaaaaaacaagcaatggggaaaggattttatatttaataaatggtatggggataactggctagatatatgcagaaaattgaaactgaaccccttccttattgccatatacaaaaattaattcaagatggattaaagacttaaatgtaaaacccaaaactataaaaaccctggaagacaacctagttaatacaatttaggacatagtcacggacaaagatttcatgacaaagatgccaaaagcaattgcaacaaaagcaaaaattgactaatgggatctaactaaagagcttctgcacagcaaaagaaactattgacagagtaaacagacatgtctcccattctgtagaattggaggaaaattttgcagaccttccctttactttcaaaaggtaatggatacatgtgctctcctttgagtgcatgaacatctctttctattttttgattagaatgtgcgagggcttgcatatctctcttctgcttgatgatcaaagtgctataatagtctttatatcagcctttttaattctaatcagttgtagaatttaggcctttaggtaagttacgttcatcaaacttaaactagaatggatgtgttaaaagaaaattgggaaatgttaataatgaaatcccttttcatttcaacatgtaatgagggcaaagtgactgttaaatgggctgaaatgaatttggagaatacttttgaagaatggtaacgtgtttcatatggaaatgttagcattatgaattattcttctttatggaaatttcaattgattaatcccctcctacacttacctcatgctcttcctcttgtctaggaatccatgcaaacatcaaagataggcaaaagaagaacaatcacaaaatagaagggcagtgtggggcagggtgggactttactctgggaatattcagcaattatccaaaaagcatgtattgaacccctactctaaagataaagtcttgggggaagtggctgagagggggttttagcacatggctgtggatcaggccgagaagggagagttagggctccactgcaaaactaatagctgtgccctgggatatcacattttgtatatgggacatatattaaaaatattaacatgggatgacattttatattaattacttaagatattctaatacagtaccttcatctaaataaaaaattaaactaattttaattgtttcattttttaggaacatttggtttacggaaaccatggtatttcccctttactgcctcatattggaagagtgtgggtttcttggtggagaaaaggcaatactttctaagttctagtctgttcttcttcaatgagaactttgacaataaaggtttgtaaggagtagaattattagatgcatgtatttttcctttgatccattttgatttttttttgtttgtttttatggtccagccttttcaagtgtgtgctgattcctagagagacttacatttaggctgtcttgggctgggaaacagctgcaagcccaagatgtgggaaagtatgccatgacagtgtttgttctgtgaaacccaggaaacccagggagttcccattaattattatttagcgtcctcccctctgtgcattatgtgcatttgtgtgtatattacaatttagaaaaattgaagcgttagtcccaaaatgaatatgtgtaagaaataaaagcaaatatgggcagctaccctgtgtaaagcatttaaaaatttttaagtgttctcacccatgctggtttattcagtgttcctgtgtgagggagaatatcactgtcccttacaaatagggattgtggttctcaggagataggggcaggactgtccctgtgcctctgcactccagagtcatggcctgttcctgcaggtgcaggcacagggcacctctgccaaaggatgaatccataggccatctccatggaaatagagatgcatcactcagagataaacaagctcccatcgtggtgggtttagattacaagtcaacattctaatctaaacaatctaaatatttttctgaattatgaatcttttagaaaatgtggaacacatcaacaagcacctatccactctcacgtcctcaggagactatttctcatgaacattttatgtgtaactaatctgcctgttgtttttttctctacttaaacaaaaatacatgtgtgtgtttttattttttttattttttacaaaatggttatcataagggttcaaaactttgtaatcagtgatatcacttaatgtttgccattatatagtctgcttcttgttcttgctaaagaaagatttttgagttgatttgtgtgcttcacagagctggaattcaatttcaaagcagaatgctgaattaataaatatgagcattatttttagggcttttgaagtcttttcacaatgaattttcatctctctcacagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatgtgggtcccattttacccttatcaaacactgggcatttgattcttaaaacttcagtttacctgtgagacagaaggtttgatttcttttcctttttttaaaattttgagtctcaatacagagtttagagacacgggtgaaaggcagagcccctcatgagtgcccgtgtgagagaggccctatgtcttcaaccgcacaggtgcactgtaggcctggggctcagtcaaaggggtagtggtggatagctttttaaaaggcttaattcttgtattttctacaaataatttaccatgttgtactttagtctttgaaagtcctttggcactttcagcgtttgtcctactaagtatcatcttgcttgcatatctgtaggaagaggaatatcacagtggtacttgcaaattttttaaacacctgattatttttcttttccatgttctggtttttgtgtggttcttttctcattaagggtagatgtttggtttaggattcaatggctctagatttgattaaagaatcaaatcatgtgctcccagagaaacaatgaattcaaacattcacagccttgggctggctgtagaagtggaggtttaaggttaaactactaaaattatgaaatatctcttttgaacaaatcactttctcttttgttctttttctcactaaatatgtagtattaaagtgtgattagttaaaacaatgaagagggctttgcctcagacttaataagaaaggtagaaaaataacacatgaaacttcagaaatctcatactgaaaaaatagaaagaaagaatatggacagtttttatttgttccttggatacagaaatggacctggaaaagcgtgtgagtgttttttttagtgtttgaaaattgggaaaccacaagttgcacaaataatgactcagccagccagttcctctcaccctgcttttactaagacacatttcttacaaggaaaacctgggctgcttgtttagcagaatgatgagaattgcatttggagtttctagatgatttaaagttcaatgactgtgttgcttttagtgtacatttgtagtacattttgagtcatcctaagtggctgcctccacctggcaattcttagatgaaaggctgagaggtcagtcaaagacgggggggtcttcactatttaaaacaacagtctttgagacttctagggaatgtgtataaactattttatagtatcccccagataggtttgaaaataatatagcaaagagttttaagttcatcgaggtttaatttttgtgcagtaaacagtatctgttgatgtgtacagtttgatgagttttgacacatttggttagtgccggaacaagcaccacaaatacagaacctttctatgctgctccaaggtttcctgtgctctcctttgaccctggccttcatgtgaccactgatctgctctttgtcactaaaaactaggttacttattctagaatttcttgtaaatgggatcatgtctggcttcttgtactcagcagactgttttggggacccaggcatggtggtggtggcccagcagcctgctccttgggacagctgagtggtatccaccatatggaggcaacccagcttctttatgttttcatccatgggttgcaactgaggttgtttctctttgtcagtgattgtgaacacagctgctgtgaacatttgtgcatacagctttgtgtcggcacacatttaatttctcatgtgtaaatactaaggagtggatttgctaggtcctgtgtggtaggggcatgtttaacttttcagaaataagaaaccaatttaaaacttaaataataaacttcctgaaacaaggaagcagaactaggcaattctgaggcttctgttggtaaagtcggtcatgtgagcttgtggtggcaggctgcttgatttcttgtggttttaacacacacagactatcccgggagcagcggaaagaagactggctccagggttggggcctagctttgtatctctgttttgcttatatttaatgatgaggatttaggtatatatgtcatttctttagcatgtttcctcatctgtaaaaagttgaatgttatcatcttaaagtcccatacaactataatgctctatgattgcagttcagacttacaatggttcaacttaatgatattttgactttatgatggtgtgaaagtgatacatattaggtagaaaccatagtctgaggactcatacagccattctgctttttactttcagtacaatattcaataaattgcaagagatattcaacaccttattataaaatacgctttgtgatagatgattttgcccagctgtaggctaatgtaaatgttttgggtacacttaaggtaggctagactaagctgtgatgttaggtaggttagatgtaaatagatttttgacttacaatattttcaactttttatgggtttattgggacataacccaatcagaagtcaaggagcatttttatttcatgtggtagcataacatgttaaactcacattttcaacatcaaccagccaatgtaccctcaaactactcacaccttttaactgattgtgtaaaaaccaggtcagcagaaggtgagtgctcttggcaggatgcatgcgccatcctggagctgactggattgctgacgttcacagtatcagcaacgcgtattctccatgctgtcttattttctctggcagatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcagttagtaaacagttgtctctctgctcctcctgcctctgcccattgtgtaaggaagtgaagacaatagaaagagacacttaaaaaatcatctgtgtctacatttataagatgaaataattagcaaatggttgttaactatggaattatgacacagccaccaacactgagaatgtcagaaaaggcttctgtgggaaggcattgaatttgatttgatttgtctttgaaatgtggaagagatgagcacatgtaagcacagaggctgttgatggaaactttgtgtatctggagtaaaaggtccctaggggtgtcctgaaatgaaaagaattcaaaggcagcgggaaaactggttgtcaagaagctgattagtctgccttttctctccttgatccctagctcttcctcaactccttccttccttcctgtcacacacacacacaaagattaagaaaaaaagagccttattagtcatgctaaggagtttgaacttcactgagcaagtaggtgttcatgagtgggggactgtgattagcctgagatctggaagatctctcctgctagatcatagcaggtgccatgggagagactagatacagagtggccagtgtaggcaagaggtggtgacagcctgatttatggtcatgccactggggtgcatgggccaggaaggcctgtatttgaagactattcaaatttagaagaatcaggtcatgttgactaactggttgcacaaggcagggagcagagaactcccggtagggtcacaaacaattggtaggacattggttggtccacatggggggctgaaccctatatgaaagtggaatagcacaaggaagatctagagttgagaatatgtggggagaagtggaaaggaagtagggtatccaggatgggaagcaaggcaaaatccaggcagtgtgccctggctcattggacattgatagaagtttagaccagaggtaaaagggagagacagtaggttcctgattagagaacaaagtggtgtttgagggtgatgaccatggaagcatggattggaggggaagtggagcaatgaaagtcatggagagtagctggagatagaaacattaatccagtgctggggtcatcgattcagcaaacagtggtagttaagtgtgcaggccgtctgtcctgtgctgggctctgccccctcaggaagatgcatggctctggcctcctggggctagtgctgcatgcttggcaattccaatggatggactttgcaaagcagaacgtcaaccatggcgtgagtgtgtggggaaggggcccttggaggcaagcatgtaagtataactggtaatggactgcacattcctaagaagaaaatgtgaatgtcatgaattcttacagaatattgttattttacaatatttttgcaagctttacatttataaataagtatttacaatctgcatttaattaaggtgaaagctcacagggtttgggtgttgttttgtatggtgtaaccttatttctttaccactttttccgctatgtgcttcatgatggtggagctctaccttggtgtttctagccctggaacactgagaaaaagaagaatgagtcttaaagttgtcacacattccatgtgccgttggcgatatgaccagagaccaagtaaaacgtttgcaatgagaatgctccattccacccttccttttacttggcctctccaggtgccattgcttgcttctccatccctgccattgcaggtcacccctgcatcatgcctctgtagagatgccagggctgcagctggccttcctgcctgctgtcggcttcttctaccctttcctccagcccctttggctcacttctgcaaagcttatcttgtccccaaacccaacccccagctgttctccccagatcatggtctagcttcctgatgtcacgtgctttcagtactccacatggagtgctccttagaaatgtacccaggtcctggcccttctctgccaactgcccttcaaggactcacatcacttgaggtataatctaaaggtatggaggcctacaattgtgtaatttacattcttgtgcctattgtctcagatttattatgagtgcccccttccacctcaaaaccctcctcctttggaatataaatttataaagccctgccagcctctcttgctttacctgatccttcattgtgtggtgcctgctgcgctggtcttatggtggatccctgagcacactgaacaggcccttcgctgcgttcgtgttgtgatgggctccgtgtgtagcctgcctcactgccgtcctggctcttctcagacaccatcttaccagagcagacttcctgagcattctgtccagaacaacttcccactcactctcctgagtcccctctatttctctggctcttatttacgacatttatcatttcatgacagcctctgtgtattagtcttctgtttctttccaccagatagcaaaccccttgactacagggacgtagtctgtttggttcactatagtataataagcattctttgagttgaataactggatttttttttcaatttttatttttatattttttccataagttattggggtacaggtggtatttggttacatgagtaagttctttagtggtgatttgtgagattttggtgcacccatcgcttgagcagtatatactgcaccatatttgttttattttatccctcaacccccttgagttcagaaagaaacctcaggtgcaaacaatgaagctgaataagctctactggggggtgtgtgaagtgggtgcagggggtcagctgcccttggttgtatggtgaagggtcatagcagaggtaatgattgagcagcaggctacaggatgagtaaggatgaactggggttgactgcagtgggtgggctgcaatatgttacagcatgtgcagcttagagcgtccacaggcctctctcttgcaggcctgtgcacaggcacattacagaagcttcctaagccttgcaagattttaggttttgttccttaggctgtccatgggcatgaggcctctggagagtgctgagcacctgatacgatggccgtctaatgatggttcacacactctctccagttgcaggtggaggatggggtgggctggggtgagcccaagtcgcagggagagctgggggctcctgcactaagaacagattaggccaggagaggtccagtagggtgaggaggaaagggagatgcagacccaatggggaataagagaggagggggcgtccatggtattccccagatgtctggctcaggcaagcacagtgtttttcaacatacagttgactcttgaacaacacaggtttgaaccctgcaggtcttacttatattcaaatgttttcaatacaagtaacacccagtgtgcctacctcttctgctacctttccttctcctctgcctgacctgcctcaaccacctttgagatagcaagaccagctctccccttcctcctcctcctcctcagcctactcaacgtgaagatgacaaggataaagacctttatgatgatccacttctagttagacaatagtaaatatagtttctcttctttaagcttttttaaataacatttttttcctctagcttgcctcattgtaagcatacagcatgtaatgcatataacatacaaaagaggtgtcaactgactgtttacattattggcaaggcctccagtcaacagtagaatattagtaggtaagcttttggggagttgaaagttatacacagatttttgactgtgtacagtgtggtgctttaagtccctgcattgttcaagggtcagctgtgtgtatagagagagcctatttgagaagttggggagaggaaagtgatgagtttgtcttagagatgtgagttgaaggagtctggaggtttctgatgctgaggccagctgtggtgctaggctcccaccagggcactgccggcctgtgctcctgcccatgctggttttccttatttattaccctcccctccactgctacctcagtttccttggtgtgcccaaatcctgagatccttcaaggaccagatcccctcccaccatggccttgggatgttgtgcaggccatgtgggccagggcaggaaagaagccccttgtgggctctctcagatggccagaggggccttctgcttccagcctcacctctgcaatggctacctacattgtataaaggaggactttcatttgtttaacatcttttttttgtgccagccgctatggtggatatgtgccaggaacttacatgagtgatctcattcaagtgtcttttccctgggatatgggcagaggctccaggagatggtgccatgcagctcggagagggaagccaggatctgacctaggactctcagatgcaaagtgccttctgctgcctttctttcaagctggccactacgttgtagcatgtgggcatggtctctgcaaagacaaaacccactaggcggagagagggcagattctctagcacatttctagtgttgatgccctaatgggagtacggaccctcattggggattccatgagtctgagaagtgaaggtgatttgttaacagttgctctccctggggttagtgaatgcagtagctttaaaatgcactctcggaacttggcaggcagggcaggtgtgtcactagcaacccacagtggggaacgtgtggatgaaggatcgctggtgcattgtggaacctgcctctggggcatttctcttgaaggaatctcaccccagtaaggtcagattgcaaacacgggatcctagaggggctaaatgaggcagtattatgaacattcttttggagatacgaaacaaaacaagatcacaaacacagaatacggtagaggcttttctcttttcatagtgtctgtttttgtgtccttttatatttgaattattttaaatttgcttacctctatcagattgatggattagcttcagttcttgtgggttgagccctgctgggagtttgctgattcttgagtgtgatgagtgcactgtggccttgtattgatcaattctttgtagttttgaatcgcaaaattaggagacctggaggacatgagaatacagcatattgctagttccagagaaaatggggaaggggaacagatactccaagagatattgcctgagaattttgtagagttgaaatgcatcaatcctcagttttagggagcacagcaagttctgaacaagataagccaaatgaatggtttttttcttactgaattcttatactgcaaattgtaatttgcaatatatactcatttctttcaaagtgtcaaaaaactccttataataaaaaaaattaaaattgtaaaaaaaaaaaagaatatggtagaggcacatattacccaggggtcagggtctgaaaggagggcactggggaaaaccatgctcacattacccctgaaaatcttttagtggagagcagcattggaaaatgacaaagtggctctctagaaatgcaccactgcattgcacagttttatttttccatacttggatgggatcagtatttgtttagatgatctcaaattgaaattcgtgcctgtgtttagagaccagctatactataaatgcatgtgtggaaaaagccaaatctccttctggatggatgctgacactgtgagggccatgtgcaaattaagcctgaattgatggaaaaagtccttgagggaccgaagtccattgttaaagtgatggatgatactatacattttatttaaatcatcctttcttcttttgtcccccgctcagcattcacattattgtcataatctctactggagggcattctctactggaaggtggctggttcacatcttgtgctgtcttcagagaatggctggaaatagtaataatgttaatgacagtggacacttggatatacatggaaaatatttagtttgtactattgaaagctgtcttaaatttgagtgggtacttaacgagaaatagctaggtatcttatggactatatattatgagatagcaaattggctatgtccaacctgatttctttaaaacaagtcataggttacctattgtaattttttaaaatgcatctaccctagaccacagtaaactctattgtgattgagattgggagcttaaatcaaacacctaacaatgctacatttgcttcatctttttttgggtgccaggcaaccttaatgattatcagcgcacagagtgttacctagcaacaaagccaatttgcacaaaagcaaccagaataagatcatgttttaggatggtagtcttcaattagagaaagggaaaactgcaaacatctgatttagatccaacatgctccctattactctcctgtatcaccgcttggtttccttaatgtgtagcttcattaaaatgtgacttcaagggaggttgcatccctgctagaatctttagagtaaacatgtgtcaagattcagatcattactgttttgcccttaatttggcctaaagaagataagcatagtcaagagaggaactttgttagacctttaagtcagtgtgatgttgttatgtagttaacgttactacttagagttctggagttcaccatgcaactcaggttggaggtacatttgtttgatagtaatgagatcattgagggcataagtgaaggaagattagaagaggggacaaagcattgatccctggacactccaacatggagtgtatggagagatggggagaaaacagccaagcaggcaagaaagagaaatcagtagcaaaggtggaagacaaggaagtgaaccaagtccactaatggtgagggtgtgatcagaccgtaaatgctgttgagggtcaagtaaaatgaagacttaaaaaatggcctttggatttagtatgtggagggctctagtgacctctggaagagcaattttagtagtgtgaagggaatgaaggtcttattagagtcagttaaagaaagagcggaagaagagaaattggcagcagcacatcttaggagttttgctgcaaaaaaagcaaagaaatatgatagtgtcaaaaaggaaaagtgaggtcaagagaaaaaatgctcctcttccattcaaataattcaaagacaggaatcacagcagcatatctgtacacagatgagaatgccccagtagagaatgaataattggattgagctacagagcaggtggcttgctgggacactattctgtatgggacaggggaagggatttagacaagagacaaggggttgtctctcctgagagcacagcaggctcacttacaatagaaggaccaagagctgagtctgtgagtacttccattagcttcattgtttttcaaggtagagtgcatgcacagaagggattataaagttaactagtcagaagaggatgcatggaattgagagcctggagaagatgtgtttgttagaaattacaaggtctaggatgtaacttggttgtgagtaaatgggattggtggagtgaagggaggatatgctacaacaaatactaataaaatctctaagaataatgataagagtagagctgaagaaagagacagtgcacaagagcagattcagggatgggtagatgacaacagcaatgacaacaacacccaacagtggatgatatgctcagatgacctgagattcaaggctgggggcttcagcagaggtggggaaggtcacagtgagacaaaaggagacacctgccccacatggagacccagtgaaggaaagaaacagcagttatagaacaggatttatgatgggtatgtgttctggctcaagcctttctctcctgtcttatctgaggtcattgtatggttttccatgtatttcaaggacagaatctctttgttccttgcatatgctattctttctcccccaggtcctggcaagtgctttcctcttttttttttttttctggaacacactgttcaagcatccccacttcacttactctcactacccatctgactgatttcatatgccactgtctctggagtcagagggaatccctatagctcctgggactttatcattaccctacttacctatactcttattataatttcttgcctgtcttttccactagaccttgaatttcttgaatcaaggataagatttgatttatttctctagccctagcaggtggcaggtgccaggcattgtaggggttcagtaaacattccttgaataaatgaatggatgattaaagagcagcatctgaaacacattctctggtgcataattgggtcataataggagaaaatatcttttcctcctttccctgctgcctagcaatgttctcaattagaggattatcctgtccttttgagaaggaatttggaaatgtaactttgaaaaaattatttgcttctttttgatatgtataagatcaataactagaaaaacactagcctctaaataactttaaaattaaaaaaaattcaacagattaaaaacttctggccagtgtttacaaattgctgtcttctttaatttttaagtccactctaagcatatgaacaatgcccagaaaccagcagagtggaaatgactgggctttgcaatggggttctcttcctgctgcaatgataggtgttcagacattgttttgctgaccctggccaatgcctcagtggcttagagtcctaggaatgtgtcattctgtacaaaataagtcaaggacttttacttccattgaccttagtggatattatattcactgattaaaatgccatgagtgctaattatcttcagcctccatgcctggttctgggaaaacagacataataagtaaaggggcttgttcttggggaagccccagtccatgtggggggtgagacacttaacaggtacatatgatacgtgtcacagggacccagtggatgccagtgtgtattctggcttcagagtgctagtggttaaatgcagttcttccacttagaaagcttttaacaatatatgctatctctctcttgggttttccaaatacaatgtggttctaataatgagaagaccctcatttggaggttatgtggattataataatttatacacacaaagcacttagactagtagtacccagtgtatgatacatgtctaataaatgttaaatatgattatctaggcttggagctaacatttaaaaaataaaataaagtgactgggatttcctctgtaggaaagcgtttatgaaatgaatgaatgatattcttcagaattatagattctacagtattgtgatgtgatagaaagttctactttaagttggacctctccaagaccaataactcaccatctcctgtgagcttcccatagcatgttgattatacttcatctgtaacatttatctcattgtgtcctaattggatatatacacatgatttatctagataactctgatttcctgcagaaggacctgtgcttcgttgctctttgatgcccctacctttatacccaatatgcaaccagcacctatgatgctatagaccatttgtgcaatcttgcaagaatttataaaatacacatgaatgaaataccctcatcctcacttcctccaccctatcattattacctactgctcttggcttcaagaattttaaaacacacacacacacacacacacacacacacactatggggagcaaaattgtccataaaatgtgtttgtatattgaaattcaaagtgcatcaggaaaacaggcctccactaaaaacagaagtaaaaatacagagtgaaccagatcggtcagtttaatgctaaccagttgcataagatataatagagagcaggccccagcttctttgcataaatttgattgtagaagcatggttggtcccttttgcttacatcttgtttgacacctgtgtagtgaaggttctgtgaaggactgcacaggtggggacaaagtgcagggggccagaagcgttcctgaagttcaatgccaggtgtatgaagaggaggtaggcttccagcttgcttagggtgcacaatgaggcagcagcgtggggccaccccagagggtaccatagacatcccaagtagtaccaatggaagaaatgaagaaggaggggtttggggttgaacacagaaaggtaaccagaacatgcacgtttgagaacatctgacatcttactgacttgttttcttgtctatttgtcttctctgctgactgatctctggttaatgtgctaagtttaatagatcgacctcctctgctagattggaatctcgcagctgggaatgtgttgggagattgcagggctaggcagttacctggtgaaatggaaacatttgtcttcctccttccaatagggtgttgtccacactgggaacacatgaaaaacaggagcataaattattactataaatttaggttgagatttaaccagcagaaaatgcactataagacttggatgaaacattaagtgcacagagtgaacactaaaccctaagaagtgggcttgaactctttctagttcaggatgggaagtatttacattaaatatttacttagtcatcaggcagaaaatgggattcacccaattctttgcttggaattctggaatgttccaggccccaactattcttgaagctcaactgtctggaacatgtcaaatcctcttctgcctgtctagccttctctctggctgcaaaatggcaccatgacttcagctgctggctatcaggaaggtagaaacatgcctgcagctccgaggagacactccactttggtttgagtggtcaagggaaggtttcaggaaggcattgtttaaactgggtttgtaacaatgagtaagatggtaaataggtgatgagggcagtaagtattcctgtagagttaacagggccacagtggtgagggaagttatttgtgagaaaagagagtggatccctggaagaggggtaaagtttcacatggggaaggctttgcactgggtatctgagatctggaactcctaagactgaaagatccctgcaacggaacaggacacttgttcttacattaatagcaaatgataatttatactttgcacgtggcatttcactggaacatctgcattaatcaggaaggtcgggtgatccagatttagtggacagtggccagggagtgaagggcttctctgctgagcagtagagctgggcctgccttgcttcttctgaccacactggtacatcagccattccaccatactccataccctgtagagggatgcagggccctccctggcagaaggtatgagtgaaatgagagacatgcttctccagagaggagacaatgcaagcatttccaagcacaattctgggcagatattgctggtctgcatcacggttggtgtcccttggcgtggttccatctgaacctgaagaaagtcaatgctgctctggtgagactcacgtgtgtgtagcatccacacctctgtgatatatttgtggtttataacgatttcagccactgttagtcattatttctggagtgaaattagaagcaaagttttaaggtgttcagggagaagagtgatgttttcttctaatttcagaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtaggcactgggcctcattctgccttctcttcccacaatattgtgttgcaggaaatgcattgctactgtacagtagaatcaagttgtatcccagtgaggctacattatccttttcagaaaaatataaatttttaaaagcacttatagggatatattcgttagataacatctctatagtgcttagaattgcttactttgtgtttgaccttttaactcaataacagcaatgacatctatgtacattatacattatcatacatgatttcaaggaaaattgtcttcttctggaagcatagtttcttagaagaggcatcccagatcataggacaagcctcccttgtctcagatgaagaaatgaaggctcagagagacgggcatgtgatttacttgtagctacagagaaagtttcctgaactgagggtggatgttgaacctcttgtccatgtttctcacatctattattgtttctttccaatttaggacatttgatgggcagttactaatttccaacttctgattctttctgcaatcctgacagctaggaagcattgttctatgtattttctgtgagaatactcccttttggaaagaaacattgcaacagtaaaacacatcttggtgctggtaaataagtgtagaggcatcagtggcaggattaatacagattctcataaaatgttattttgctttttcttttgccttttgagtataaattttcttctgacttaacctaaagtctccatttccctggaggtgaactaggatttgcaaaggaagaaataaaggaaaaataacaagaaagagtccttctttttcttagcatatagagggctgaggccagaagtcttggaccatcaaattctatctttggagtagaaaaggtactccagtctgtcacttaaagcttaaccataggctggagtcagaaaggagaaaaataacaaaagggagcatagaagatcaatctgtttctttctgtcccacaattttgttggaattatggaaggagaagatagatagaagtgggaaaattgagcaagcagatgtgactttttgttccactctgggctttggcctggcctgggcaattgcactagaaaagtgcaggccacatctgcggtgctggctcctcaatcatggtgcagccacatcggagttcacgaggctcagcagaaatccaggtcccagtgaggcactgagggctggtattccctaccttttcatgcccatgaactttgacattgaaagacagggcttgctaggcatgctgccatggaagtaggggaccccttggagctagctggctggaagccagggcagagattcagccgtctgcagtcagcaggacctactgtgaggcctagacagcctgggagcactctgctctggcctgacccctttggagtccaagctacaaatgccaaggtggggaggcaggcagtgccatgtggttttggttgacacccagacaccagatgaccctgaccacattgcacccaaagattcgaacccttccccgttgccacaagatcaagaagactcctgactccatttacctaagtgtctcttggggaaagacatagaaagggcagacatgggatactgaccaccacttcaaaagattgattaaattttgagatgcaacgatttaaactggacgaaacaatttgcgcactaccctggctggggactgatgcggaagatcaatgggagatagacaaatagataacattgtctctgcacctgtgaattgtggtgcaaattaaataccacaagcccactactcttgtttagtttaaaaattagagctggagtctcaaaggtttagctgacagaacatttttgtaatgagcacaaaggttattttagacagaaaaatagatacaatgaaagtctcagaaacagacagttttcttcagtttctgttgttacaaaccaaatattttctcactgtccttcgttgtttagcaattttttttgtctttggaggacttttttgaaatcatccctgcactgactgaagtgcaaaatcaatagtatgtaagcgattagataggcggtattggaagaaaaatgtgttttcaagaatcaaaatgtatagccatttctgaagcagcccaaacctctaggtaatcatagagctctgtgagacagatctaaggactgtgcagaaacaaacacttccttctgagaagaaagagctcttctgtcggaataccagtgcagtgggggctcagtctacctggaattttgtgtgtgtttcttgcttagttatgtacagtgagggctcttgatcagccctggtaccagtatttctgtgtctcccatggaaaaataaataaggaagcaaaaaataccggtgaaaactggcacatctcaactaaatttctgttctggggtatgcacttgctctacaaatcccatgtgaccctgcagaaatgatcaaatgcttctgagcttcagtgttctcatttgcaaatagagacaattgtaccatctcataggatgtgagagggcacagttgtatgtgaaagtgcacagttctgtatataccatgtgtgcgctcaatcaatgacaggttatcattattattattaaaatagacaaggggcgaatgtgggaagcgcagcttttggaggaacatatcatctgaatcagagagagaaacagtcaaacagtgtcttggggaaaacagtagcattgctctttgaggccgggcatggtggctcatgcctataattccagcactttgggaggccaagatgggtggatcacttgaactcaggagttcgagaccatcctggccaatatgatgaaaccctgtctctactaaaaatacaaaaattagctgggcatggtggcgcatgcctgtagtcctagctacttgggaggctgaggcaggagaatcacttgaacccgggaggcagaggttgcagtgagttgagatcgtgccactgcactccagcctgggtgacagagcaaggctccatctcaaaaaataaataaataaataaataaaaataaaatatatgtatatatatatattgctctctgaggctttggatgtgtcttgaatttccttaacagccactaaaaagtcatcaagggtcaaatgcctgcaaacttaattgaaattctttggaagtttattcatttatttattttcccagcttcattaaagtataattgacaaatgaaaattgtgtatttgtggtgtatagagtgatgttttgatacactgttgactccttatatccatgggttctgcatctatgggttcaaacaacctcggatcaaaaatattcagggaaaggcctggcacagtggcttatgcctgtaataccagcactttgggcggccgagagaagtggatcacctgaggtcaggagttcgagaccagcctgaccaacatggcaaaaccctgtctctactaaaaatacaaaaaaattaaccaggtgtggtggtgcatgcctgtagtcccagctgcttgggaggctgagacatgagaatcacttgaacccaggaggtggaggttgcagtgagctgagactgtgccactgcactccagcctgggtgacaaagtgagactgtgtcaaaaaaaaaaaattttcagggaaagaaagccaataagaaataataatacagcaataaaaataatacaaataaaaataatagagtataacaactttttttttgagatggagtcttgctctgtctcttaggctggagcccaatggtgcaatctcagctcactgcaacctctgcctcctgggctcaagcaattctcctgcctcagcctcccaagtagctgggattacaggtgtgcaccaccaagcccagctaatttttatattttttagtagagatggggtttctgcatgttggccaggctactctctaactcttgacctcgggtgatccaccacctcggcctcccaatataacaactatttaaatggtatgtacattatattattaataggtattatatgtaatccagagatgatttaaagtatatgggaggatgtacttaggttatgtgcaaatactaccccattttacatagggattttggtatcttcaggggtcttagaaccaatgctccacagataccaagggacaaatgtatgtatacattgtggaatgattaaatcaagctaatttacatgtgcatcacctcacatatttacccttttgttgttgagggcacttaagatctaatctcagcaattttctggtatataatgcattattactaactgtagtcaccatgctgtacaatagatctctagaatttgttcatcttgtgtcactgaaactttgtatcccttaactaacatctccctccttctcctccctccctgctccctgccccgccagctcctggcaacaaccattctactctttgcttctcttttgggaatttagattctagttgacttttatttttagacttcattgtatgggaatgtatcatctgaactacatgatagctctagtcagatgatctaaactgcctttaatcctagatcagggattaagcaaattttcttagcctcaaaggtctaacatgcaaggagcttggccttgggtgtggggacagggacatacatgtgcaagaactggtcattgtggaccttcaagctctattgcttttgtgtctacgttccatagtttatttgtaaatgcatcttttttttaatgtattgaaagtcttagtcttttaaggtgtctcctctattattgttattttttctacttgcattttgtttttaattgacacatgataattgcatatgtttattgttttgatttttttacttacattttaaattcaggggtacatgtgcaggtttgttatgtaggtaaacttgtttcttaggggtttgttgtacagattattgcattgctccggtattaagcctagtacccattcattatttttcctgatcctctccctcccggctccctccaccatctggtagacctcagtgtgtgttgttccctctatgtctccatgtgttctcatcacttaactcccacttgtaagtgagaacatgcggtgtttggttttctgttcctgcattagtttgctaagcatgatggccttgagctccatctacattccaattatgggttacagtgtgatgttttgacacatgaacacgttgtgtaatgatcaaatcagggtaattagcatattcacaacctcaaacatttacttgagtagagttaaagacatgtttagccttctctctttgaaaatttacctttggaacaagaatcagtcaatgagtttctttctatttaataaaacggaacaggttgaatggggctcagtgaaagccaatagggagtgtcgaagctaaaagcagcaacatctttttacataactgaatcaacttcaccaaaatatcttctagtttctttggcctctgctctgctaaagctaaatctgaggcttcttctttacaagcaaaagtcgtaaaacttgacaagatgctagaatgcttagagaaaacatttgaatttaatattggtttctgccaaaggaagccatgcccactgggctcactgatgactttcctgccaggaacacccaagtccccctccaccctggctccctgtgtccatcacccacaacatactctcctctctgtggttcatggctactgtgagcttttccaggaaggcattgcatgttctgatgctgctacttggaataatgaatacatgtggttacatcatccctgattccaaagggtatcaatgtataccatggccatttcagacctcttttttatcactgatttctgccttaactcagtgctatgattttcttattcaattgcgcttccataaaatatagccttctccctacatacatctcccttgtcatccaaagaagaatgaggagggccaggcatggagggttcacacttgtaatgccaacactttgggtggccgaggtgggtggaccatcggaggtcagaagttcaagaccagcctggccaacatgatgaaatcccatgtctactaaaaataccaaaaaaaaaaaaaaaaaattagccagacatggtggcatgcgcctgtagtcctagctactctggaggctgaggtgggagaatcgcttgaacccgggaggtggagtttgcagtgagccaagttggtgccactgcactccagcctgggagacagagcaagactccatctcaaaaaaaaaaaaaaaaaaggatgaggaagaggactttagtatctgaggagagagataaccacccagcttttttttttttaatttattctctccgttcattcagtgatctgcttcaaagacagagagaacagggggctgtgcacaagcactctgttttgccccccagtttcactctccgtgcctggcagagcacccacttttgttcatgggggtggggatgggagatccgtggaaactactgtagaggaaagagtttcagggcctcgaattggcaaagtggccaggacgcatttcaatttttttcagtttgaaaattggtgaggatctttaaattgtgccctggatctaccatcctgaggaaaggagggaaggtcctcctggggcctttgtcctcctggtgctgatgcaccctgtgcttggacccaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcaggtaaggagtgcaaccattctatctcactgaagtcccatttctgtctgtggcataagaaacaagtggtgacagttacatagtaataacgtctcagtggaggccttctgtgcacaatggcccacatgccaaaataagtggccccaggcctgtgcagggagcaagcctctgggaacccaagcatgcattttgaccgccaggagaaaatacatgaggagtcagaattacctgatagataacaggagctgctgtgagtgtcagggccaggaagtatatgacctatgtattctagaaattcttttctctttctttctttctttctttctttctttctttctttctttctttctttctttctttctttctttctttctttttctttctttctttctttctttttctttctttctctcctttcctttcctttccttttctttttctttctctcctttcctttcctttcctttccttttctttctccccttcccttctctttctttctttctttctctttctttccttttcttttctttctccccttcccttctctttctctttctttctttctctttctgtttctctttccttcctttcctccctccctcctccttccttccttcttttcttttcttttcttttcttttcttttctttcaatggagtcttgctctgttgcccaggctggagtgcagtggtacaacctctgttcactgcaacctcccgttccaggttcaagcaattctcctgcctcagcctcccgagtagctgggactacagacacatgccaccaggcccagctaatttttgtgtttttagtaaagatggggttttaccatgttggccaggctggtcttgaactcctgacctcaggtgatccaccaacctcggcctcccaaagtgttgggattacaggcgtaagccaccatgcccagcctagaaatatttttttgacaacgatattaccctcctagaggctaaaactttgccagaatacaagagagtagtgagggtatagagcaagtggagtctggcccgagaggctgaacttgggtcacatctgtagtcatcattgcctgtgtcaaccgggggcaggaagtggtgactctggggctgggattcagggtgtgtgggaaatcacctctccactcttgatgactgtatttgacccttggtggcccacgaaaagtcttccctcacctctgagccaaggttcctgtttgcttcctctctcattcagcgtgaatgtcattatccccaggtggctcctttcttctttggctgagaattcttgtctcccttttaagactccttcaacccagttttctgctgttcaatgctaggcccaggatctctctgtgactctcccagtggacggggggcacttcatgaatacaaacctctggaggctggccatggcaggcccagtagctaagacgggcatgttggggggcatgtgggtgtggcctcacaaggtttatcactgcagatttatattttttaaaaagaaagaaaaaaatacgagatgtcattgagatgcctattgcttaagtgtgatatttcatttaagctttgaaatggagttttgaaataatttgcttatggatatacatgaaatcaattgatgtatatatggattaacattccttactggcttcttttttccttttttttatggatagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtactgagaaaactgaagcgtgctttaattatttatgcctttttgaccagtccacattaaatgaagagatgtgggtaaagggggggagatgtgggtaagggggaggagtgtgcacttttatttacatttgatttctgattggtagcatactagatgccaataactgaacttaacaggcctgacaggtggcaattgccctttaagtgaaatggcattcttttagcattctttttttttgttttgttttgtttttgtttttgagacgtagtgcaggctggagtgcagtggcgctatctcggctcactgcaagctctgcctcccgggttcacgccagtctcctgcctcagcctcctgagtagctgggaatacaggcgcccgccaccacgcctggctaattttttgtatttttagtagagatggggtttcaccatgttagccaggatggtctcgatcccctgacctcatgatccgcccgcctcagcctcccaaagtgctgggattacaggtgtgagcccatgcacccggcctcttttagcattcttgtatttgagaagcttggtgtctttaattcagaatcatgaggtgtttaaacagttgtcagtagtggttgattgctggttgtaattcttcatgtagagatgccctcctctttctgcttctgtctgggagtctctggccccatgctgggtatccgtgatgtgagagggtttagcacgggaacactgcagacgcctggtgagctcccatcccccaggtcccacttttctctacctggatctgaggtggatgagaccactccatgtgggttcttcatagagtacacttaacaacaggcagaaataggcgtttcctccaggaggacattgctacgttgtgtgacccaacctgaggcatgccttgtttggggttcttgaggttggctctctgtgtgggcagtatttgagccctaattttacattgctattatttatataaaatgtcacgggttttcaaaaaatcaagtgctgcaagttaaaatttttaaaaatctgcaaaagtcaaagtctgaacattcagttgtgttttggaattgattccttgggttagtgatgcaggaggaaaggcaatcttttgtgtgataaatcagtgtggtcccaagtagatagcctccatcacaagttttgtctggaataaatagtcataaaagattgtgaaacataaaaaatattacaaaatgcttttatacatagaatgtatttggttcccctgaaactccgtaacttattattcctattttaaggttgagtaagctgaggctcacataggccaatttctttaccccaaatcacgaaggtcgtaaatggtgagctctacttagacctagggtttctgatagttagtcaagttctctaaattagcccatacctttgtggttgatgctctgtattccatgcatcatcaggactggagtccatccattcccactgcgttttaatagagcaagttacagtgcaagagacaaacaaaaagcagcctaataaacacacatgatgaataggagctgttttctaaagccaaaggatgcggtcactacatcttttcttgtctggctgtctcctattttcattcttcaagtcttgacatgaacggcgcctctgcagcggattcccagattcctcagcatcaattctgttccgtgttctccccacccgccctcactgcactctgaagcttttcttcgtgacacttctcccaacttgttatgcatgcttctctgtctctcccatggacgctgagatctgtgagtgcttgtatcttttctgcccacctctatagcagcagtgcccaggacagttactggcactcatggttgcttaataaatattttctaagtgaacaatgtgctgaacctttccaaagattcatccagctatatttttaatataaaatgaatattttattatttaataaaataatacatatatattacacataatatacatatgtatacatatgtaacatataatatacatacatatacatatattacatgtaataatacatagatatttaataaaacatatatatatgttcagggtttcgttgtgttgctcaggctggtctggaactcctgggctcaagtgatcctcccaccttagcctcccaagtagctgagactataggtgtgtgccactgcatctggcaccaagattttgatctttaaaatggaaaaatcagaacagtttgcctggtttcccaaggagtaacaatcatgattaaatgcctggaacaagtctgtcaaaaatggtaatggcttttctcacttacagtgggattgcatgagacgttgctgccgtagctttggagtgaccacggagctaaataacatctatacccccaaaagtcacctttcctccaggaatttttgggagacagcagtcttccctgggccaatgtagaacaagaaggaatttcctaagccccttttccccagattgcatgagtcagaatgcaggtttacagacgtgctgctaactaaagcaccatacttgaatgcagctatgtcagacaccacagttgtcactatcttcttaaatgtgaataacaagtccaaatattatattggaagctaatcatttggacagttgagagctgtcagctggcatgagtcagtttccctacagacagaaggaggcgctgcttccaggggtagttttgccatcctgggtcacttggaaaagaaaaataaaataatttttttggggggttatcgagagaaattgtcaaaaaagcccagacttcttatgttcatgtctgtctctctaatcattcaccgggttaatccggttgtttactagttgtatggtgtcttgtacagataaattgaacatattcataagctcactggactctcagggcagggaggaagatgctgtaggaatatggaccaagcacacttatcagtgaaataatgagtgttcacccccaatgtatttactgatttgcaattaaacacatgcgacaggaagagtgggtgttccctttacgtaagtggcattttgcttgttgttaacaaaagagaaatccttggtaatacttttaatttttattattaagaagagtgaaattttgtggaacattttgcttcaatattttatgaatttaaatatcacagaaaaaaaaactggtgaggaaagcctttatatcacgggtggatgcttagctcttaattgttttgttaattattgtggcatatatgaccaatcaataatatctccaggtaaaacatacatttagggagaggcttattcataaccatagcacatgtgaataagatacttcagtattctttttagtaattcccttccttcctgccttccttccctacctctctctttttgcctcccttcctccttcctgcctacatccttctttcctccctaattttcaggtctgtctgaatttttagtcacatctgagactaaaatgaagatcccacaggagtaagaaagtgtcagctgtgctgtttcatgtttgctgtgcttgtgttgctcgtattatcttcagaatcttttaaagccactatctcctttataagtgttattttagtaaaaactagataaatcaatgtaaaaatctacttagacaggcctctacaaagctgcaacctgttgaaacttgaagaactgtcactgtggccacagaggccaccagtgctcctatcagtcttaaataggaggaattctttatgtctgataggttccgcctaggaatagaaactgagatttccatgtttccttctgcaccccctggggtgctgagagagctgggcctcgacagagcctgcagggccacggggagtggtttgcattcttgaccatgcatggtgctccctcactgcactcactgcagaatgactcccctaccttggcacccttacctgtaggttgggaatcatggaaggaaccacaacatagggttgaagggaagaaacttctagtgcagcgcgtgacacacagacagacgacatttgttctgcttgatagggacttgcatgagatgccctgggaggatccccagtcggagagtgccccgggaccaagggaagcctcctgcaggcgctcccagaggacaaggctggagctgcaacctgggtgtgtcttggggtttagaggctgcaccttttgcttcctcaccctccaggtccagcctcccacctgccccagacccatgtccatgcttctccttctgatgtctgccccttccccactctcttccctacagagctcgggcctgttaagagcttgctgtacttcagtccttccatgctcagaattctaaaccagtcttggaatctcactgcatcactgcatatacctttttttttttttaaacaggagttacccatttcacaatatttatcttgaacagtttttatttttcccatagtcatgatgttcatggtgacataatttcttttacaaaaatgtgtccttatgtagttcctcccctccctgctttaaggcactttggttgtttctaaagttttgattttaccattgagactgtacaagtccgaagaacaggatcccccagcttttccatagactgattcctagaaatgcaattactgggtccaggggataaccctcaagatctgtgacggggtcaaatgacagaatccccaaatgatgacatgcatttgtgtcctagatgcttttttttcatatgcctcaatcttttcaacatttcaaaagaaacccagtgccttctagtcacatttaggatttcctaactggcctgctgccccatatcttcttcaacccatggttgccatgggaagggcctgggaatcaggacaagaacattgacacttgcatttatgtttcatcacttcctgtcggggacaatctggacaaatcacttagactggaaccacatttattcatttattttaattttaaaaaccttttaaagagcagttttagattctcagcaaaattgagcagaatgcacaaattgtgcattctgtgtccctctgcctcccttgcccccagcctcctccactatcaacatccctgcagaatggctcatttgttacaattgatgaaccgacatggacacatcaccatccagcccattaggcttcactcttgctgttgtacattccatgggtttggatgagtatataattccatgtatctgccattatagtatgatatggaacagtttcactgccctgaaaatctcttgtgctctgcctagccattcctccctgcccgaagccccagccctcagcaaccactgatctttttactgtcatcgtagttttaccttttcctgaatgttgcagagttgggaatcatacaacccttgtagcctttccattttggcttctttatcttagtaacatggatttaaattttctctgtgtcttttcatggcttgatagcttatttcattgtaccgctgaataatatttcagtggctgaatgtaccatagtctatttatctattcatctactgaaagacatcttggttgcttccaagttttagcaattatgaacaaagctgctataaatatctgtgtgcagatttttgtgtggacataagttttcaacttacttgggtaaatacctaagactgcaactgctgtatcttacagtaagagtgtctttagttttgtaagaaactgccaaactgtcatccaaagtacctgcaccattttgtgtttccaccagcaatgaatgggagtttctgttgttccatattcttgccaacatttggtgctgttagagctctggattttagccattctaataggtgtgtagaggtatctcactgctgccttaatttgcattttcctgatgacatatgatgtggagcaacttttcatattcttatttgccatttgaatatattctttaatgaggtgtctgtttaggtctctggcccactttttaaaaattgggctgtttgctttcttattgttgagttttaagagctctttgttaacttcatttttctcatccctacggtaggtttatcttccctatcttccacacacagtttttgtttaggtcaaatcatataattaaactgagtgcaggttacatattgctggattgtggcataaatatgaggaattatcaatattttttctactatttatatccaaaacacatatgcagtggtgtattttcagattagacactgttatattttaatctgtctatattttaatgttacagaataccttgcattatagaataacttctaaaaattctttttatgttatgtattagtccattctcacattgctgtaaagaaatacctgagactgggtaatttataaagaaaagaggtttaattggctcaaggttctgcaggctgtacaggaaacatagcagcatctgcttctggggatggaaggtggaaggcaaagagggagcaggcatcttatgtggcaggagcaggaccaagagagagtggggaggtgtcacacacttttaaacaaccagatctcacaagaactcactcactcgctatacactaccaaagggggatggggctaaaccattcatgaaaactccacccccatgatccagtcacctcccaccaggccctaccttggacattagggattgcaatttgacatgagatttgggtgacgacacagatccaaaccatattatgctatattccttaaatatctctgtttctgtttagtagtcacctttcttttacaaaatatttgtatttgtactttacccattcatattccttttggaaatttctcagtcttcctcctctttgccctcttttcttaaaaaatttatatttatgtacttcatatgtaaaattcctacagtaaaattcactatgagtttgacaaatgtatagagttgtagaaccaccactccaatcaaagtacagaggagtttcatccccaccaccttctgaaaagagtaattcttccacgtaacatgcctctgcaattttttaaatccaggattcatgttcttgctgttagtcaccccagaacagcaagaactcctcattagtcagtgaggagcaacagaacaagttgttcaattactttggagatgtagtacatgtttcttcaatttcttacagtaatttctactttctacatttagtatgtgctttgcacataataggtcttaaataaatattgatttactagattttacgtatctctctttttccacatctctcacacacacggacgctaagaaagaaattatctctctaagggcaaccatgggcaaagaatctggaatatatatacaatgtatatgagatctaacaaaatataaatggtatatttagagccgtttgagaaaggtatcttaaattggaaaaagattggggcttttggagaaccttcttttgtttggtagaggctataaaatgtctgtctcaaccaattttgtctcttgacacttggcgagcattgactttcctttcttatgtctgatacacagttagcatggctgttgtagcgctgagggtgcttttctcttccttcatctgcattttgcctgatgactttacaggagtgaggaggacctgccaattaactctccagttgagctcttcagctaaaaagcatattttatttctaaactggaatacacttactataaattatgatctccaactttacctacaagctagtgaaattaagatttaaaatgaaatcatgatagtcaccagtttcattaaggcatctgtactttctactccaatgcttggacctaaggacaatcctggcaagttacaatgtttactttgtgtgggatgggaccatagagagttagaagacttggctttgcatatggaatatattttcggcaatctctgaagccaagacaaaactttctggcataatgcaaacagagtaaatttttgcagtgtattttttaatagttttgaagtttttagtaatgttttagaaatgctggtgagcctgcctgagatgtgaagtttctttccttccagcttgctaaatactgattagtgggttccctttgtacctttgccaaggaggttctggatgctagttccttgggtgcatgaactcagctgccccatcctacacagcattaagaggtaaagcctgggcctcagatgtagggcttgatctttttttttttttttgacttttttttagaacaatttttaagaaaaaagaattgctgtaaaatctttgcccatttaagtttcaattgtgcccctcatgtccctaagagcaaaaggatccagtccaggatcacgagctgcactcagttgcaggcctctttagtcactgtcaatctgcaagaattcctcagtttccttgactttcatgacctcaatatttttgaagagtccagaccacgtattttgcacaatgagcctcaatatgggtttgccctattttgctgtgattggtcaggttatgcatttttagttggcatattccaggggtgatgctgtgtcccactgctcctggctgcctgctacacaaggctgatctgtcccatggctagtgaggtgatcttttttcccaggtaaagtggaaagtggtgtctgccaggctttcccactcttaagttaatttccttttctctctctttttttttttgaggatatattttgagaatctgtaaattccacttttcttacccacctgtttttgcatcttctgatgttccttgccagaattaaaaattattactatggcacttgccaagtggcgatttttctaattccatcattccttccatgtgttttagttggcattgtccagtaagaaagaactctctctttaccccattgacctatttatataaggaaccactcatagcattctattctactcaatgagttacaattcagtagggtcattatttactttgaggctcatgtcataccaagttgagccagtgggaggtccttcaagctggtttttgtgccttttaactcatgcctcccattctttgagcattttcctgcttcctgacaaaacaagatgttctaggattgccattctttcccagccctggctctagaatcagccatttctccaagaaatcctggctgctcaatacgctcatggtgattggggtgttgctgctctgaggttccctcatggataaagtaaaagatccacctctatttttgcttctctttctgcctataaatacaaaactaggagttcaactccacatctctaattccaatccaattacacagcattcatttagtgtttcctcttgccttatttgtaccgcccttcactgataatgagaaactcgacttactcattcttatgctaccttttcccttagtcctcctgtgtgcagctcatcttccaaggcctccacactgctttgctgctctgctcacatgctgtcttgtgtgaacctgccccacttcagctgccactttctgttggccccaaaccctaatctggtgtctttcttacaaaaaaaaaaaaaaaaaaaaaaaaaaaaagaaaaaaggaaagaaggaagaaagagggaggaaggaagagaaggaagcaggtacttttttgagagaccctgttccctttttctttcatgtgacatcctgtttgttgttgtttttttcttttttttcttttttcctaaagaacaatacattcagtattttgaggattcttcatttgggggctaaggtcttcttaacttagaacagtctcatggtctaagcatttatgcagacagcctgctgtcttgttaacactgactgtgctatcagccctttgactggagtgctgtgacccattctttgcattctgtttataacaaggtgttataggatgtcacagagcctgagtgtgaactagaattgactttttataacttatgtcttttaatcttccccttgtacgaataagcaaactgagagaccaagagaccaaaaaggtaatgagctgaccaaaatcagacattgaattttttttcattttgtgttggactccaaaattttctactctacttaccaacgtctcctgttctgtagtctccagggacacctcaaatcaacagcccttgtttcaaaggtgtgttgatggtgtgatagttctaggacaggctggataatggtcccccagcgacgtccacgtccttatcactgaagcctgtaagtgttacccatatgggactgtggcaggagatatcccaaattatctgggtggacttgatgtaatcaaaaggatacatcaaagggggatcgaggaaggtcagagaggaagaaggtgatgttatgatgaggcagcagttggagagatgagctttaaagatggaggctggggccattggccaaacaatattggcagccactagaagttgggaaagtccagggagtatattatcccttgattttagcccaggaaggcccatattaggcttctgacccccagaactgtaagatactaaatacattgtcttaagccaccacatttgtggtaatttgttacagcagtgataggaaattcatacaagctcctgtaaaataacaaatcttgctgcatgcattgtgttagcatgtcaggggacagccctgcccaagatcccatatttagagagcagttgctagtacctctagtgtttcgtatcatctaagttgtccatgtgttttcatcttctgcttccttaaaaaacaatcactttggggaaacagaaagagtacatcttatgtgacatgtaggtcaagtttggaaattcttcctctgctcaagtcatcactcagctgggttccattgtccttgtcttacaaaaatttggtcagcttcaaaaatttctctagcatctaagcaaaaaagtaccttgcactgaccatctccaggacacaatccatcaaactgacactttaagtgtagatcatatctggggtctcatgctgcttgacaacaccctttaaacagagaacccaaaaggatggggcataggactcatggctgagggactgatagcacaatcagtgtagagatgacactgggctgtcataaatgcctagacctcaaagctcttttaaattaaggagatgtagatccccaaatgaagaatcccaaaacttttgaatttactgtcccttgaaaagaaagagtggatacaccataggcattgcttttaaagcatatttttgttacattttaaattactttcatgctagttagtgtcctttagacataatttcatcatgtcttattttattcttatttactttgtgtgatgaatttacctaaaaattaatgactagtttgaccaacttgattgtcctttgacttgagaagcttgtaatttcagtgaaattcaaaacattagataagattgaaaagaatattctacttcttttgtatgaaagtgggaaggtgtaggtcttatttggtccatttgaattggcttatggcctatattcagttacaatgatagaaaataccaccaaaagaggaggaagacatatgtataaataatgtcattccatactaaatgcacaaacgcagcattcttcttaaattggaaagtgtagccaggacattagatgtttagcctgcattcacttcctgtgcagttgcctaacctttatttctatctcttttggaagattgtttatatgttttgatcaggacttttatactcttaataagaatatttttgcagtattttgcatctcctcataattgttgaaatgaaagagagtttacgtttctttatttgaattactttaaaaaacttgaagaacacctttcggtataaatagtgatttaaatattgctggaaagtatgtatcagataagaaggaatacagtgagaactcagttaacattgttgatgggttcttggaaactaagactttaagcaaaacaactttttttccctcatcaacattataacaaaatggcgttgaatgagatgacattatttgaggacctgctgtatgtccttttgctgaaagttgcagttgtgaacaacaacttactgatgacgctaagtgaggacttactgtaaaatgatgtaatgtggaaattctatgtccagaattcagtgaaatgttaggagccttcttgtaagttttctttcattaaatccctgggtaatgttctattctggatgttagggttacctgaaatacttgccaaggggagttttacagttgctgtctgtgtgattcagtgtgagaattataatgcaaaataacaaaggcaaagtctgccatcaagactccaaatctttgattacagtgatcagtgtcatattgcttttgaaaagagtaacctttatttgccctctctgttaattgggctactttgacattttgtcaaaatctcagagcctcccggacagcctgcctgcagttaaggtgagttgccacttgatggcacgcataacattctgatggtcttaggcttgcctttcactgttcataggcaaagttccagaattttcagacacattgtacccagatacttagtgccgtaccataattgattgtatctcctgctgatctgtgagattattgagggcaaaaactctgtccttattctgtttcctcctctaacacacacatgcccacaaatgtgtgcattcaaacatgtgcatatacattcacacatgttcatacacactcacacacacacaccctcctccccgccacatacaactatggccttttatgagaggggctagaaaaggaaaatttaaaaaggacagatgaatattgttatcaataatgccttagttatcaaggtatgcttcatataatcatagttaaatatgaccattaaatgaaaattccatttagaataagatataaaggaaaatctttagtcaatgaataattcttgattttcactatttctattgtttcctatttaattccctataaatgcactaggtgaagacttactgcactaagcctcagtgccctcatcttaagcaaggataatagtactcatctcatcagattgatctgagaattacatgatgaaacatagcacatacaccctactacacttactcatccttatctagctactgttgagaccagacattgccagcatgctacatgccaggcatcgtttttataactttatatataaatgcatttattgcttgcaacaatcctataatatgtcttatttatttatttatttatttattttttcgagatggagtctcgctgtcgcccaggttggagtgcagtggcgcaatctcggctcactgcaggctccgccccctggggttcacgccattctcctgcctcagcctccggagtagctgggactacaggcgcccgccacctcgcccggctaattttttgtatttttagtagagacgaggtttcactgtgttagccaggatggtctcgatctcctgacctcgtgatccgcccgcctcggcctcccaaagtgctgggattacaggcgtgagccaccgcgcccggcctcttatttattaccatttatcatgtgaggaaactaagttaaagagtggtaaaataatgtgttcaaggtcacatggctggcgcacactcagaaatgttattaatcattcttcttcttattattatttgcaatagtagtgaggtttacagcttttccttggagtcttactgagaatcagcaaagtgttatctttcacatgaaggtagctgcatctgacctttcactagtgctactcatgcagattttgctcagtaggattccatgcaaactaattaaccacgtgcggagatattgcatgcctctcctgaaggcttgcttgctcatggcttcttctttctggtgccttcccccatctttccctgtggttaggggctcctcaggaacatctagagacagtcaatccctttttgcttgtttagaggaatcagaatggtgaggttgtgtagagaaatcagaagtgaggcagggtgctcagtgtgggctgagatctgtatatgcaggtataggacttcactacccagggcattgggtgggaggtaccagctggatggacagtgacgctggcccagcaggagtcacttggagaggggccagggccagggaccaatatctctatggatacgtgcagaggaaggggtgatggaagcacctgcacagatgatgctaagggagagagtggcaatgcacagtgcctagctttgtgcatggcccacagagaacgttcaggaaaccttggctaaccacatgaataatagaagacttactgcatgcttccagagtctgtgcctggcactttacagccatcatctactgaactttaaatactgtgatcatcatctctgttttattaatacaacgaggcagccaacactctgcgtggtgcagtcctatgcctgcagacagagccggcccacatcttgccaagagtggaactccagcagttaggactgtgctgctgcagggcgatgtctccttgacttgtatgcttctcgtgaattgcccaatgtttattttagagattctctttccatcactccataaatccctgccagcgatccaggtgcagctcaaggccctcgatgtctccaccccacctcatttccctttgtgtctgcttgcacttctgctttctcaccttatttttgctactttagtcatagtatttggctttgaataaactgaggttggacttctgcctccactactaaccaagaaatgacttcaagcaagttatttgattaactaccttagtgacatcatatatcatagcccatggaaagcatacatttaatggggatttttatgtatgagatcccatctactgtaagtaaactgagcattgcaattttattgtctgattcacctctgaattcctaagatgctggtacagtgagtcacaaacttaagttgaattggatacactgtgttgctatctgtcccctccctgcctaccactgcctatgcatttgaccagcctccactagcccgtgagggtctgggagttcacagtcaagtttcattcatctttgcatcctatgggtagcctgttttgctgagacctaggtagtcttagagttatgccaattaaatggatggctaaatgaaatatatggggtgtgtttggcatatgttgtcacaaccggattaggcaattgaggcagaagaaaagaaatgcgatgtgtatagaaacataaaataatacatggcgtttttttttctccgaaaggtgtttttgatgcttttgcaagattccaacaagaaatctcacattgccctggggactgagtcagagctgcagaaccacaggcctacaggacatctgtctggctactgtaagtacagaatggcttcctgcatttctgctggaggaacaatgacaccagccttattcaacatcccttgttttaaaagttgtatagcaaggttctgaagttagtgaggagatgtgagtgtatagtgagggggcaagtaaatacaggtcagaggcaaaaaaaacgttgagttttatcctggcttgaaaaaaaaaaactgtgtgtttatgggacacatttatcttttcttcaggacttgacttagtatataaaaaatttctcaatgtatacagttagaataatgaccatcattcatcttattttaccttcatcacaaacaaactgatctggcctacctgcgtggtgtgcctcttatgtgcaggcaccctcctggtaatggatttgcatggtttaacaaagccccggatgtgggctttgccttcatgcgacctctgtccctttgggaccaaatcatggcttcagcttttgtatgcagcctcctttataggctttaatgattgaacagaatccagatttggtatctaggtgtgtgactgaagctccagttcagtccaattcctggcatatttattagcagcaactcagcaaggatccctgagctgagctctagggatgtggagggtaataaatctaagagctttccttcagagatttcagtctactaggcacatgaacccatgaataagtaactagaattaaatatgttataaccttttatgatgtttcccaaattgcatccttaccagcaactgtaggaattgctattgctgtacttcctcttcagctcttagtagtatcagatttgaaaaacatataatttagctattaaaatagatgtgtagtagtttctcattgtggttttaatttgcattctcctaatgattatgttaggcatatatttttatttcccacagctttattgagatataattcacataacacacaattcactcatataaatgggaccattcagtggcttttagcttcttcagagttctgcattcatcaccacaatcaaccttataccattttcattactctgaaaactggtgtcacttagcaatcactcctcaaaatccccatctcttcagccataggcaacccctaatgtactttcaatctctaatagatgtgcctattttggacattttatatacatggaatcatagtatgtgtggccctctgtgactagcttctttcactcagcacaatgtttttgaggttcatccatgttacagcgtgccagtactcaacttattttgattaccaaatatttcattgtataaatataccacatttttgtttgtccattcaccagttgatgggcatttggggttgtttccagttttttactattgcaaatatactattatgaacatttatatacacaatttttgtggatatgttttctcttacatgtatacctaggagtgaaattgctgaatcatatgtttcaatcatttgagaaactgctagactgtcatctaaagtgatcacaccttacattcccaccagtagtatatgaagtttctaatttctccacattctcccaacccttgttattatctgctgttttgattacagacactttagtggatgtgacacacaccttagtgtgtatctcattgtgggttttatttacatttcactggtggctaatgatgttgaatatcttttcataggcttcatggccacttgtatattttctttggagaagtcatattcagattttttgtccattattaaaattgggcagattttatttctagagctggaagaatttctaattatggaattgtgtgagttaagtggaatggtaactaggttttcataaatgccgtttatgaagttgaagaagtttctatctgttcttaattgtggagtgtttttaatcatgaaaggtgttggatgttgccaaatgctttctctgcatctattgagatgatcatttgttttttgtttatttatttatttatatggtatatttttggtttttggtagttaaaacaacattgcattcctgggacaaattctacccggtcatgtcatatattgctggattttattgtgctagtattttgtggagcatttttgtatctttatagcaggtattggtctgcaattttcttttcttgcagtgtctttggcgctgttatcatggttatcttcacctcatagaatgagttgagaggtgatcccttctcttctattttgtggacatgtttgtgaataattggtattagctcttctttcaatgttttgtggaattcaccagtgaaggcttctgggtctgggcttttctttgtgggtaggttttttaattatgattaattcaaatatttaattgatgtagggctattagattatctatatttttctcaaatcagtttcagtgttttatgtctttctaggaatctgtccatttcatttcagtcgttatgctattttatgttattggcatacaattgttcatagtaatcagttataattccttttgttttttaaaagtctgtagtgatgtttgtcaggcgtggtggctcacgcctgtaatcccagcactttgggaagctgagctgggtggatcatgaggtcaggagatcaagaccagcctggccaacatggtgaaaccccgtctccactaaaaatacaaaaaattagctgagcatggtggcaggtgcctgtaatcccaattacttgggaggcggaggcagagaattgcttggacccgggaggcggaggttgcagtgagctgagattgtgccactgtactctaccctgggcgacagagcaagactccgtctaaaaaaaaaaaaaaaaaagcctgtagtgatgtttcacctttcatttccacttctaataatttgagtcttctccgttttcttggttaatctagctgaagtgttgtcaattttggtaatgttttcacagaatcagcttttggttttattgatttttctcttttcaatttcatgaaattcagctctaatttttattattttgtttcttttacttaccttagatttagtttgctctgtttttccagtgtcttcaggtggaagtttgcatgaatttgagatctgttttttataattataaacatttactgctataaatttttctctaagcattgcttcagctgtaccctgtaaattttgatatgttgtatcttcatttttcattcatctcaaagtattttttaacttctcttttgatttctttcatttcttatttaggttgtgttgatttccacatatttgtgagtttctaaattcccttttgttattaaagtcccatttcattttattgtaatctgaaagaaaccagaatgggttcatatttttaatagagatgggatttcaccatgttggccaggctggtctcaaacttctgaacgtgggaggtggaggttgccttgagcctagatcatgccactgcactccagcctgggcaacagagggagattctgtctcaaacaacaacaacaacaacaacaacaacaacaacaacaacaacaacaaatctcttttcaacttattaaggcttgttttatggtctatgctggagaaagttccatgcctcttgaaaagaatgttcatctgttgtgataggtggtgtgttctatagacatctgtaatatttagtttgtgtgtagtggttgttcaagtcttttgttttcttgttgatattcttgtaaattattttatctgttaataaaatttgggtattgatatttctgattattattgtagaattgcctatttctccctttaaatctgttgacttctgtttttatgtctttgcgggctctgttaggtacataaatcatcacaattttatatcttccagatgtaagccttatttcatatcttttatagtcttctttccttcttgtattcttcctggtctttttagacagtgctggcactatacctgatgaagcagttttcgcaaacactttgtgaaaccttcttaggtttcaataatattcatccattagacaaaagccaggtgtttttgaaataacctcttctgtattttttggcttctacatagatggcagaggggaccacaccacaaagcttcctagaggtcctctggtttggttgagtagacctgtgagacacacttgatcttttttaaaattttttaattttacatacgtaacaaacctgcacgttgtgcacatgtaccctagaacttaaagtataataataataaaatatgtgtatacattatatataacccagttaaagaaaacaagtaatgcagttaaaaaatgatcaaatgacctgaatagatagacatttctcaaaggaagacatgcaaatggccaacaggtatatgaaaaaatactaaattaatagtcagcagagaaatgcaaatgaaaaccacaatgagatataaccttatatctgttagaataattaatattaaaaagacaaaagataacacatgctggtgaggttgtcaagaaaaaggaactcttccatactgttggtgggaatgtgaataagtatagccattatagaaaatagtatgaaagttctttaaaaaattaaaaataaaaccaccatatgatcaaggaatcccattacttggtatatatccaaggaaatgaaatcagtatattaaagaaatatctacactctaatgtttattgcagcaccattcataatagccaagacatggaatcaacctaagtgttcatcaacagatgaatggataaagaaaatatggcatatgtacatagtagaatactattcagtcttaaaaaagaagcaaattctgtcatttgtgacaacatggatgaacctggagaacattattttaagtgaaataagctaggaacagaaaggcaaatgctacataatgtcacatatatgcagaatttttaaaagttgaaatcatagaaatggagagtagaattgtggttactaggggctgggaggggatgtggtgaggagatgttggtaaatggatacaatatttcagttatataggagaaataagttcaagagatctattgtacaacatggtgactgtagttaataacgttttgtattgttgaaaatctctaaaagaatagatgagttttctcatcacaaaaaactatgtgaggtattgcatatgttgattagctcggtttagccgcttcacaaggtatacatatttcaggacatcatgttgtatatgataaatataatttttatttgtcaactataataataaacaaataatagtttatgacaggttaaaaaaaaaagaaataaaatctaccaagtgtgcattcaaacacatacatgtaaaatatctttggaagggtaaaaagatgctggtaatggagtttgcctctaggggaggaaactgagtagctgaaggattctatagcccccttgagatctttggtagatttgcactatgtgaattttagcaactgaaaataattaaaaaacaaagaaaaataaaaataagtacagtactcaaaaaatatttttttcatctaggacgttttttggtaatagaaaatatcaaatggaaaattaactagcaaatgtgtttttatatatgataaatatataatataagtacatatatttatatacatatatatttatgtattatatatgatatatatttttactgtggtaaaatatacataatataaattttaccattttaaccatatttaagtatacagctcagtggcattacgcacattcacattattgtgcaaccatcatcatcatccatttccagaacttttttatcttctcaaattgaaactctgtaccaattagacaacaactcctcatttctccctcccccagctcctggaaaccaccattctagcctgtgtggctgtgaatttaactacctcatataaatggtatcatacagtatttgcccttttgtgactggcttatttcacttagagtaagagtttcagggtttatccatgttgaagcaagtgacagaaattcattcttttataaggctgaataatattccattatatgtatgtatcacattttgtttatccatttatctgttgatggacatttgtgttgctttcatctttaagttactgtaataatgctgctatgaaaattgatgtacaaatatctgttcaagccccctgcttttactttttttgagcatataacaagaaatggaattactggatcctatggtatgtttgattttttgagaaattgctgtatcattttccacagtggttgcaccattttacattcccaccagcctgaactagggctccagttcctccatatcttcaccaatgcttgttattccaccttttaaataataatcatcctaatgggtgtgaagtggtatctcactgtggttttgatttgcatttccctaaggactagtaatgttaagcaccttttcatgtgcttattggccattagcatatcttctttggagaatcctctagtaaggcctttgcccatttttgaatggggttggtttttgttgtggtggtgacttgtagaagttcgttgttttctggatattaatctcatattagaaatataatctgcaatttttttctctttccatgggctacctttttactctattaattgtagtttttcttgtactaaagtttttaattttgatggaatttagcttacctattttgttgttgttgttgcctgtgcttatggtggcaaacccaaaaaatcactggcaactgcaatatcctgaagttttttcctgtgttttcttccaagaagtttatagttttagcttttacattaaggtctttgatttattttgagttaattttctatactgtgtatggtaggtgtccatttttattctcttgcatatggatatccagtattccccacatcagttatggaaatgactttttctcactgaatggttttggctcatttgttgaaaaccaattgaccatatatgtgaacattttcttctgagttctctattttattccattggtctttacgtctgtttttgtgccagttccacactgttttgattaccatggctttgtagtaacctttgaaatcagaaagtgggaattctccaaatttcttcatatttatcaatattgttttagctattcagggcctcttgggattctgtatggattttaagattaatatttctttttctccaaaatgtcattagaaactttagaagaattgtattgattagtttagatagttttgggtggtattgatatctcaaaaatattaagttttccaatccatgaacatagactatccttccacctgtttgtgtctttttcattttcttcagtaacattttgtagtgttgagtgtacaagttgcttgccctcatgattaagttaattctttagtattttattctcttttatgttattgtaaatgaaatgattttcttaatttctgttttcagattgttcattgctaatggaagaagtgcaactaatatttgtgtattgattttgtatcctgaaactttggtgaatttgtttatgagtactaacattttgtgtttatgtgtatgtatgtgtattttttagagttttatacatgtaagactgtcatctgcaaacaaagataattttacttcatccttttcaatttggatgacttttatttctttttttgcctaattgagctggctaggacttccagtgctatcttgaatagaagtggtgaaagtgagcatctttgtcatattcctgatcttagaggaaacatttttagtctttcaatattgagtacaatattgggtgtgggtttttcatagatggcctttattatgtttaggtagtttccttttatttctagtttgttaagtgtttttatcataacaaagtgctgaattttgtaaaagttctttatgtgtcaattgaaatgaccataggttttaaaaattttatccttttaatgtgtggtattaacttgacttttttttgtatgttgactcatccttgcctttcaggaataaatcctcccttgtcatgatgtgtaatcattttaatatactgtcaaatttggtatgccagtatttgttgagagtttttgtatcaatattcataaggaatattagttggtaaggttttttttttttttggtagttcctttggcttcataactcattctgtgaggctagcattgcctcatacaatgaattaggaagtttattctcctcttcaattttttcaaagagttctaggaggcttgttgctaattctttataggtttggtagaatttaccagtgaagacatctgagctttatttttatttttattttttggtgggaatattttaattattgattctatctcctcactagttataggtttactcagattttcaattgctttttgattcagtcttaaaagtttgtgtgttttaggaatttatccatcttatctaggtcatcaaatatgttggtacacattgttcatactattgttataatctttttgtttccgtaaaattggcagtaacactttcttttctgacttcagttatttgaaccttctttctttttttcttagtcaatctagctaaaggtttatctattccgtttatcttttttaaagaacaaattattgacttcattgatttttccctattgtttttcaactttgtattttattcatctctgctttagtatttactccattatttctgctagggttaggtttagcttttttcttcttttcttattttttaaggaatcatgttagaatgtttacttgaagtctttcttctcatataagagaagaatttagagctatacatttccttcttagtgctgcttttactgcaacccagaaattttggtatgttgtgttttcacttcattcgtttcaagatattttctaacttttcttgtgatttactatttgatccatttgttattttgactgtgttttaaatttccacatatttgtgaatttttctgttttttttttctgttgttgatttctaatttctttccactatgttcagaaaatacattttgtgtgatttcaatcttatttaaaatgtattaagacttgttatgtagtataacatgtgatctatccttgagaatgtttcgtatacacttaagaaaaatgtatattctgctgttgttgagtagagtgatctgtttatgtcatttacgtacaatagttctatagtgttgttcaattctctgtgtctttgttgatagtctatctggttattctatccattattgagagtgaggtattgaggtttcctactattactatagtgctatttttcccttcatttctgccagtatttgcttcatatgttatgagctctcatgatgggtatctatgcatctctaattggtacgtcttcttagtgaattgactctttttttaaagggtcaacataatgttctttgtcttttgcatttactttctacttaaagtttattctatctgatattagaatagccacccttctgccttttggttactatttgcatgaaatggcttttccatcattttacttctaatctatgtgtatccatagacttaaaatgtgtctcttgtagaaggcatgcatttggatcctgatttttagtcaatgctgccaatctatgtctttggtttatatattatttatatattgctttcctgattttctttagttctttatccatgttttcctttagcttttggagattatttgacagttgctttaaaatctttatgtagtatgtgtttcttcagagactgtttctagaaactatttctccttttaatgggtaagatttccctgtttttctttgtctaaataatcgtttgttgggaactgtgcacttgataaaatagccacttctcctaatttttgcaaattggtgtggaatacttctgctaattagtgatcccctgggtcttgagatcagcctggggtaacggcttatggtcttcatagttattttctgggcatgtagcctatctgagcctgtgtaagtgtgtgcttttgcctctttcttctgatgttccttggccactttcaaatgccttagtttttcagaaagtctcacctttttatcccagtgcctcaaatgttctaatgtattcccctatctataatcttttgcctcaggcacccatacgcctgcactcctcctttagttttcatgtgctctgttgcccaccaaatgccttccatggtttccaatcttagatctaaactatgctcttattcttgtgtgcttgctgaatcaggtaaaacagacactagtcctttgggcactctacaaccaggcaagaattttgaaaacgatttgcactttgctctttctgccctgaaggagagatcaggaattgagccatttctttgaccccaccaatatgggaagaggtgagcaaagtcaagtaaaacaccacagaatttttcctaccatttcaatgtgttttgtttgtttgtttttgattgggagtttggttggttgctatagatcttagactaatttccagagctcttgtaaagttgttttagtcagtctgtagttgtttatttagtgtttccatagggacaggggagtttggacttcctaatcagacatcttgctgatgtcactctatcctcttaatctttttagggggccaattttctgactaaatactggcattttgtgagctttttgacgtttgagcagaaggttctgtaatcacatactcagcctttttttttttctgccatgttatcaatagcttttcttgacttttgctaccttttcttttttttaacctgttgaggctgaaacttatcaaaattttaccagtttctttactgattttttgtttacttgtttgcttaacatttctttcctcattttatcgctctcctctctcattttactggaagttccagtagaaaccaggcagcaccttcaattcttttttggaaatctccttagctaaatatccaactttgttgctaacaaattctgttttccacataaccacataactgcagaagacaattttgctaaggtttttttttttttttaaaaaactaatgatctaaccaaggaaatttaagtttcctctagcgtgattccaaaaactctttcatccaaacccattccatgatttcaagttacccttacttttttaatatttgttatgtcacttctccatttccagtttccaaaatttattttagttttctattgctattaataaattaccatcaacagaacagattaaaacaatacctatttattttctcacagtttcttttggtcaaggggctgggcacagcccaacaagttctctgcttaggatctcataaagctgaataaatgtattattaagagtgcatttttatctagagctcaggggtctcttccaagcttgtttaggtctttggcagaatcagttccttgaggtgcccattttttggctggctgtcagctgggggctgctctcaattctgagaagtcaccctcaggtcttagctatgtgataaaatgtttacaagaatctaataatcatattttctttaaattctctcttacatataaaagttattaaaaaatgtatctcaaaggaaatgaatgctagaaattaaacttaggcaaaatgctaataaccgaaagagaaaataatgtgtatgtccagttaaaataaatcttgacataaacagtatcccaattatgatatatgcaggaggatattactacatagaaattagataagcaaaaaatacatttatagaattaacaaacttttgtaatactatataattccttttacataaagctcaaaaacaggcacaatcatactaaagtgatagaattaccctttggcataaaaaattttataagagctctgtcagaagtaaactggaagtttacttcttcaaagtgagcaggataatctgttttgattaatttaaaggcaactgattagcgttcttaatgagatctgtaaaatgtcttcacctttgtcatatgacgtagtttaattgtgggagtgacagtgtgtattcagggtctcactcacactcaaggggaggggattgtacatgggtttgagtcattgggggccactttagacttcttcctaccaaaacagtattataacaagctaaactgaatttccgcaacttgagcctctcttcatatttattagccatttgcattttctctttggtaacaatgtttttccttacctttacatataaattacatatttatttaagaatagtgttctaaatttattttcactaacataaactgcatacatcttatagtaaatggcacagatgttaattgtacaaccagatggatttttccatggtacatacctgcgtaaccaccacccagattgagctagaactttcccagtacttcagcaggcaccctcacatcctctccaggtcaaatccctcctcacaagggtaattgaattactttagaataattgtgcctgtttctgaactttatataaaaggaatcatacagtatatatagaagtctgtgtttttttctaagtattattttgtctctgaaattcatctatgtaattgcttgtgtaatttctatgtagtaatattccctgcatatatcataattggtctctacattctaccgtttatgtcaaaatttatttaaactggacatacacattatttcttttttgattattagcattttgcctaaaggtttaatttctgagcattcagttttaaaaaatattagttaacttttatatgtaagatcgaatttaatgaaactatgattattaggttctcataaacattttgttatcgtgagaagttagaataatttatgttgaagatgtattgcctatatatatcctctatataggatatatatatcctctttattatgcttatacatctgttttagaaacgataattttatgttctgaatttggagaacattattaaaaaacccatgtaaataatttggaaataaaacacgtgcaataaaagctaatgctatatgaaaaagagtgatgttttgaatttaagaaagaaccctgaagaaagaaaacttatgtttttattgccattataaaatatgacataaaaatgtaattttagttatcattcaaattataaatctgggaactgaaatgtatattatttaagaatcaatttaagtatttcattaccaaataagaagtaagtctaggatgcattaaaacaaatttgatatgagattgcctacatttgccaattttattatattcttcaaattcctcctataaaactccacatgaggcctcaacctaagtccagtttatgttacttagtagatgtaacttaatcacaacattagctcaggatattggacacagtgtgcattaatgtcttctaagtaaagtgatttagttgctttttgtgttgtgtgtgtatgtgatctacactagagaaattcaatttctagaatagccatttacaaaagcctttctcctcctattggtgccctcaaagattactcttttgttattgattcctactcctgggctgcacctgcctatgggcaccccttctctctacagatgccatatgtcttcagaaatagttttttaagggatagctctgaaataactcactccttgcttttctgagggattgatgaagacaaaataaaatataaaatatatactttttaatcatagggaccctagtagctccgtagaaatgagttatgaagaccgatgcctgcaactgcacttttgtccttgtctctgcaccgcagagtgtggaagtcacttcttcatggagaaagaaactatttattagctgcctgaagtggatcggacactatgataggcactttacatgatttggattttctcacttcatcattacaaccagtttgcaaacagactttcatatctctgttactggatgttatagagatgtgatttggatttctgggcagtgttgagagccctgttactaagaatctactatagagactgcgaactctaaatgataaaaatgctaaccttactgcgaaaaaaatgaaaactgtgcgatgagtaacaacaaattagcatggtgaaacctacaaaagaactgtgtgctaaatgttggaggaacatgtagcacagagtaaataactgctcagaagagctgagaggcttccagaggagagactgtgtaaacagaggctgtgtgagtgctgtaccatggccagtgcccatggggccagcttttactctagatcaagtcaagtggcatgaacacacagagtgtcccatcccactgccgagctgctgggttgaggaatcaaccagtcaaactctcacgttgcccatgtgtaagcgcttcaagaaaatgacttccccagttgtattatgacttccccaagttgtagttgtattggcagcttgggctgccaaactgccacagactgagcggcttaaacaacagacattcatttctcacagttattttctaaacctctaaactgaggtttagagatgttatctgatttgcccaaaccctcacgaggttcagcatgaaactctcatccaggcacaatgcctatatttatcctctttcttatggttatacatctgccattgcagtccctttgggtccttttttaaaataattttaataatttttattttttgaaaaggcttttccaaggctcaatatacataaatcattgaatttataatgtttagtatatattaactgcttagtgtaatgtttagaatatacataaatcactgaattaactagtcagcttcctgagaaatttagtgatctcacaactgaatgatgacctggagagtttgttacaacacagattattgggtttcacccccaaatcttctgactcaggaggtccaggatggggcctgagaacttgcatttctaacgagttctcaggagacgctgctagtccatgcatcacatctggagatacactgccttggtgtgatggaaaaagaattctacttacaatcataagttatggggctattctctcttttattggccttctagctgtgcgctggtggtacggactgaactgtgttccctgtttgttgaagtcttaaccctcagtacctcagcatgtgactatagctaggactttaaaaaaggcaatgaggactaaatgacatcaaatgggtggatccttataagaacaggaaatgtacgcataaaaagagacaccagggatgcacacacatagagataaaaccatgtgagggagaagaaagccgtcggcaaaccaaggagagaggcctcaggagaaaccaaccctgcccacaccttgctcttcttggtgctgacaactgtgagataatgattgtctgttgtttcagcagctcagtctgtggtagtttgtttggcagcctgagctgactaatacaactggggaagtcacttccttgctgagcttacacatgggcaatgtgagagttcggctggttgattcctcaggccagccacttgacaatgagatggggctttctgtgtgttcatgccacttgacttgatctagtgtaaaagctggcccccacgggcactggccatggcacagcactcacgcatcctctgtttacaccatccctcctctggaagcctctcagctcttctgagtagttatttactgtgtcctacatgttcctccaatatttagtacatgcttctctcacaggtttcactttgctgatttgttgttactcatcgcatggttttcagtttttcccagtaggtttagcatttttatcatttggagtctgcaggctctatagtagattcttagtaacaggactgtcaacactgcccagaaatttaaccatgtttccctggccaactctcacttcttgtgccaagtcaatttcaaatgtcccctctcctcgtgcctccggttcctcctcctcccactcccattggaggagggagttcctgcctcagaaagaaaataagagtgaataaatccatccacctcccaccctctcccacctgcatcctctttccttcctgttacaggaggaaacaccctctttccttcctgttacaggaggaaacaccctctttccttcctgttacaggaggaaacaccctctttccttcctgttacaggaggaaacaccctctttccttcctgttacaggaggaaacatcctctttccttcctgttacagagtagggccctcttcctaggtgaggctgatttctttgccaagatgaatcctttcccacctttgaaggaagaattcattgctctctgttttcaatgcctccccctgtcctgaatctttctcactatggattatacatgctcatggctcttcttttgctaaagacaaagcagcataagagaaacaaaacccttccttcaaatcatttccctccagttgcctccatagctctctcccctttacagccaaacttctttctcaagagttgtggagacaagctgtgacttgcatcgtcgtctctcacttgagcctcggtcaactcagatatgtgccattttcccaccatcccactcaaaaggcctgttttaatttcactggtgaccagcacatcactagtttcaaaaggcatcatcctttatctctaagctgtatccagcatcctctttttgggcaaaactttatttctttggaccctatgacacatcacttgttttcccctgagtacttgtcttcacctcacctcctgcttcatcctgaccttcatctgttagagttctaccatgctcaggcagtccctgagctctcttctctctttattcttctgaggggtcattttgtccctaactgaggtttccttgttcccatactgctgctcatacatctggggtcagctcagatcacctctcttggctcttggctataactgcctgctgagcaactccattctaacgcatcccaggtacctccatctcaacacgtttaagtccaactcatgattttaacccagaaaactttcctctggctcattcttggtcttagagaatattgctgctctctacctagtttacaaaccagaatgtcagagttattcatgagccttttcctcttgccctccatatgtagccatccctagattccatcagggcatgctctacactgcagccaagtctttctttctttctctctttctttctttcttttttttttttttgagacagagtttcactcttgtcacccaggctggagtgcaatggcgagatctcagctcactgcaacctccagctcctaggttcaagcgattctcctgcctcagcctcctgagtagctggaattacaggtgcccaccaccatgcccagctaatttttgtatttttagtagagatggggtttcaccatgttgatcaggctggtcttgaactcctgacctcaggtgatccacccacctcagtctcccaaagtgctgggattacaggcatgagccactgtgcccggcctagccaagtcttaagaataagtatttgatcacattattctcactcccaaatatttaatggtttttcatcttctgggactcaaattctgctcatggactcctaagatgatagaaggattggatcctgactgcaccttgtctatgccagttggactcctttcagtttcttaaacagatcaagctccttcttgcccccagaatctttacaacagctcttctccctgcctggaatgctgtctactctttcccccttctctgagctaatctttgttcattcttcagtacgtgatttatttgactcttctgcagagtcttcttcaacttgccagaccaagttacttccctcctgataaatgctcatgctcccctcttatgcttcacagaacctgtggcaggttgtatttaaatagctaattgcaagtgtttaacatctttgcccagtgaaagaatgcaaattcagtggagctatctcgtgtgtggctgtatttctggcagggaatgcagtgtctgtcataataaacctggaatataggtttcttgcctgactaacagaccagctgaatgagaagggacacctgcatatcaaggcaagtggtaaccacttggccttacctgggttctactctagggcttctggaatccatgtatcactgcacatatctggcctttgcgggctctgtcccacctacagagtgaacagtcccacagtgttggccacactgatgtggccaactgatgtggtcccactgatgtaccattgctttggttactttgttcggaatgtagttttaagagaaggggcctttttaaagaaagtttaaaaatcacctgggtacttagtaagatggcatattcttaggcctaactttcacaaatttggattctaaagacctagacatttacattaaggagcaccccaagttccttgatttagatggtctgtggccactactatgagaaacatcctgttagagtatctttaagctcaaagtttatgtgaaagatcacaaatctatctaatactgagtgatttggggagacatgattgttttctttatataatgctttgtcatgccctttaaaaaaaaaaaaaaaaaagaaaccttattccctgatgtgagacctgagattgcatttacattttcagctctatgatctgccactaccactttacatacagttctgttccttttttctcccacaatttaattctctgtatttcatttctaattactgcttcttctgatgatggaaagcaattttggcagtgattaatttgaagggtctgcaacctctcctttgctttttaagacaattctatttgcacagcccatcctatgaagggctagtagaactctgcctcttcagagggctgttccaaattttttgggtgtctccaggcttaaccatgatgctaatcctagagtgctgtcttttcttctttaaccaaatttcctcaaatttcaaaaaccaccttccctggaagcaaggtgggaagggacatggctgctgccaattatgcaggccaaagaaagtttgtgttccacattagctaaaagcagcagaaagctaatggcagggtgctttgcagaaaagagtctgccaaaataaaatggaattgaaatagatttgggcaggataaatgctggtggcaggtgccagaaagcagcaacttctgtcagaagcagtgaaaagagaagaaagtgtgtgtaattcttgcagccatgcagatcagagctactaaataaacctcctgaggttaatgataaatagttccaaacctcatctcctgtactggaatatcatattcctgtgagatatttaacaaaagatgagattaactcatcttaaatgcagtcattgcctcaaaagtgggtaatgcagacaggactagctctgagcaactttcactaacatatctacctccaggaagctaaggataaataggcccttgaaagcatcttcaatcctgtttcaacacccacctcctcacgggagcctaggagagttgggtagggcatcttgaactggctccttcaattccatcttcctccctactcccataatccatttctttctccctagtggatagagatacttgggaatactgtgagtagctgcatttatctctctttgaaccatggtacaaaatcatgactttactttgttaactactttaactttgttgtttttaactctgaaaatcatgttgcaatgaagccccattaatgacttgaaaactgctcctgaatgaggcccactaggcatggctgtcaaagttgagagtgaaatcaagaggttaaaggaactgcagaggtggtattaggttttctgaggaggggaagaatggacccaggagagagagaagcctcacctcaggaaggcaatacatagatagggatgctgaatacaatatttggtcaatatccatccattcaatcacccatcagaccttactgagcatctcatttgggctggggagtgagattaaagctgaagatattgagatgaatttaaattaagctccactctttctggtttcaaggacctcagcgcatatgaagaagacaggtaagtggaaggtgataggaacagtgagggagatgaacattgggctcaggttgaagagaagatttgatagtagggaaatttttcttctttttttcagctatatttattgaccctcacttgtgccagatgccaccgtaagggctcctacttgcattatcatcactaacttttccaagaggagctgtctgagccagacttccaatgggcagatgcctgacaacagagtccacatgcctgcctgcatagaaccttgcctcccaaatgtgaccaaaatagaaatcagagagcagggttaaggctgagatcataattatggtgcagcaaaattatctctcgccctaaccatcaatgacaaccgcaaaggaagctcaggtttggaaactcaagtgtgaagctgtttagagactgcaggaagacctgtctttggtgcatatttagagtttaggtgccttgaccaggtagtataagccctttagtgatactgatgggttcataccacccattcaatatccctgattccctgaatgtcaactcactgtcttttcagtataggtttaatcaaaagtgtttcagcaacctttattcaaaaatgtggctgggtttaaggtatgaccttattcacaagtgaaatactaatttgatcttttgacattttggctattacaatcatagggcattgcaaagaaccaaatcaatgatgaattagccacataggaattggaaattttaatggcatgacatgtagcatttttcttttacctatattgtgtttttttaagaaaaattacatttgaaaaagcagtatggttgttataagaaataaacagataaagtatcacataaattgataattatgagattatcaataaaacagtttagataaatattgcctccacttattagcttctttaaagaattaggcttaatattgattttactttttaagaatatatttaattaacctagctttatttatttatttgagacagagtcttgctctgtctcccagactggactgtagtggcgtgatcttggctcacggtaacctctacctcccaggttcaagcaattctcctgtctcagcctcctgagtagctgggattacaggcacccacaaccacgcccagctaatttttgtatttttagtagagatgggatttcaccatgttggccaggctggtctcgaactcttgacctccagtgattcgcccaccttggcctcccaaagtgctgggattacaggcatgagccactgtgtccggctcctagctgtctgtactgccatgtttaataaataattgtttttcaggttttatgttttgttagtaagcacccacatgccacaaaaacattcttttattttcttttccttttgatttctctctattccctttcctatttcctctctccttccttccttcctttttcttctctcctctcctcttcccttttctattcttctttaaaaataagatgtttgattttattggctctctacttggggaaacaaaaatgttttgaataagacaattcagtaatggtttggataaatatcatacagctttatatataccagaacaaagattgaagagtaccctatctaacagggaagaaaattacctgtccaaaatgttcagtgtattcagggttagccagggctggaattcaggcatcctgatgctagagtgtgtgacttcccctgtgagacatttacaaagttagtacccatcttaatggtgtctgcctattgaattagaagtatatttcccaaggaaacctgtagcactgttaaggtttccatgcagctcacctgattctatttccctgacttggtgagacagatgcaatgatttatgtcttttcatgtctgccaattattctgaaatccagcattatgactggggtcagcagaaaatagtcctcataccatttctgtaaccagcttagcatatttctgtcccataatccatgtctttgcatgagattccttctatttcttcacactctggttaccctccctacctgtcacaaacatgtttttatttttgaattgctggcattggctgactccttgaagaaacttcctctaatctgacattatgtatatttcactgtgctgttcaggtttcactgacacgttttgtttacttgtttgactctattacaagaccaagaacttctcgaaacccttcttcaaatagataacccagcacctagcatagcacttgcactagtaaatactcactgaatttaattccccaaatttaactcatttcacaacctctcttgaactggatttatttataaataaatgaaccttttgatctacattagttcagagagccatttcagcactagaattctgtaactcactgaacagagaattttactgtttctatctcataaaatcatgctttatttcctgaataagtgtacagtctttacaaagtaatttatcgtttacaagatgattaagtgttcagtgctgagaaaacccagaaaattgtgaagaagaataaaagagtcataatctcaccacaagaatataaatttttaagtaggttaaaaaatgcttataccaccttcgctttttaaattaaaaccttccattttatcaaatggcatgtagggtttatgaattattggataaaatgcaacttttcactaaaagcatatcaaaatattattttttatagtttaatattagtagttttagcaaattatcttcattctatatgtattactttgcaacatttttcatctgatatatgatgagtgtcttcctataatttcatatgtgatgttttaaccctccctcattttttggttaatacacgctgttaatacttgggtcatattccctctcccactcattttactgagtcacctttcatgttcatttttcaaaagactgtataatttcatcttaaattgctttattcacttacaaaatgtaataaacattctctatgagtatttacctatactattaccttaagcagattaatgtattttactacatccttgtattgtaatttgttcagttaatacctacacattaaatacttgtttcttgcctcttgttattatattcttttttttttttcttttctttttctttttcttttttttttttggagatggagtctcactctgtcacccaggctggagtgcagtggcgtgatcttggctcactgcaacctccgcctccctgtttcaagtgattctcctgcctcagcctcccaagtagctgggattacaggcatacaccaccatgcctggctaatttttgtatttttagtagacacagggtttcaccatgttggacacgctggtcttgaactcctgacctcaggtaatctgctccaccttggcctcccaaagtgctgggattataggtgtgagccatcgcgcccagcaagatgttataaatcacctggtttatgtatgtgatgaaattttattttattatttataataaaactcttgtattgagataaagcagatcaaaggcgatctgtatttgtctccaacagaaagactatatggacctgttctcccaccaggaatgtataagaagatccgtttccttaaccctcaataatattagatgttaacattatctttaatctttactatattgattagtttaaaaactaaattattgccttggattacaatatttacatattggctattttgtaaatcttttattaactgtatattcctgaacgttgtgtgcccattttcttttggagttttcatcttaattttactgacttgaaagcattatgtttgtaaagctttattataaaatcttcaagaacacttggatgaactgggtagtgtggagatcatattcttggatgcttgctgagactttgatatttaagctatttctcataggtgttaatgtttgaacaattgcagccaagtgaccaaaagaaaaattctttggacatttttcccaagcaatttgatggtcaggataaatgggaatgcatgattatggatgaaactagagtccttgaatataattgcactcataagtcaaagaaggcaattcataacaatttggcccagcattttaattttgtctgttaaattattcatgcgaatactttcatgagttaagccatgaatatttgattggtggttgattcataaccataaactatattagccctttatttttctcatttatgtccaattaacatatacgggaaggtggagaaaatttattcttcttaatatgagaaacatctttccccacagacttatcgaggctgtctgatgaacatttactatgactccgggtcaacattacgtttattctggcagtttaataactgttctaataataattctcattacatagagggaaaatattacaaatctctactttacaagtgaggagatgacattcagagaggttaaataatgttccagaatccacacgatatgttggtggctgagattagattcaaatccaggattaaaaaattgaatgttccccaccccacagtggctctgatgattgttctcaatgaacccaggccagtgtgcacataaatcaccactctctgagtctactctattccttttctgttaccagagctaattgctaagtagatatccaatacttgtttagtcatgtcagttttgtatcacttaacaaatatctcttctgccaactaagcaggtatttacagccatttccctgctgtacacaaatatgagaaggtgcacagtttggcaggtggctaagaatgggtggctagatgtgaatgtcaaaagctgctacgtaaaggctaatttgtaggttgtgacatttggtgaactgtggctattcagttccttttaagcctgaacaaagtatggcattttaccttgtcagagaaagagcttcttggtcaaagggctgtgaagatatcaagtaattatttcagtaattacttttagaaatccagggatgggcacccaaaaacatcccagttattttagcttgagttagagaattcaaatacttatcctaataaatatgcagacttaatagaattggtgttatccagcactataacctcataaaatcatcaagaagagtgtatatacttgtatgtgtgtatatatatagatagatagataggtagagatataaaatttagtttaatgacatacttttttcctagcaatataatctgtctatatgctgacttaataactgctttatgagagctgtatatggatcaccattgataaatgcattaaatcagtggttccatagactggctgagaatttcaatcttctgggaagttataaaaacacacttttaactctgagtctctggagattgggatttttttttttttttctgagatagggcctggcaaccagcatttaaaatgttcccaggttaatctgatatgcagcctggtttagaaaccactgctttaactacctaatgcctcatcctcattagaactttattcattaaaattaaatactaatttgccttataatttggaagtctaacatgtgactcagcccaagtgactactgggtttggaagtcttctgtccagcacaaaccctgaaatccttaaaaatgggtgtgcaggtctttcttgtcttggtttctgatcacttttaactctcatctcctgccacttgctacacggatgtgccacattctgtttccttgctattcacagagaatgccaggcctatttatacctcctgttttgatctttagacttccacattttcttgtctgcctgtaaactcccagggatctcaaggattctacctgaacgtccgggccgcttggcctgtttctcactttttcctcagcatcccaaggactcactccttggtaccgactctttccagcctgacactttgttacagtgtgctgggttatttctttacatttttatctcaacccgtatgttggggacagaaaccaaagagcccagcgcctgcacacactgggcactcagtaaatatcccaaatgaagttttctcagatatgcatttttatccccatgacccctctacaattctgttctcaatgctgtgacaaatgatgtctctttcacatggtacagcttctttaaaaatgttctcttttgggtcttcaaacttgtttgctgctctctattaactgtatttcagtttggtgtttgtgagcagtacaatccgtttagtacatctgttctttataagactgcctttcttgtgaaatacttcatattggattttctggagtactttagagtcaatcactgggaaaaactatcaccacagctgattgatccggctgagtcctgctttggacgtcgtttaagactgcagtccatgggctacctctgtctctgctcccagcttctcatccacccagtggacagaaaagctgctctccacagcttgtttggaacgtgcaacctcaactccaggagatttactgagattcgttggtagaggctccaaaggatcactcttgagggagcgtggccggatgatcagtagatgaatgatgcacagctcacgctttcctttcgaattttgcttgtggatcgctctgatagctgaggatgttttcacattcgctgcgtcccccagagcagggaagcgggagcagggaggcgcagtgggcaggcgccgggctctcctatgccctgcggggaagtggaaggcgccgggaggagcgggggcggggtgcagggacggtggaactgaggaaaagcaggccgtggggttattccctgaatgaatcccgacccacacataagctggggttttcccaggagagacctggagttaagaacagagaggaaaaggatggtgggagagaggaggaggaagcaaaggagcagcccaggtgtgtcgtccgctctaagcgcagcggagctcacacgccctgctcctgccacgcgttgccacgaggcttcctcttgcattgcagccttccggcccaaggcccagcttccgcactttaggtgcataaaggggacactcaagggagtcctcatggggtgggcctgcgtcgcattcccatggctgcgagatgccgcagggtcaccgagagggcaaacgaggcaaagcgctgtcacctccgcagagctgacccagccgcccttcctcccgcccgtcctgcaggtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcaggtaagttgtttttgttcctttgatttcgaaattatgtcgaggcagattatgaattgcaatagcttcgatacttttgagaattctagataaaaactggaaatataaatgttttcattatttccgaggtctgaattcacgaggagatccttggagaagctcttgctcctctcaggctgtctcagggcaggcgcttaaggctaatgaggctgcctggtctccgaatcctgagcccctgacccctcctcatggtggccgagtccctgcgcgaaagggcgcaagctgtcacccgccgacctgcagagggcccagcacgccctgccccacaggagggcgggatagactccgggatttgtaggattctagaacgtattagatatatgtggtattttcacaaagccctccacagttgtttctgggacaacagccccacagttgcacacacctctctgcggagaaacgtatgacagcacggaagggatggaagccctgagcctccccaggctggggtcaattgagcaggatctgttgccggtgcgttcagaagagcctgggtttttgccaccaaatgaatttacgcaagaactcagagctttctgggttgcagattcatacacaagggttgggaacctaagatagaaaccgatcccctaagttcctttgccttagtttagcgggctcctctctagattcaggagaatctgtgcagagtcagggaggcccggcccttgccgggcacggccatggctgtgatccagacatcattacattgaacatgcaaaatcgtcttcaaggtggctacaatttttcacatttgggatggggagacaaatgactggaactcagtgatactagtttacaactgcacaagcatactggctaggcttttcaacatgaagacaactaagaggacagtgtcagttctgcttttgtcaaatatatatgcttactaaaataagcagcttaaccagctaatctctaagagcctactaatatgtgtgtaatttttgtagtgatgtgtaatttggaattagatttaaacaaatacatggacaaagtaaaaatctatggtaaactcttcagtttgttccctccttgtcacactcctcaactataaaagggctatcactattttgagtcttttgattataaaatatgtttcttgaagaaaataatacaaagcacaggctagccaaaaaataaaataaaaaacaatcacatgtaattttaccagagatatctacagtaaacctactgggataatctgccacatgatatacataatacttgtatctacatgcatttgtatttgttatcacaatgagattacactgtaatactctctgtaactcttttacactccataatatctttgtatctcttcttataaatcagtacaaccactttactcatgaaaactacagtaccctgactactgaatggctctttagtagtatgttgttggaggcacattaatttatttagacagtctctttttgggggcatataaaggtttatttatttgttttttttttcctattataggcaatgctgtataacaatctttatttagttagatttaggtgactatctacttattcttaccatcagacatttctattagaattttggggggcaaaggcatcagtatttttatggtagatagtgccaaattacccttataaatgtgtgccaattaacagtcttataaagtcattgattcttttcttcaacaaatatttatggtgtacttactatatgctagctactgttctaggtggtagttatatgtataattagaacaaaccaaaacccctagttttgtgggagaaaggaagttcagttctctaaactctaaaagttttgatagttcagacctgatatttcattgcttaataggcagctctttgattactattgaagttgaatattttcaaagttttttggttatttaaaattttactttacatattgaatatattaagcatcatctatatatatataagtgtatttccacatcatattttgcttctaactgacttcttcaccctcctcccctctctcaactttaccgcttatctttttcttctgagaccgctgagaatttcccttcatggtgtttatttcactgataccattttcagttgactccagatagccattcactttctctactgcattgttaatttggcgattatgtttttcatttgaaagcatttttcctactctcccagtattcatttgttatagaagtgatgcacttcaaaattattttgagtctgagaattaagatattttaatattttcttctatttctaagagttactattttaaattgagatattggtttgttctcatttttcataatgttacttaacttatgaaacagagacattcacatgtctggaggtttattttctcatccttacaaaggagtcctgcctacacaggctatcgtacctgttccatcagtgattgcaagtgccccacttctcatggttaatttctgtctaaagagaaaagaacaagcttacattttctcagtttttattttagtagagtggtagtttagttagttatgaggaaaaagtaaaaagctaccaggaagcatccacattgatggaacattttcttgcttttttgttattatctctaatgtttgcagtgatagtcaaaaattagtgggcgagaagaataactatcatcatttgatcattttatgggtgctataactgctcttgttaggaattctccactgacattcattacttttcttctgcatactggatcctctctgagtgtgtaccttgatttctctgaagacaacccctgttgttttgcatttgtattaaacttgcctctttccactctcaaaagtgccctcttatgagtgataaatgatgtggccattccttcgttattgaatctgagcaccatgatctaaatcttggcacaggaatgattcaaaaggggcccagattttcacatcttatagtcctcctgactccctgtgtacacaggccacccgtggtaacccagcacccatccttgctgctccaaatgtgggacaaccccattttataacatctgtgagcagtctccttgggaaggcatataagattgccattacactccctctctttctccttagggtaactccctgttgatagatgcataattcaggcctgcatgtggctttcaaaaatcatgaatgcattagctttgtgctgatttggaagatacatataaatcttatcttattagtgttctgacaattctcaatagagccccatgcttctaaaattttagagttgagaaaatgcaattatatatctacattaaattcactgaaaatttcttgcagaatacaaatcttcataaaagcacaaaccagaagaaatgcactagagaggttcttttctacctgaatccttctacaaatgaagggaacagatgacacccccacagctcatagagggtttgagcttcttgggcccaaacaaacctggggctttggcaactcagtctgcagtgttctccaactcacatgctttggtggccaggtagggagtgaacgcatgacatccacagggctgtaaagatgcttgttttgtaaccagacctccacagcacattgactttatagactgtgagggaggaggagaagtatggagcatgtctgtgttggtttggggtctggtcagccattcatgacccaggcttctgactcagttttgttctgaatcaacttgctctgattgctgttttgagagtgctccagaaattctccctccccactaagaagtgtgagaaaagggtggcagggcctctgtgcctgtttagggtggaggcgagcagcacagagcagccccagagaaattagaggagggtggtgcatctctgagagatatagtgtgaacacagctgcacctgcttgcagacatctgaggctggtaagacctgacggacctgctcaaaaccttgagcagctccatattgcccaagggatgatattgccacatcttagcatatcctacaggtcctcctggtgcctctgcagcctctgccactccctttatctcatgctctgaacttcagaatgacacaatcatacatgatgttgctgcatctctccctgtttaaggaaatggaaactaccttcctctcctcagtcctctgccactcccactctatacactctaatgttcccagcaaaataagaatacttcaaaacccggctcagatgcccccttccaaggatcctctgtgcttgctctctcatctgaatgtctgtcattcctgtgtggatgtcactgtggcttaacttagtgcgggagattcttgcctttcttcctacagggagacttcctggagcttaaggatcaagccttctttatatctgtacctttagttcctgccaacatgtctataaatgattactttcattaaatccttgttaaattgaaataatgaaaatgaaatgtatcaaaaatgtcttccagaaattaacttggacaggcagcagacaaacaaatggagcatagaaagacagctctctacacattaaaaatataaaatatttaggctccatgacctcatcttctgggatggggctcttagtccttactagaggagatggtcctaaatataccactagttcactgcattagaaaaacccgtgagccctccttgaacatggacctgaccctggcccactgtctgctgagtttgttcctacccccaaactctctctctttttctcctagttctccaactaggagacctagaaaaagacctagaaggagcaagtgtaggactcccaagtcctggttgctacaccagttctttaagaacccaagagggccagtggatgtatgtggccagtcggtgcccactgtcaccatccccttctcctgttagcatgccagcagaaactgggtgcgttttttagttttctagggctgctatagcaaagaaccacaaactgggttacttaacagaaatgtattttctcactgttctggaggccagaagtctgaaatcaaagggtcagcaggaccatgtcctctctgaaggctccaggggagaatccttccttgtgtctctagcttcagtggctgccagcgatccctgacatgccttgacttgtggcagcatcactccagtctcagcctcctgtcttcatgtggccttcctcctgcatgtctctgtgtccacatttccctcttagaaggacaccggtcatattggatatggtacccactctaatcctgtatgaactcatctaattatatctggacaaactcattccgaataagatcactttctgaggttctgagtgggcatgaaatttggagggaaatcattcaacccacaacatttcctacaacatcttccttaacaaataccactaaatttgaccaatctcttggccacttgcctacagtagaatcacttggtgttctgtaaaactcaagcttttctgctatatgcagaaggataacagaaattaaattaactgaagactgacagtgattgttggtgtatatttgttggtgttctgtcatctcaaaaacatccaccaggttttgcaaaatggtcaccgggatgtgataaatgtatacttcatgatccagtgatgttaacattcatagagaacatcttcaattatttatattcttctcctcatatatgtacaacttccttctatgtatgtggcatctttatcacatgagatagtagtgattgcttcactttgtttcagtaattcagtgagaggacgaatggaaagtaattggacaattgtttggaagaaatataatgaaagttatttttcttcttattcttagtaaatactaggatggacctaatatatcatctgtgcttttgagcgggatggagaggatgtagcacactcaccagcaggctcttggaagccttttttctggcagaataacatacaaagtgctggctgcccctctgatctcatttcctggtttcccttcccttgtctgcaaggtccgccttcacaccaggcttcgtccaggtcatagaacatccaaactctggaccgactttgcatgtccagttggataccccaagagcattcttcctctcagtcatggcacagaagctgctttctcaatgtaactcgcccatggtccttttacagtccagtgggaaaaaacagatggtaaatgaaatagctgaaactatttgcttgacttaattatgtatacattgtatggggacaaagtccagcactgagtaggcatttttaaaatgtttacccatgagtgaatatatatccttcatgctctacccaaccatgaatttaggatgtacttcatggcccctcaccctgggtgaactgttcttcagctcagcccacctgagattcagtaatttgtgaattgctggtagtcgtacctcttagtgggttgaaatttaagaaaaaagagagagaatccctgatgacgacattctcattgtggacagtgaactcacagatgttgggtgaactcctcagttggcacaacctagccaactagccaacaggactgagaatccatttcaggcctcctggctctaattctcattccacaaacacttacaaggccataagttctaccctgagaaagtttacagtcaagcagagaaatgatccctacaaacagatgggaaagtcttataggtagatacttggtgcaggggttgtgcataagccacatggggagatatttaggggtgtcaaagaaggttttttaaggctatgccccctaaattgcttcttctgagataacaggtgttttccagacgtggagaagagaaagtttcttctcttgtactctctctaaaggaagagtgtgagtaaatgtgaaaagtaaggcaggaagtctagcagaagccttgatggtttctggcaggtattacggtattataaggcattctgaggagaattgacattatcttgcaaacacaatgcagggaggcattaagaagttctaaagtctggggagtgatatgagggggattatttttgtagcttccaggtatgaagtcttatttggagcagtctatctgagtctcttcccctcataggtaactttttctgtctggaattgtgcaagatttcttctttatccttggagtaaaggattcccccccccctactgtttccttatcaaaactgcagatttaagtctttttttcagttcagggtaatttttttggggggtgggggagtacagggtctcactctgttgaccaggctggagtgcagtggcgtgatcttggctcactacaacctccacctcctgggttccagtgattctcctgcctcagcctcccgagtagctaggattacaagcatgcagcaccacatctggctcatttttgtatttttaatagagacagggtttcaccatgctggccaggctggtcgcgaactcctgaccttaggttatctgccggccttggcctcccaaagtgctgggattacaggcgtgagccaccgcatcctgccagttcagggtaattttcttctattattaatctaatttcttcacacccatttttcctttacctccttttagaactcctagcacatctcatgttagggtcttccaaatccatcttttaattctttatctttccttaaggatttctttttcctttttgtcctccttctgtgtggatttttcttatacatcactgtttgtatctaaacagtggctatcctcttactcaatttatacctctaatattatcttcaggaaaccattcttcttggtttgagaaagtcctgtgtaggcatgtgcttctctgtttttttgttttgttttgttttgtttttaattttaaagtgtgtattcctgcagcacctttatttttcataaatattggcactgtttgggtttttctctggttgctgggaccccaggacatgtgtttgttattgctgttttgacagatcagataagtatgttgcctatcaactggacgaagttccgaatcaaagcacattctgcctctgtagggcagcagctgggctgccagtactttctgtttttttcagggaggtggggacctttgcttcctatactctctctcatttaggaatagaaggcatcagctcctttaattaagctttttcttgactattggggtccagcgagagaggggaggctgaggtctctggagatttgcaggtctctgagggccacacctcccaggatgggtcctttctggtccttttccctggatgctctgctcctgttcttcacattgcattcatatgtggcctggcctgtagagatgatggccctgaatttgcttggctagtagcaaatcccatagagcccaagacctcacctggaaccagaaatttatcaacaccaaaagctggttggatcaggagaggtcgaaagactggagctgagagtgtagggaaggaaggaataaagaaaggaaaggaaaggaagggaaaagaacggaatggaatggaatggaatggaatggaatggaaaggaatggaactgaacggaacggaacggaaaggaaaggaggaagggaggaagggaggaatggaggaaggaaggggagagtgtaggctgctgtcttcccagatgccccagtgtttctcaaggttggtttgatccttgtctaaatcagaaccactggggggacttgttaaccaggaaggcccattaggagtgtgtatttgttcagccaagctccttgggtcactctggtgcacaataaattttaagagatgattattagagagagtgattccatttatgaagttcctcgagaatcataggtagtaattttcaatttctagagtctagtaaggacagatgtcaaatgtttctaacatagagatttactttaaaatatagccaggagtttgaaggcaacaaaagagggatagtttaggaaaaagcatttgaagtttgtggtgacaaagatacttttaaaagaagcttgcatttcctaatttgttagaaacctgaaggctgtttatacagaggtcacactgcctacttatgagacataactttgttgtaaatttcagcaagttccatcattgtgtgtttctggccacagctgtagggaattatattaggacagttgtaaaccatacgaatattttaaaatctttattaaattttatgcagtggggaagatagtgtttttctgtaaacatttatttctggatttggatgccacagaggtgtttgcattttaagttgctctggaaacaaagtcctcctcagcagaaatataatactaatttaatgtaatgagttgcatttcttctcaattaaattttgtttttgtttgaatggtaaaagttcagaaagggccagatttagggaagtaaaataattggatggagattaaggatgaggccaatgaattcagtgcattgttaacatatcacaacttggttcgacacatcatttatgagaccctgagttccaacacctatcctaagcattgtgccctttcctcaaggattgcttcattccagtaatgagaacaagggtaagcctccagttaaactccagtgaagatgtatactaaggccaccaggcaggacaaatggagcagaggaggcagggaggacttattatggaatcggtgttccaaccaaggtttccaggccaggctggagatggcttccaatcaagtgtccaggatattggagataccgagacagagggatcagcaccctcaaaagcagatctgcccaatcaaacagtggttctcctggtctgggctgcgctggctaggctgggctgggtgccgtgctcaggaagaaatggtgagcaacaggccctaggattgtggagggattcaaatactatttcaaaacgcataggtaacaagaagccattgatacattttgagcaaagaaaatgtcagattggtatgttagaagagctcactaaaggaattagagaaattgggagtctgtaatgttccattctatgtgtacggtcacactgaacagtagcctaatgagaagtttcttctcattctgagcttacgtttgttctgcaggatgtggttggaaattcctacatttccacctcagacctttctacattttaatgctaatagcaattcagaaaaatattttggactcaattatttcttgtctgagaacaaaaaattaattagagaaatcagtggttacagattgctctgtggttgcttacatttcttctttctttttttttttttttgcattttctgttttaaagcttttttattgctcataataattatacatatttatggggtacatgtgatattttgatacatgcgtacgatgtataataaccaaagcagggtatttaggatatctatcacctcaaatatttataatgtcttactttgggaacatttcaaatcttctagctgttttgaaaataggataaattgttgttaactacagtcaccctgctgtgctatcgaacactagtacctatttttttttataactgtatgtttgtacctattaaccaacctctttctctcccctattcttcccagcttctggtgtttgcatttcttcaatgtagctaatgttttaagttctttaaaaggagtcacttatgtatatttgttaatttatataataattctttccaaaaagaattgaggtcaccaggtatatctatataatctataatgctgattatataccatttttgaaatttttgagacaagtgtttgcaaagattcttactcaaaaagtattttataaataatgcaatgtaagttctgaaaagtaagaaatctatactcttttctaaatactaatttagaattttaattaattaaatgagctcattctcattcagtccaatttagaaaatcttaaaatgtctttttctctacattttctcaagattgtcttataattgaggtataaaatttaatacagggtttgtttctacaactccccacagtgacatgaatagtgtcttattgctgatggtgtcttcagtaaggaaattcagtattggtggttttggctttcagtaatgctgcttgaactacaaatagacttctgagatgtgtgccagtaaaatttaatgtgtacttaaagcacacataggattctgtgttgaggacctctgttaagaaaatgtagctcaatgtagctcacatatagaaaccaaatgatatttcttacattagaaattgttttatttcaggactatgttaatagaacaaatattcagaccaaactggagctccaactttaagagcatagttttgcagattttaatatattaacacaatatgatattatgtagcctttaaaatttgtttttaaaaaccatgtaaatatgtgaaaaatggtggtgttatattaagtgaaaatgttgaggaaaataatgtactgtgaatgtgagtctataaaaatgcatatctgatggcaaaactatacttgtaataaattttccaattttattgcttgtttggcattatcataaaaacagtggaaaattagctgtatctcacttactaggaatcattagatggatcagcctgactagggcacaatgtgaggtcagcagctggttctccattctctgttgggagccactaataatcccactttgtttcctttgtctcacaatgaacagcagcagtgggggcgacaacttggacctcacccgtgtgcttctgcggaagtttagagatcaagatttgccctgtgcagatttaaacccacgccagtaagtgtcaggtgctctctgcaaaagtgaacactcccaactggtaatattgtagcctgggaggactgtttttcttcatgattggttatttcatgtcacaagtttatgttataaaaaatgaaaattagcctaatgactaggttattactgaatgggccttatgggtatcaccatataaaatgatccgaaataagcttcataattaccccctttctcccttcgtacatgcatgctttatattattgcaaaataaattaataattaacagcattcaatttgtttaataaaacccaaagctgaaaagaatgaagtaggaattaagtctgaattatgtcttagctattatttacttttagagaatccttgtacatataaaaaattaattatatatttttttaacttaaaagacttaaaggtcagtactgtacatcaatctggggtgaattactttgaaaatgatctttttggtatttaatcatggttattgtgatgatctttctatgaaacctggataggggaggcctttctttataaacacttatttccctcttattttgctcaattgttatatattgaagatctactacaagcaaagtgctgctgtaggaaccaaaattaatacggaatatggccctggtctcaaggaatttacagttctgggtagagcaaatgaggcaaatgataaaagccataatgatttattaagtgccagaagtgtatgtttttaagtagtaaatataaaaatctaacaataatacaatattggcaatttgttttctaatttgcgatgacatattttgcccattagtcatattggtaattagtgtgagactgaaaaactattaatgttctcagtaagaaagaattaatagataattatgctgcttcactctagtctttgcaaaacaaagtaatttatttaactaaaacttcaatggtaatgtttctatttttctcctctctgatggaatacacagggtgtaaaatatgtctacctttgaaaaattgaaatgtaacctagggccccatggggtccagccctggtccaagctgggatcaaagaagaaccagttagaaaaaaaaaaatcttttatctagtccttctccttccagaggaaaaaaacaaaaggtagaatcaataattaaaggacagcagaacgtattggacattttgtttggacacgtattttacttccagttccttttacatgggttgcagtagagccccaaactctcctcctctcctctctctgttccatgagctcctgccctccagcccagcctgcagatcagcctcatagcttttctcctctgtccgttcttcttctaccttcctggatttatgtttttgtgttctcccttttctttgtgaaatctacctaatctatccttaactcatttctatatttaatcatttctatctatttttgtggtcagcataacaaaagggtaggaggagaggtacatgaaaagatgctgtgaacacttgtattaataataatttatgtccatgttatacaaatagggcttgattcactaggacctcaaatcagagcaaaaagttttacttaaaacctgtagatttccttctgtaagtgtaaaatattgttgaatttgatgatatctacattttacctccttggaagacttgggcaatcacttgataattaactagaggaaacattttaaaataatacattagattctactgataggttgcttttctgttgagatactcagctctgagtgtcaactcaatggtgctatgttgaacttctgatttgtacctccctctcatacgaagacaatgaagagctctagaaaaatccactgttgtctaaatccgatctaaaatatgagttttctcacagtagtaggtgatgcataatttaaaatttaaaatgtgttaaagtagtcaacttttagtagctgacgggtagatatagatatttagctttattttacaaggcttatatctggtggcacttcagtgttgaattctcctactatttctaacacaaaatggtcactttcctcacccattcttgttaatggtttagtacagaacaaaagtcatagcaaatcttatatttctatcaaacttaaaacgccaagtggggagatggataaggtttatttttgtaattaaaaagaaagttattagatagcagtgatacaataaatcatctcagtactcaggaaaatctagaaggctcattattagccaaaaggtgggatcttcagagcctgtcatggctggtgacagattccctcttaggggcctgtaaagaggaaagttgaggccatggatcagcagtgtagagaatgtgcataccagggatcatgatagaggggtaatataggaccagtcttcctgaatccaaatctcagctccactcttactgactgtgtgacccacgcaacttgctgaacctctctctgcttttcttcatttgcatcagtgtgctctcagttctatagaaagaacagtcacctcaatggcagggtagttcttgtagagagcttttgttctcttaaggcaagttcctgcctcagaaagcaactctcaagacaggaggtccttagagcttctgcctctgtcttcgagatttaaaatgcaccttagcactttggggaggccgaggtgggcggatcacgaggtcaggagtttgagaccagcctggccaacatggtgaaaccccgtctctactaaagatacaaaaaattagctgggtaaggtggtgcgcacccataatcccagctactcgggaggctgaggcaggagaatcacttgagcccaggaggcggaggttgtagtgagccgagattgtgccattgcattccagcctgggcaacagggtgagactccatctcaaaaaaaaaaaaaatgcaccttaggtgattgaaaactccaggcagccctgtagtagagagaactatttcacccagtgtgtccaaacctgaaggaccaaatgaccctcctccagcagcctctctgcagctgtgtcctgtaggccactttagggaaatgctttgctaagtcaaagtgtatttttcgattcttaaactttaaaagaaaaattatgtagaaacttctgatttctcatagatcatcccctctgtctctcccttttatgaacattcacacagcttcttagtgaatctgtttgaacacaaaacttgttggaggctgagaagtgctcaaaaaactacctgtcatgggtcattatgtacctctcatggacacctagttttactctataaaagggagctaggagaagaataagggaggatttggaagagaaaaagaagactttttgaagtcatatattaaattataaacacttgttaaccatcatctaaggcatctgaaggaagaaaggcctgctgagtttcagaagtataaatggaattttttttaaaagtacatatcagatacagtactctgattaaatacgtaactctcttaggtgttatttccatgtaaactcttaagtttcaaactggagtccctataagctagtcagccaacaaagtgtggagaaatctttacgttatttttgttgtttcaaaaattacgtagacattgtactttgctaacctggttaatagaaatggcaagtttcttttcactgggcaaggctttcttcaattggtgttatcatactggctttctcattggagcagcacacactttgcatagagctgggatctcgacagctgcttcacctctctggaccccacctcttcttctgaaaagcagggctagtaaggatggtggtaaaaatatctagccggtgcttgtaattcggtaaatgctagttttcttcctccttttccaatttttgagtaattaagagtaattatcattactgaaacaaagtttgatttccaaatgctagaaaaaatattttaaagtatgggactcataaggaaatagaaatgatagggaaactgtggaatacaaatgtgtttttgaaccactgctacaaatggttttcataactgtttctgttgcacaatctttctgcaacagaaagtttaaccaaaaaggtttaaagaggaaatttaaaaattgtttttccttaagtgattattgaattactgtgtcatgccacaaaaaggaattgacgtcttgctgtttattaattgcttcttggtacctgtttatgagactgcaagcctcagtttccaccaggagccccagccgcaccgtgaaagtcctagggagccctgtgatacactcagtacagtaagaaaagtgagccccatgtaatataatggaaatgctggcgttgtaataaaacattgtcatcagattaacagctcaagctgtgaaaacaaatgtaagagctctgccttctcggcagtgggagatgattatcttgtgaactctgttctagtctgatgaaactctcttttatggaaatacaatggctttgtaaatctaaaagatcattccaattctctcctttgttttttaggaagaattcttcatgctggcgcacagatcccttttctcacccagaattccaggattcatgtggctgcctggtaggtttctgcagcatttttgatctttttaagtctaaaattcaagtgacaaaaatgagtttaccctatctataaaattttcatatttgtaactgtgtctttataactttttggtttcctggattagctgtttctgggaaaagttttgtcacataaagtgaatatttatagaacacagatgctgtatagattgacagtgcccctctccttcattgccttctgcctttggtctttaacattcccctggcattcattaagaaaatgactattcttcaagtaatgataaagaagctagaattgccctaaggaaggaaatttttctaaatttcaaggcagcatgacctcaaggttcttgccatatttttatttgggctagatattaacagctaagatgccccttagctctctgactatggttgattcttacaaaaacatgtggaagtaggtgtgccactattgaggtgagagacatcactgtctaatctgtgaaggagaataaattgaaatttatttggaaaactgattggaactcatctcaaagaaaatctcagactctaattaataaaaggcatagacctgctagccacaatcaataagcaagtatgatgacaggtctaatttataggaaaaagggaaaagaaaaaaaatattgaagttaattgagcatctgtaatggaaatggctatttggagaacgtgtttacagggccttcctagttagtggatgatgagatgcaattctccttaatagttgtcaacctaagggaagaaactgagacaaattaatataggtagagagtttatttgagccaaagttgagaacagctatgtgggacacacttccaagttatctttggaagtactctagagaacaaaaaagaagctcaagtgaaatggccttattgtctagggtgtcaaatgaagttatttgtctcatggccaaggaagtcaaggatgtggacacaccaagagtgagcttagagcagaaatgtaataagtgaaagaaagagagaaaactctctgctgcagagagggatctcaaaaaagcgttgtcattttgcagtgaagtgcaatagttttaataaaaaaagctagcagggaagggtgctccatttatatagggctcaaaaaaccggttaggactaggtgtgtcatttccataaggcacgaatccctggcagtccccaccccatctgtttagtgtacatgcaggtccttagcctaagttactccatattgcttatctcctcctactgtgcatgcattaggggcggaaccctttttattaatccattttcatgctgctgataaaggtgtacccaagactgggcaattaacagaagaaagaggtttattggacttacagctctacatggctggggaggcctcacaatcatggtggaaggtgaaaggcacttcttacatggcagcagcaagagagagaatgagaaccaagggaaatgggtttccccttatcaaaccatcatatctcatgggacttagtcactaccatgagaacaataagggggaaccacccccgtgttcagttatctcccattggggtccctcccacaacatgtgggagtacaaatcaagatgagatttgggtggagacatagagtcaaacaatattacccttcaaggtggatgtgcctggcccaggctagctcttcttatctatagtgttgcagccatgttccaagcaagctccccgtgcaagcttccttatgtgagtatgtcgaaaaaggaaaggaatgtgctcactggggcccactgtatgtcagtgaaacttgctgactacacaggaggcccctttctgtgagggaattcatctccccatctatgtttgcagcccgaactttcaggctgctctttgttagaaaataaatgccgctgaggaccttgccctaactatctgcctagccagtttcttccttccttctctctcataatttattaaagaaaaaagaatgaatcaggagagtgggtggttacaaaagtcgtttgtcagggattctcactggcattgttaggttactttatagctctggtggtggcactcagcctagggtccatatagcgagctgcttagaaatgattgcttagcccaagggggatggggtggagtgtgactgctatctcactccagtgcctctctgggcctgattatttaaagggagctcacattcctcagataaaaagtttttttgtttgtcttttttctagagattttagaagccttgcttttggaggaactagtctgctttcttctcttagacgaaagatacacatgtaagcgggaatagtgacacagtacgcttagtgagcactcagagtgttggttgatatgggagaggttttggaactctccatgtttccctcttggccccagctgtcaataaactcagctacatttggtgatcctttgcagtgatcagttatctttttttttaaatacataattattgttttttttcccctggtcttgtttttccatttattcactttaggggcaaagggcaaatttccctttcaccctctgaagcttcactgaaaatcagttgacaaaaggcaggttaactggggaaataccatacaaatgtgtgaatttgcatgggaggatcacatcacagagtaattaccccaaacccccaaagaggtgcagaaatttctatacccttttcataggggaaggaggagatgggaaatgtggataattcttttagggacaggaaatgattgttatagagaaagaatgggccagggagagagaaattaggttctctctaattagatgattagatgattagaaattagatgattctcctggaatttgagtgagcccgaaagtcaggcattatcttgtgaaaaagtccatccaagcatggttgcattcttcacacttcttttctgaaatagataatgagatttcagggaggggattgaggacttatgtgtttcctttggtaaggagttttttggtcagatatggaaattccaaagagaattggaatggaggaggaacaagacaaggtttcagggaccttgattctgaggcttatttctgaggcctttcaattgataaaaatgcccagcatgcacaaatgccatattttgggggattgttttctatgcctcagcactcatgagatctctgattttttacaccacgctcttattctctagccttgatttgatcattctattatagtagtggcttttagtaccaccagctacctaaggcctattgggattagagtgggtaaatatcagaatgattggtgtttatgttcctaaattcacttcaactcacataaactatgagatttcagtaatatgtaagaaaaaaggttttatctgaaaaagttccatagtcaaatacgttttgcaaatgctggataaagcagtattaagcaggtatctttgccacagctcttctaagaagctatttggtgataatgaaattgtccttgaattgacagtggagtagatgcagcattttctgcaaatttgactgcaagagtccttcccttttgtggcagcagtgtgtttcgggatgcactttgagaaatgttggaccacacgttagaaatcagagaacctcaggagacagggagttgaggtggaattaatgaaagtcctaagcaatgggtgtggctactctttggggttgtctcaaaggagacgtacacaaagctgtgtggaaggaaggcctatagacccaaggccagttctctggtctttagtgttcatgttgagccaagttgactgtgttttgttagaaggaaaaatatttctcttcccttaaatacatgtgtgctatccagcagccctgggtctgcaagagcatgtcaatttaatttttttttttttttttttttttttgagacagagtctcgctctgtcacccaggctagagggcagtggcgtgatctcgactcactgccacctccgccttctgggttcaagtgattcttctgcctcagcctcctgagtagctgggattacaggcatgcgccactgtgcccggctaatttttgtatttttagtagagatggggtttcaccatcttggccaggctggtctcgaactcctgaccttgtcatccacctgcctcggcctcccaaagtgctggggttgcaggtgtgagccaccacgcccaacctgtttcctcatgttttatcaaatatgctgtggctgtctccaaacctacaaaaaggttccatggttagtccttctgaggatgaaaacatgatttggaagcgacaccgttagaaaaggcttaaaggggaacaggaattgagctaactctaaagaacaaacagggatttttagggtctgagctccagtggataacaacactatgacccaaaacatgtcatcgggactgagtgtggctttatacagaataggtggagggcatatttgtttcttgtcgctgagataataaattatcacacagttggtggcttaagaaaacatgagtttattctcacacagttctggaggctggaagtctgaagtcagtgtgactggagtgaaattaaggtgtctgaagactcttgaggacaatctgtccttttcctcctccagcttctcttgtttctggccttccttggcctctggtgacattacacacatctctatctccattgtcacagtgcctcctccccttctttctctgtctagtcctcctctgcctccctctcacagtggcacaggttgtaaccagcaaaagggcctggctgctcgctgcttgtagaaagaggccaaaataataacgagctgattaaaagtgagcaagacttttttatatgtgccagcaaggggaagagcagaaagcaattccgctgtaatttgtggagggaacacagggttttttaaagaaagggtttggaatgcagaagaggcaggggtggtaggttgggggttggggagcggggagctaggaggtcccaggaggggttacttactccaatggttcatcttgaattattgtttcatttggtgaagaggctgaccccatcgtggatcctgccaggttataaactaatcacaatcttgtagttagtcttcagccgggaatgggttctggccttgaagtaatcttttgttggggacagattttcagaggtgtctagtcctctgaaacttctaaggaaatatatgaccaggtaagtgagcatggcatgtgcttaacaagcatctaggtaaataaatatgcataaggcatgggggcatgaagtgggaaaggaaagagaaagaaaacatttcgaggctataagtttatctcagagctacatcttgaaactcggaggggaaagaggaaaagggaaaggataaaacattttaaaatgttgtttgaggctaaactgctaagcagctcagttacaaggtgagtgcatgagggtgcactgtcacaatccaggataatcttctggactcaagatctgtaacttaataacatcgtcaagatacaaagtagcatttaaagagtccagagatgagggcctgatattttggtgggggggcggtcaatattcagtttaatacagagggtgtatttggggacacctacacggataatggttagaatgagaccaaggatattttctcatgatcattaaaaagtcaggaaacaacaggtgctggagaggatgtggagaaataggaacacttttacactgttggtgggactgtaaactagttcaaccattgtggaagtcagtatggcgattcctcagggatctagaactagaaataccatttgagccagccatcccattactaggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaataatgagttcatgtcttttgtagggacatggatgaaactggaaatcatcattctcagcaaactatcgcaaggacaaaaaaccaaacactgcatgttctcactcataggtgggaattgaacaatgagaacacatggacacaggaaggggaacatcacactccggggactgttgtggggtggggggaggggggagggatagcattaggagatatacttaatgctaaatgacgagttaatgggtgcagtacaccaacatggcacatgtatacatatgtaacaaacctgcacattgtgcacatgtaccctaaaacttaaagtataataataataaaaaaaagaatgagaccaaggatattttctagtagacctgaattcttgataataattggaattttttttagcaagaaaatcatctaatggaaaacaccattttagaaggatgtatcttgataagtatggggggtggtgaagtgaattggagagaggaaagctggaggtagggaaactttggaggttgttatgttcatcaaggttggctgatttatttatttattttaattgagaagcagaagttatatatatttgtggttacagcatatcatatatcatgatatatatataatacataaaatgatatgatatatatacatatatcattatatatacatatataatatttcatttatatatagtatttcatttttatatatatcatatatatcattttatatatatatatatataatcacacacacccattatggaaaggctaaatccagctttttaatatatgcattacctcatgtacttattgtaggggcacaggaaaacttgcccttcatcctctgtaagtttgctaaaaaatcaactctaaaagcagattaattggagaaaaggcatatgaattcttttaacatgtacagggggagaattacagagtgattatctatcccccaatgaagttcagaagtttatatatcatctcaagtttaccaaaagaatagggctttggatcctggcaaatcaggttatggcgggagaagacgcattctgtactgggacaataaaagattgcaatagagaataaatggatcttggaacagacactctctgtttaggtatggttacattcttggtcttacagggaggagaagaaataaaacattctccttggtgagtctagattttagttaggtaaagaatttcaacttcatcctgtgctttgggagagatggtgggtaggagggaggtcagagagaccttgaagcttctttagctcagcatgtgaaagcaccacattttggggtattgttttctgagccccaacgttactatttgtgtgcatgtgtttgtgtgtgttgaggatacttaaaatctactctttttttttttttttttgagatgtagtctcgctctgtcgcccaggctggagtgcagtggcgcgatcttggctcactgcaagctccgcctcctgggttcacgccattctcctgcctcagcctcccaagtagctgggactacaggtggccgccactacgcccggctaatttttttttgtatttttagtagtgacggggtttcaccgtgttagccaggatggtctcgatctcctgacctcgtgatctgcccgcctcagcctcccaaagttaaaatctactcttttagcaattttcctttttcctttttttgagacagagtctcgctctgtggcccaggctggagtgcagtggtgccatcttggctcactgcaacctccgcctcccaggttcaagcaattcttctgcctcagcctcccgagtagctgggaccacaggattgtgctaccacgccctgctaatttttgcatttttattagagatggggtttcatcatgttgcctaggctggtctcaaactcctgacctcaagcgatccacccacctccgcctcccaatgtgctgggattacaggtgtgagcccctcgactggctcttttagcaattttcaaggtacaatacattgtcactaattgtagtcattatgttgtacaatagatctcttgtacttttgcctcctgtttagctgaaattttgtatccattgaccaacatcctctctgccaatcaccattttactctctgttcctatgagtttgacttttttagattccacaaataagtgagagtcttgctgaattattatgtacaacaattattattctttttagtatctttcctcaagcctttctttcaagaccctgaaagtagtatcttaaatgcatatcgcccttcttactttgctgtagttctttcatgtgtatctgaacctaacagcaaatccatgcatttaggtaagcctgttttcattttcattttgcaaataagcagacaagcttccaaagctgtaatgaatgtgaaactggcccaaatgtctcttagaagtaatatttatggattttcgaataaacatagaaatggaccctccctggtcttaaaagttgaaacttacatttctctcacctgagtttcttcctcaagaaactgatcctcaggcaagggactgaaatacgttagatctctgagttcagaaaatgagactccagacgtcttatccatcatgattgcttccttacccctccttctttcctgttttcccattttcccctccatataacccccaccagttttagatggttgaggagatggatttgagactttctctttcattctcctcagctgcagaactcagctaaaagcttcctccctggcaacactcattgtttcagtgattggctttctgtgcagcaagaccaaacccctggcattttgataacaaaagactcagagacagagtcgtttcctattttaatatatcatcttttctgaaagtgtttgagaaatggaaacaaagcacattaactctaaagccggtctgtggcagggcagagcacatcattgcgcagcctccagtggcctgggttttgcgttgtgttgatcacctcctcctaccttgttaggtgattattccatgatgcagagctggtgttggcatgctggtgagtcgctggagaaaagctgtttgatttctactttagacccttatgaaagagacacacgcctttgaattatcctgcttatcttcctcccactagttgtttctgactctctttcaggttcgtcaaatgcaagatcaccccagtgaaaacattttttttctttttagtttttataaatctgcccaaacttacatacagaaaaggatttgaagttctcagatataattgactgcataagtcacagtggtattctggcataattctcaaatacatgtgactgaaagagattttagaaattagaacatataaagggctgcagataatttattaaaaattgaaagctagagaacaatcacatgtagtttcaagtaatgtcagtgaaccagtttgtgaattataaaaaagtttgtttttatctttttgaaaacaatttcagaagtgtccaaatagaagtgctagtgctccctacctgaccaaccacctgggccacacactgttgaatctctcaggcttcaatatggaggagtacttgctggcaccatctgaaaaaccaaggtgtgttcaatactcttgttgggtctttacttgtttggattactatggaaaacttattgttttaaatgctaatgttcttaaaaagtcaaaaatctaagactgaccttggtgctcataaaaattccacagtgtgtgatgttccccttcctgtgtccatgtttttacattgaaagtagacaaatagttttgtcatctgtttctcatccatttctaatatttaaatataataaagtctaattgaatacaaaaacaaacaaaaaaaattccacatagatgccatggaccttaataagattccttactgctgactttcactcttttaagtgctgggggaaatcctatcaattgagatttgtcagtggcagaagcacgagagccagaagctgttttactgctttaggaaataagagcagataagtttacagcatgcaagctccacctcccaggttcaagagattctcgtgcctcagcctcccgagtagctgggtctacaggcacctgccaccacacctggctaatttttttgtatttttagtagagatgggatttcaccatattggtcaggctggtcttgaactcctgacctcaggtgatcctcccgcctcaggctcccaaagtgctaggattacaggcatgagccgatagctttttgaaggtgggaacttgtgtgcccagaacttagaatattatctggcacatcaaagatgttcaaccagtatctgttgaatgaatgagtgtattcagttgagccagttgggaatgtgtacttattcctttgcctgaatttttgctgagagtagaacactgtgatagaagagaagactattcttcagtctccttttatctagtgagtggaagacaaaatttatttagataatagttaacattatatttttttaaatgttaaccctttttttgaagtttaatagatacaagatactgtgcaactcatggagatattaaaaaaagatataattcccacccaggaaaaattcacagagctacataaagataaaccagcaaatagacaataaaacccagtgtggtaattgataacaatggatggaaatacagggtattgtgggaactcaaaagacaaggaacatctaacccacttgaaattgtctggaatgctttcctaaaccagacaagatttgagtgaaagattaaagaaatagagtagggaagacaaaccagagtggctcaaaagattatgaccactattaagaaattttttttttttttgaaatggagtcttgctctgttgcctaggctggagtgcagtggcacgatgtccactgtaacctccgcctcccaggttcaagcgattctcttgcctcagcctcctgagtagctgggattacaggtgcctgccaccatgcccagctaatttttttttttgtatttttacaaaatacagaaaaagacagggtttcaccatgttggccaggctggtctcaaactcctgacctcaggtggtccatctgcctcggcctcccaacgtgctgggattacaggtgtgagccaccacacctagcccaagaaattctgaataatggatttgtagagggaatgaccattaattaaaataataacagtgctgatgatcaagccctacctgttacatggcatgtatttcctaacaagacagtaaggtgtgacaagtacactttctaatgtggccagccttatccacaccttctcaattatcagtgccttccgttttgcctggcttgggagccaggaaacttgcatcagcacagcacctgtctgcctgtgtgttcatgtcacagaccacagatgctcagttggctactgtcctaagactgctgtacctggtggggttagtaatgaataccctctgattagaagtcctggtgctctgtggttgaagcactaacacaatgttcattgttaacaggcttggaggttggtcttttggattaaaaatccccagtgaagctggaggtgcaaatggaaacatatcaaaacccccaactctggcaaaggtaatcatatttttttatttttttcctgttttagaaagtatttaggaaaactcaacattcaaatataattttgagcacagggttcagaaggaccagattaaatccaatcatttgttactaagcatcaaggaaaattatatgtaaacattgtcttgaaaaaaaatggcttgtttttctttagaaatcgaggaaataggtttttgctttttgttaagacaggacttcacctagtaaatataaagtggaggaaaaaatctattttcaaagatacccacagttgtcataattggaaatatcactagtttctttgctggccaaggagtacttccattcatgaatgtaaatgccttatcttccagaaggctggatagataggcctggagatgacacaaagaaagcagcagttacacagagctactcttaggagtcctggattttcaagccctgccaggactatacctgtgaattaggaatggtccccttagaattaaagagactaggtgggagattcttcagctttgagagaatgaggactgggatagaggaaagatgccttgatccatcagtaggaatagagaagtggtgaacccaacagtgagttgttatttaaggaaaaaagtcaacactaccttaaaatggggaaagcagaaagattcaaagcattcagtctccatgactggagaaatagtattgtgtttgattgagagagaaatcagaaaagggtagattgtgggaggaagttaagtccactgcgggagagtgagtgtgagttcttattaggatatcagtatagacatttcattctgtagtgtgtggatgttgtgtctactcatgagccaattgtggagctatgagaacaagaacaatctccatgagcccaggaaggcactctctctcttctgtagtggggacttgcatggttcatgtgaacctgaaggagcttattgggataaagacatgcacatgttggaggtttattcagtgaaataaaagttcttacaggtgcttcacaatgtcatccctgatgagacagtcatacttcacaatgtaatccctaaacaaaattttaacagtcatgtattacgatgtaatctgggaaaaatttccagtcatagtgtggacgattcaggaatctctccaacagctgaggtttgttcaaatctcttttccttctaaagacaacacacattcatgaagatttaaagcttgatatgaaaatatcattattaataacttgatagaaaaataaaatgtatttgctgacatatattggaatacattatgtggccattatgaaaatatacctaattagtagaaggaatctgttcatttcctctacaaatattccgactttttagtctatcccaatctaaacccttcttacgtattcataggagatggttgtgtctttgctttgaagtgtctgaggcacggacctcttgttcagtgatgagtggctggggatttgtgtgttctcctcacatctctaactttttgtctttgtttagatgagtcttctgtactgacatgtttgagtggtgattgctgaagtttttaatgttatttacgtgtccttcaccaggcacaagcatgcaggtgaattatacttgaccctttggggactgagctcctctccagcaagccaaggaactcaacattgttgtggggtgtaaagggcaatctattatttgaaataccagaactgctggcggctgatactgcttcaaatgattgcatttatctttctgtaatgaccggctttttctttcagcccttaggctacattcatcgacatagatgatatgatttcatagtccttctgaaggaaaacatgaaaaatttgcatatgaataggcttaatgtatggttcaatatcttgtagaatgtctcttgtgtgacctttatgagttctatcattcacatcttgagtgtttagcttgtttaatcaaaacactctttagaacttacacacttcagttaaagaagccaaacacattttcactttcgtttttttcatagttctgttctcccatggaattttatatatttgaatatccactgagagttttttttttcttatagctgcttagttactttttggaggggctgttattcctgagatgaaaggtctgttttgaggtgtcatagtatgttcctaaaagaagattaatttcctatttcattattggactttatcacttcgtgacttatggactggtagggaaggaaatcccacagcttatttccagaacacagcctagttttagaaaaccattcttgggagaaaaagaaaaagaaaaagaaagaaataaaagctttttctttgatctctgttaagtcctgaatggtaactttaagatcatcacaaagtatgcatttattacttaaagaatctataaaacctttctcaagtaaaggccagtttataaaggaaccgatcaggagttccagaacattttaaaatctgttccttggaactctgcaagtcaatcatttattgccaaaatgatgctatgtagcaaacaactgcaaaccgttagtagcatcaagagtaaacatgcatttcgctcatgagtctgtgggattgtgctgctgtgggctgtgcataacagatggtgccaggccccactatctgtggggaatttgggatgctctttatccaggccctggttctacatccttggaatgttccccagctcatcatctgcaatgacccttaactctactctgccaggtgcttccccttccattgccctccatagctatgtgtgaagatactttaaaatatgccttttgagtagctctcagcctgcttcctgcctgtggacagctgggttcttagagctatttacattttacatgtattccagcctggggtaccttcttgatatagcttcctataaagcaccctaggctttctagttttctaactgagatccacaagctactctcacgatcttgttgagatatgctgctctctctaaaattaattagtggcatttggggaatgccagaatactagaggacaacaccctttaggttcctaaaagccctgtgtctccctgagagagtctcttagcagcatcattctttgaagatctcaacaaagttcttacaattgcacccttgacttgatctttcttctgaggccatgtctttcaacattctctcaagagagctccgtacccaggtcaagatgtttattgggcaccatttccatctttgaagttaatacaggtgacattacccactgttttcacactgtaatatgcgtcacccttttttcaattatttatagcagtttgttttttattatttttccccagtattcctaaatactttatcatgtatttccaggcttctcaattgtctctttgtcccccaacttgctagtatcaaaagcaacgccaactattttcggtttttggtacagtaacaccccattccagtgtaaatcactatattggtactctattgccacaataatgctctataacaacaatttcaaagctcagtggcctccacaatggatgttcatttagctcacgggtctgtgaggttttgctaatgcagactgggctgggctgatcttggccaggaatgaacatgtgtgtggtattggcttcagctgggatgacagtggaggtctcagctccactgttgcatctgatgatagcagaggcataagggagacttcaggaacatacatgtgcctctcaattgtgccacattctattggccatagcaagtcacatggccaagcacagcatcagaatgggagggcatgaaagtcatatagcaaagcatgtggatacagggatggtgaagaactagggcccttaatacaatcatgaacagaagttttggcccggtgcagcggctcatgcctgtaatcccagcactttgggagtccaaagtgggcggatcacctgaggtcaggagttcgagaccagcctgaccaacatggagataccccatctctactaaaaatacaaaattagccgggcgtggtggcacatgcctgtaatgccagctactcaggaggctaaggcaagagaattgcttgaactcgggaggcagatgttgcagtgagctgagatcatgccattgcattccagcctgggcaacgagcaaaactgtgtctcaaaaaaaaaacaaaacaaaacaaaacaaaaaaaacaaacaaacacaaacagaagtctcagaatctacaaagggtgaaactagggaggctgagcaggcagcctcctgtctttccagctccattcagccaaagaagctctgtttttgtttctgtactgtagtgtggtgtcatttttaagttttttttttaatcactctacttttaaaacaaaaattaaaataataaaacaaatcaaaacaaaatttaaaaaaccttaattcagggcagggactatccttgtgtcttctattttttccctaaatttgaacagttaagggaatcaagacttgggggagaaggaggtcacagaccaggctagtgggaggttccactttccataggcagtgggcttttctaccagattagcctgtcccttaacttcaacagaatcctgagtttctatcatttccagaaatctggctagtgcctgtgtaggtgtctgtgtgtgagggggcagggtggcatgggggagaccccaaagggtgacagtacagagttgtgtgggtggatgacatggacacacctctgatatatgacataaactccttcagttcacttttgacttttccatcaaaggaacttggaatttaccctactttggagaattgtgtctatgttgctgtagtttttttgtttgtttgttttggtcacaaaatcccactctgtttagacatagctttgaacactcacagttctgtagttagtgggtctcaagctgcacttcttctccttggggtttaaaaaaatgattggcaaggatttctctgtgaacttaagaaaatattttaaaatgagtggtgtgaaagatgagatctgcattctgaattgcctgaagaggtaggctatttgagaaggaattggggaacattgtcttgtgtagtagggttttgttttttttttttctctttttggttttttaactatatgatcaatattttattacttagctgtttccacaaacacaatagctgccacacaagtctctggttaaaaaataattagttatagcatgaaggggtggaaagaaaagagattggaagccctcaagttggaagggatttgagatctggtccaaagtttgcataaactacgataacttgaataggttcccccaagccttaacttgctgtgaggcagcggtaattctaccaagcggattatctgtcacaaaaggcagcctcttctagagaaatgagctgttcagtcaattgaattaagaccaaaatgcatcagttggagtcatcatacttcttgaagacactcacttgcttttcaaattaataatatattttcatttttattaaaatattgatactttgaaatatagatactgatggtttgattagtgttttttatgatgcttctcattccagctttaataacattgtctttctcttattttcacctttctcttgacaggcatgctactttattctccatgctcagcaaatgttcagttcagtttattttgagaaataatgttccatgttcagttattaatttgaaagtaatcattttttttctgataatcttccacacatttaatttgcaggtcaaatttcagtagcttactaactgagaaagaaaaaaaaatgatagggtttggttcctttattcttataagaaaataattatagagcaacattcacatttgttctggggaaaattaatctatttttagctgtaaattatatgctggagataaatataaaattagcagactagaattgactgctcactgtcagccatgcaggaacattactttgaatcctgcactcaggtgccttggaagttaattgacacatacgttccttaaatcccagaatagttgacaaacagacttacgagctaatttcgtgagagccattaaattatctttctttttttaggtgtggtataatcagaagggttttcattccctaccttcctacttaaatcatctaaacaaccttattttgtggcagcacctaccccctactgtggactggagacaatacggtaatgttatttttcatgcattgtaattcactactttcaaaagacaatgtttttaaaagtgaaagaaacagaaaagtttctgaatagaaatgtgaggggcaatgagaaggtttctacttggcaaccaatccgtgtctaaacacaataccaagttgtaggctgtctttccctttgtgtgtcattaaatgtctttattttcttgaacctgtaacctcatctgtaggatgaggggaacaaaatgtgactggagagttctctcctaaaattattttattctgtgacttaatatcttacagaagcaagaaaaattttaccttttaaagacaatattatatggaatactgtaatagagaatacagactgtccctcctccttatcactgggaagatgaacatcacattttgatttatgctgagccctcaattcatcagttatttatgttgatcattgattcattatctatgctttcttattttggtaaatggcacaggtccatttctggtatccagagttaacttactggtttaagtgaatatttatttatttcacttaggtgggataaattataatttgttaatttaatttagcttcttttttaaagaaaggaaagaaacaagaagtataagcaacaggccatgtccaccacaatttattcacaaaatgtatttgttgaaacattaattcacatagacatcaacactaaacaatttttctaatatgctctcactttatttcaatcatactttatttttccatatttatttttccttctacaccagttttttaacaaagtaaatttaattattttgtggcattgtaattattttggaatgctaataggtaatgtaaaagttaaaaatgtacgtgactaagagaagtacaaaaatagtacaatagtcatacagagtagggacagcagaataacatttctaacatatttgaagtgtatcaagaacttcattagatatttaacatccatggtcttatctgatttttatgtcaattttgtaagatagacaatatttgcctactttactgattagaaaactgattttcagaaaacatcgcctatcagctgtggctctgagcaaggtaataatggggccatgactggattctaggtctagctgataacaaactcttgcttttctactacatcaaactgagatgtcattctggtgggcatgaatacagcatggttcacagaggggaagtcattaacactggatcttgaacaatgagcagaagtttgactgaggtcagaaagccattctaggtcttagcaatgcaataacaattatagtgtatgttcagcttatatggaacagtccagtttcacctcatcataaagctgaatgtagagggataattgttgatctctttggaaagattgtttaagatcaaatgctgcttggctttgactgacatgatgaagagtatggactttagtaagcaatggacaggctttaccaatatgtgagaataagaatgacataatctatgtaatatgttaggaagaatgatctggaagccactgattaaagggagaagactggttgtaatttaatgacctattggaaggatactgctcacaattttgaggttaaggccaggatgaatccagaggaaaaaaatgataaatttcagacagatgggagaaaagattgaggcactagggatgggaataaaaaagattttaagaaactaaaatataaacctgagcattttagagttcagtactgatgacattataagaaatggcagggagaagagatgttttcaaggaaggggcgaggtgatttgtgcaggattagagatgctagtttggttcacatacatagatgaaaatgtgcgtaggattcagaaaactggagagaaaagtttggtagagcagtcataggtaacctaagttctaacattaataacaaatgatagataaaggtgttggtaaagtgagatcctgcacgggtcagacacaggctcagaacagaagaaggctatgggtagaacagagggaagaggacaaaggttctgtagcccttgaggtaagaagatcttgcacagaggccagtggagggcagaatttcacatggatgggcaggaaaaatgaaatatttcagggtcatccagaagaagtagaatgcagacgttttgctggtgacttccagagggctagttcaatggtgtttcagaaatggaaaattaaagtagaaggaattaagcagagagaggttgttttaaaaacttgagactaaacagataaattctaatttgacttgttgatgcatcatcatgggaaaggaaggtttgtgcaataaattgggaatatacaatacatagcaccacaggaaggtgtgttggcagttattatcaaaatattgataaagaactcccacgagcagggttctgatgaaaatatttcatcacatcccttgatgcttgcttgttcctgtgggaaatggacagagctagaactattagcttaatacttagagtgaaacaaaccttgccccaatgtggaacttcagtaaatcccatgaaaacagaagctgtgtcttgctccctgttcgtctcagcagtcgcacagcaccaggctcaggggacattcaggctataacaagtgaatgaacggatcattatactacacggacaatatatcacacttctcatgacaatggtttttgatgaggtttcagcagatgtacacattctaatattagagatttctgaaccctgatgcaggccgcttgataagaagctattttcttagaacccaggctggccctttctctctaggagacagctagctgctcctgacctatcttctcagcctcatgtctcgcttatggcccctcactttcccctccgtgtagctggcctttgcatcactgccctgccatccctgtgagcctggtagctgcattgcctctgctgagactgcctgtcttctcctgcatcaccttaagcatttctgcttaactttctaggcccatctcagacatcacctctgttggaatactcaccacccctgcaggatgagttagtggcttctctttcttctcccacagttatttgcttatgaaattcatccatatatttatttctatcaagcattcatataatgacagatatttcccagacactgtgttaggtcattgctgtattttaaatgtgtctcccaaaagtctgtgtgttggaaacttggtccgcagtgtaacagtgttgggaggaggaacctttgagaggtgcttgggtcatgaggcctcctctgtcatgaatgaattaatgtcagtgtctcaggagtgggctacttattgctgttgccatgcccttggacttcccagactccaaacactgtaagaaataacttttttcctttataaattacccagtctcatagctgggcatggtggctcattcctgtaaccccagaactttgggaggctgaggcaggtgtatcacctgaactcaggagttcgagaccagcctggccaacatggtgaaaccctgtctgtactaaaaataaaaaaattagctgggcgtgttggtgggcacctgtaatcccagctacttgggaggctgaggcaggagaattgcttgaacccgggaggcagaggttgcagtgagctaatatcactgcactccagcctgagtgacagtctcaataaataaataaataaataacccagtctcaggtattctattatagcaacagaaaacagactaagacagtcattagagcagttgatacttcacattatcattatttgtttacattcctttgttaataaaagtgtaaacacttcatggaaggtgtttatactactgatgtttgtgttttctaaagtctttattcataggtattcaataaataggtcatttaagtgaatttgcttttgcactatattttagggttactatagtacattccattatgataattacattctaaaataaagataaatatgcagcaaaatatgtacttgcttctttcgttattaggaccttttaagttggcataattttgttaaattaaaatattaaataaagatataaaataatgaacctaagaggaaatttcttttaataagattaacagaataagtgaaaacagaagattaaatagaagtgcttaagtagataggaaggtatcttcctctgatagagtaaaaatgaaaagggataaagtattattttattttgtgttattgggggtggttgtgggtggtgatgatagcagttgtaaaggttaaacttcttcaactacttattgaaatttcatccaaaccttggcatgccagtaatgaaatgccaccatgtgggaggaattaacctcagcaatgtcatgaacaagccagatccatggtcattaaactgtctgtacattggaatcacttaagcatttaaaaaatattgatttatgttgcttatccaaagattctgatttggttgatttggagtaagtctttaacagcaggcatttttaatgtttttgggtgattctaatggtaaccaagtttgagaaccactgggttaaactgataaacttcccagctgattcatattctgaccactgaagcaggaaaacagacagaagtgtaagttaggagtcagtttagagatatccacactcaccttctcactgctaggaaggaacctgatggatacctggctactgggtgtcaggggaggactgttctgtattagaacaagaaagagctcttgactttcttttctccccatttgtatatctcttttggaatcccctggagggccacaactcattagtatgctgcaaaccccagggaggaaggagaagggtggtgcatgttgcatgctaggatgatgggacagagatgaaatgaacctgggagcagtggatgacatgcatggtagattttcctgctttgcttttgatgaaatgagaaacctgctaaaatctccaaatcacaatgagagagtatgagcatgagaacaggggaaaatctctgatctgtaatagagctactgaatgaacagcattggctgttggaattcggctggcatccataaccttcaacatgcccttgagagctttgggtatatttgagatatttgagagagaagatctggtggtacccgagtgaaggtaaaggggcaccctggtaagggaggattctgagcaatgcaaagcaccagtactagcttgcccttgctggaatcagggagtaagaaacaaaaggacagcaaagccagttatcaaacccagtatggaacaaggactgatcccccaaccacagagaggaggacattgcataccttgagagggtgttttcatggggagcatctcatgatgtgtttatatctgcataaatagaggaaaatgtgtgaaccctatgaaagagaggataaaagataagaagaaaatgccaggctgagctgcagtgtgttacaaaaacggagctagctaagatgaagatagaaatatgaattttcattggatgcagtgaataacattattgattgattacaaacctctctccttcacttagaattattgacttaaagaacaaacatgcagtattctctaagaacacacagggaaaaggtgacacagtaaaactgatcagaggggaaaagctagaggaatcgggtatagaaaaaaagcagatgaataagaaagtaagaaggaatgatgtaagaagaaaatgaatcgaacacaaaacaaaacaacaaaataattctgtaccaatagattggaagagtttgtcatgattctatcaaaatttatgaattaggtattatggcagtagcaatgattgatgcacaaatttgatgaattttctaaagttcaaggataaagaaaaaagtttttacaaagctatgagtcaaagcacattagtttcaaaggaataaaaataagactggcctctgacattttttataatttctcttgagacttcatctttgacccagggattatttcaaaacatgttgtttaaattctaagtttttgagattttcctgtggtctttctgttactgatttctggtttggttcatcacggtcagtgaccatactctgcattatttcaattattttaaattggttgaagttcattttatggtcaggatattgtttatcttgaagcttccatgggtgattaaaaaaaagtattctactcttgttgttagaaatgtacattatatgtcaattagatcctgttggttgattgtgtggttttgttcttccatatcttcactgatcattgaagattactgaaccttcactgaagatcatcactgacacatttcgtttgctgagaggcgagtagtaaagtctccaaattgtggctttgtttcttttttcagtttcatcagttttttcttcatgtattttgaagctctgaggtacacgtcaaatgtgtgtacacatttggcatggtcacatatttctggtggattgagccttttatcatttgggatgattatattttcctggtagattaatcctttgcatatatgtagtgttcctctttgtcactagtaaatgtagttgctgtgaaatctattttatctgatctcaacatagtcactccttctctttttcttttgattaatgtttacataatatatctttcccgttattttatttccaacctatctcattgtgtaaagtgagttttgtgtagagtgtatattgttaggtcatattttttaagctgcactgcctatctctgccttttaattggtgtttgggaaccattgcatttaaggtaattactaatatatttgggtgtaagtctgacattatcatttgttttatgtttcctctgtttctcttttcttgctttccatgagttacttgagcattttttttgattctattatgatttatttatagtatttttaagtatatacattcatttagttttcttagtggttcttctaggtgttataatacatatatatgacttatcacagtctactgatattgttatttactaccttgggtgaagtgtagaaagcttacttcaatttacttttaccctgtttacctttaaaatattattgtcttaagtgtttcctatacacaccacatcagatggtgttctaattcttagttaagtcaccaaatatgacttaggaaactcatgagatgaacaatagtctattatatttacttctatttttaacgtatcttgatgttcatctttccttttgtaagttctaagccttttcctgttatgatttcctttgtgcttatgtaacttctttttgctattctttaagagtaggtttgctaatgaaaaatttgcttatttttttcaactgatacgatctttatttcaccttgattcttgaaagatattttcactgaatatagaattcatggttgacaattaaagaaaagctcagcacttgaaaaatgtgctacttccttttggcttccatggtttcaaattagaaatccattactattctagttggtattttcttccttctctctttgtgacggctttaaagaattttttttgttgacttattagtttctagaaatttaattatgatgtatcttggtgtggctttctttggttttatcctatttgggatttatttagctcttggatttttaggtttatggtttttttttgccaaacttgggaagttttcagctgttatgtctttgaacactttttcagccccactctctctttcccttttctctaagatcaggtaataagattattagctcttgtattgttttcccagaggtctctttcctgagtctcattttttaaaaagtttatttctctatgttatttagattggataagttttatttttttcatctcgagtccatgcagtctcttcttttttagctgcactcaactgtggagcatgtccagtgggttttaatttctgtcattgtatattttagttctagaattttcattcattttttaatcatttatattttctaatgagattttaatttgtttttcatatttaaggaaaattcaaaattactttttgaagcatctttatgatacatattgtcagataatttcaacattcagttcattttgacattaccattttttattgcctttttcaactggtaatattctggctcttgttgtgaaggattattttcagttgtatcctaggcattttggaaactgtaatatgtgactctggattccttttcctagcaggcaagccctctgttgaggaatcatatgagagccacctagatgtatatgttttgattccctgtgggcctgatgacaccaccctggctaggcaaaggtagagaactgacttacactgcttttgtgcagatgagtgggaccagatcgcccaccagcctcactgacacattcatggcaaatgaggcactgactcatgctgtctcattgtctctaagtgagtgggggagtagagtctgctccccattgggccctgatgacgctggggacaggtagtgaagtaccagctggctcactttgaaagtattctttagtctcatcgaagccagatgggaatggatgcttggcatccctctgtgccctgctgccactggggtgggggcagtggtggaaccagggtactgagtagccgtattctgcacttctgggttcagtctcattgctgtcaggtagatatggaggctcagctctttgttggtccctcatgacatgagaagtagagtggcggctagccctgtctcactctgctttgtgaagtctcattgctaccaggtggggatggagtctcaacttgcctcaggaccccagtgagaaaaccactgtgccccttgtctctgtcaggtggggagtggaagattcactacccaatgggccctgctgaaacctgagatggtggggacagttttgctggtggtgtttgcctagagtaaggcagatattgctaaaaagtagttcttttgttagaccactcttttccgggtccttgggttttttatttttgggagcctttcttatttgtacttgttgagtttcaatttggagactttggcaatgccttgttcaggatatatgtgaggtgataaggaagccagaatatttactgttgtattgttgaagtcttatagtctcagggcaccatcatcttgtttgcaccccagaatcttcctatttctgtttgttgtgttatgtccagcagttttttattgtaaaaatgaggacttggcagaactggggctgctccatctaggaggactatctctgacatattagccacaacctcaaaggcaaagaataatagaatagcacctatggaatatggaaagaaaaggctatactccccacattctgtacctagtgaagatgtttccataaagtacacaggccacagagatatgctcatatagaatgtggctcaaaaatatactgtagacatattgtccattagaaagaatgccaggaggtagttatttgagatattaactgaaaggaagatcatgaaaatattgaatgcacacaatgaagaaaagaacttgggtgagcaccggttgtagtgaaggacatagattatgcaaatgtttgcatgcatgtggtgaaaaattaatggaagatcaagaattacccattaaactgaagatatgtaatataaaacttaataataatgcatacatgtagagaaaattctcaacagaattaagatccaaatgcaaacagtgattacttctgattggttttggataggattataagttattttaattttattctttaccctatttaaaaatgtaaaacccttctacaattggcatctattactcatagagtaataattaatattgagaaaaatacattttttcaggatagattgatgaggaagagagagagaaagtcatcaaaacgccttgtagtcagaagaacgcatatatttcttttaatagtttgttagattgaattaactttttactcttacatatttcactgatatctcataatgaattaattaaaacaacgtaaactttccacatatattgatgataagacaagtttttccttttggtagatgcttacagacatctgggcattaatacttctaaagatatacattttataggagtaatgaacccgaaagtgagtacttgaattggagacatcttaagtatcttgctatcataatggatattggacaaaagcacagatgtgcatttttaccaatgacaaataaacagagtctggaaaccataacagatgtagccataatgagaacactaaatgagaaaactaattttgtacattcatacattgctgtgggccaattcctggaaagaaaagccggaatataaatgataataacaatcaaacaaagaaaaattattcaaatgtactcaacatgtacattttgaaacgtcatttctgaaaacttgtgaagtaatgtcgtaaagacttcagtgagattcttctactcaattctggtgttgaaactatgccccttttacttaggagccttggaccttttaccaacatcattgtctcaagattctatcacaatacaattgttacctacctagagtactgagtgctcaacatacaatgaaatctacaacccaattacagagattgtccattgcaataatgtgttttttacagcaagggtatcaaagactacaaatgattttcctagtctcataggaaattgatcagactggtatccagaaaatcagggttgtagttctcactctggtaccaattatgcttgacctcagataagttagtagagtaagcttatgcctcagtttccttacctgcacccactcaccaaccttggctacacttcctctacagtaggctccatcacgtctcgtaggattcctctttatgagacagggcatagctatcctctctttctttggatccatgaagagagttctgctttctaacgttttacaattttaaagaacaaggggtatcatgggaaggtgcagggtagtgtgagggtgagcccatgccgttgcaattgctcctacctgctgctttttgctcagggatctaggacaaccaaggaccttaggtaggagagtaagcttccacctgtgtcttgtttgttctttctttattcattactcttatttttgagaaaatatccattatttatttaagtaactccaagtccatcttcctttttgaaaaataagagtaaaatctttttagcaccaatttaaagatatatttgcttgatttttaatgtatgtttaattctatgcagctgctttcaacgaatgactatgattctaaaaacatctaatgtagtgattgataagctaaattgcaagataaaaatgaaaagttcacccagtgttcctaaaccaaaacattgcatgggtttcaccctgcacctctctgccacccctccagtcttcccactgaagctccagggcagccctgtaggactgtactttccttgcactccagccctgtgctggggtatcctgtgcatctggaatctacctttccttagaaagctccccgacttcctcccaccctgctgcacccaacctcttaggtgaccttacacaggacatagtcctgtgagtgggctatagtaccctcaccatggtgtgtccctcccatcagactgctgcggcataatgggcagagaaaagatgcgtgttgaatgaattctccgttctgtgaaggaagaggaatcaaatctctatttgacccttggtgaaactcaattactgtccagtgccccggttttcaccaccaaaatcataacaaagtcagaacattctttaacccttggcctgacaggggcaggctgttgtcttataaaagctggtggtcaatgtccagtggagggaggtggggagtgaactcaagactgacagcaggtccagggttttctctacttacttgatgacattattttcctaaacactgtggtctaagccctctcattctctgtgtattagctttgaaagataattttttaatttcagagtaaaaacatgggaatgttaagccccaaaatgcttaggaattgtccaagagctctgagcactaagcagaaaggccccattccaaggccatgaggattccctagagcgccccatgagaggaactgtagatcagtgtgttctttaatagagtctttaaatatttactctatgacaatcatgtaaattataggactctaaagcctgtgccaaatgaaaatctgtggcccctctgaattatttatgagtaagggacctaggaagagagaggcagccactgtagtttgtgggggttcaggtatttgcaccagtggttttttacttctaagacctaagtagagacagagctcatggaagattacagctatgtgcaaaaaatcggaaaaggcaggatggctgccatcagtgggctgtctcctgaagttcattacgtgaaatttatcagctgctctcttctgctgtcatagttgaggttttcatttctatgttatgctgtcattgggatccattgcggctcattgtagaggcaggattttcagtgctctgtatgttagtaggtgatttgatgagagagacacatacctgtgactccagacatgtgggttctgcctgtgtcaggagcaggttctaaactccaggaaaagtcacaacattcctctgattctgtttctgcttctggaacacaagggcctgtccaagctagaccacttcatgggatttcattttcctaaaagaatctataattctaaaatgctgaaagctgacttacaaagaactgtgcatagcatactagcttccttaacacaatttcaccatcagattactgaatgagaaaatgtattatgaaaacttccaggagagggtctggcacgttggggaattactaactacaggagcagtcaatcatttcaccagcgagatgggagaccagatgtactctcgcctcctagatgaaaaccctaaaagaatgacacaaatccaggaaatgtgctaaaatgaagggcaataaattcataacagaagaactaggatacagaaagcaaatatgagaacactgtttttaatctttcagcagtgactgtcatggtttaaggtaagaaaaggtatttatgcgacttgatcaaataaagatccaaccttggtagtttaatattttattattgagctccccacagaaacagcagtgttcttttggcagcttttcactgaagaatgaatagaacagaggccttcaacttccagccctgtatccttcccactgtatggctatagtcttaggaaaaccagacacgtgtgctgaagaagggtgtatgatatgctggcagggaaatagttgtggtgtctgcagactaaggcctgaatctcagctgtgtcatagctgtcagtctataggaacatttcctaaatatctgtgcttcagatactgcttctgtaaacaggcataataattctgatgtgacatagttgctctatcagaatttatacaaatagtctaatgtcctaaatagcatacagcacatggctacaggctaatttttgtgtatttctggctaccaactctttctctctgctcacaagtttgaaaggacttagagtttgagattttcctctcctcctttttgcccatcttcatactcctgaaaatttaattaatcctttttttgtgaggataactaagatctaatttctcagcaaatgtttagtatgcaaaacattattaactgtagttgccatgctatacattaggtctccagaacttatttacatatttacttatgtatgtatttatttattgagagagatgaggtctcactctgttgcccaggctggaatgcagtggcgcaatcatggttcactgcagcctcagactcctgggctcaagcagtcctcccacctcagcctttcaagtagctgccactacagttgcatgccaccatgccctgataattaaaacaatttgtttggtagaaatggggtctctccatgttgtccaggctggcctcaaactcttgggcttaagcaatcttccttccttggcctcccaaagggctgagattacaggtgtgagctaccatgcccaggctttatttatcttatgtctggaattttgtatcctttgactaacatctccccattgcctctttcccctggcctgaggtgacagccttctactctctctttctgtgaatttgacttttaaaagttccacacataaatgagattttgcagtgtttgtctttctttgcctgacttatttctcttaacataatgtctttcatgttcattcatgttgtctccaagacaggatttccttctcttttgaagctgagtaatgttccattatgtgcatgaatatctatcttatattttctgtatccactcatttatcaacagacacaggttattttcatatcttggctattgtgaataatgctgcaatgcacatgggcctgcagatatctcttcaagataatattttattttactttattttttgacatacatctagaaatgggtttgctggagcatatggtagatctatttttaattttctgaggcacccctatagtgttttccataagggctgtactaatttacattcccaccagcaggataaaaattgtgataatcattttgtaatgtatacatatatcaaaacattacatagtacaccttaaatgtttgcaattattatttgtcagttatacctgaataaagctggaaacaaaacaaacaaaatgaaagcaataataattgaaaaccaaggaaattaaattcagcgttggacagacatgaggcaggagtggggtgtcagcagggttggacaggaagcataagcaaatgacaacatatgcctgcagccatagagtttggggaaatgatagcaatccagcttttcaaatgggagcagtgggagaatacaaagattgggtttcactttaaaggagatctgtgtctaggtaaagaatatgggctctatatttttctatttctttctggaagttctctaggctttctgggtgagggattcatgagtgtgcggagaggtgagctgagcagggatgcacatgtttgtgagtgaggcctggcactgcgaggatggagttcacgtgaaagtaacaggactcggtaacttcttggatgtgtggggtgaagaagagcagggagatggggagggcttagtgttttttgagcctgggtgactgggaagatgatggggatatttgccccagggtgtgtgtgtgtatatttaggttaaacaatttcagtattctactgtgttcctcaaataatataattccaagacatgtactcagctaaccacatttctctggatcctcttaatccagagtgttctcattcttacgtagagtctagaagagcacacaacattgcaaatatactccacagcaccagtggtccacgggccatactttggcaggatctgatactttataaacactgtctaatgtcgcttggctttttctgacctcctgataaggttggttgacattgggctgcacatcaagtgagaagctccctgtgagtcaacactttagctaggaaggacaggactggcaggccccatgaggtgtaggctagaaataaagcttggtgaaagaaagacacataggagaaagactggtgggtgttattggtccagacaggtgagggatcaagaccacacaattcagttcatgatgaatgtggtaagtccaggatccaggaagcgatgcagcaggtgtcaggcacacacactgcgagcctggaccagaatatctggacagtattaatttataatcaaaatttattctggaaaactgtacagtggatttgctgaaccaacagctcctactgttgttgcttttatgagccggaacttgccttagtacgtggctgagttcccaatagaaggaaaaaaaaggctggcatagctggggagaagagcaggtggcaaagggacagaagtccagatgcctggtcgcaaagctgttggaagtttggagcactgtagcctgttccaactctgtaccttttttgtaggcttacttataccccatgatgtttcagtaaggatttaatgtgctctcataaagcagtgccgataagataataccgataagatgaattaaaatacaggtgatagtataaattaaaatacagatgatagggtaaattaaaggcgagccaaaagaaaaataagcaaaatctaggactggcaacatgaaatggagcaaggatttgtgcctttggtaatggcctccacatacaagccacacatttgactccaatcactgacacaaccaattaggcaaaggaaatctgattactctcacagtccacaatgtccaagataaaacacgaaccaactttatttatggagttcttcttaacacaatattgactagaatttctggggaagcactgtcccactctgtgatattataaacagctcttataataaaatgcttttaattgataagctgatggcagtttcttcattttggccgctggcatcacacacatgcgcaagcccaagaaagcaaacaaagcaaaacaaaacaaacaactccaaaaccaaaattggttcagtgaaacagtcgttatctatctatctagatgtggcttgatctagaggtgaatattgatctgattcatatcagatagtcttctttgcatattgttacttagcctgagtatgtttcctctctgcaaacataggctatgggatacttatgaggattacacaataaaacatgagaacctatgaacatagggcctgtcatgtaaagcatgaacaattcatgctggttatgtttgacaacaacagcaatgacagaaatcccagcacatatttgctgaatttcacaatggaatttgccatttttttctgctaattgaccagggcctgggcaaagcaagcaggatacattgtgatggcacagggaatctgcgtagcctgtagatgagctgcgattcaccatgcaggagcaggctgaaggctcacttttcaatttgtctttcacaggaataacactctacagccacccatatggaggggccttgctgaacaaggacaagatgtgagttgatggaatgctgaggggtgtgtgaccctgactatggaagaaaatctttgtgttacttagggatgactttggtctctcttttgcatttgccccaagagatggcttatagagttagcaggaaatgcccacaggacttgggcatttctttgcaaagtgtgagaaaaacgactattaagagagtcagtacattgactgagcttaaaacagatgagtttgtcatgcaactgtacttctaagcagaaattcttctaagggaatgatttaccagaaacttatgggactgtacatcttctgaagagttttcggggttaaaatcataaacattgcattcatgtacataaacatagtaacgcctccttgaatatttctcatgcaagattttcctcctgatccagatggagacatgggtggggataaggccagagctcttcaggtacagaattctgtgtcagttctcactgtctttgtaaagggtagcatgcttccacctgtcttctctttttctcccccatctcccttctctattatatggtcgacaaacttttaattaaaagtcgataataaaagtgggtatttttgaaaaactttttatgacctaccaaattaagtcgcagaatgcaaatctgcttaatgggcattctctgctcaagttgttaatctggcaggaaccggcaggaagcaccggttgggttgcagcttgtcctcacgttcacttaatgattttcagggttctagctttaacagtgtctgacacctgccagaattccaagagtaggctagctgacatctgttgtagaatgcgacacgatggagcagaaggcatggcacagcagatgacttgtgctgaggagttccatcgtgtcggcctcctgaaagaccatctgtggtctgactgttcctaaaggagttgagaggaggcagcaattgacttgagtaaaagtagtagtgttccaggtaaaacaattactaagaaaatgtacagtgtataatattacagagcacctcaatctattgcaaaatcttgttggtatttcatgtgactaaattcagagatgggccagtgcagtgtggagctgtagtgaaggctcctctctggcaggtgctactgtattgcaaagcagtccctgtgtgggcaaaggtcacagcttacccggatgctgctcagaggatatctttcatcttaattgggagtcaggctcaatggtgaagagcagattttgacacaagaagactccgaaatgccctcaaactgtgctcctcagttttgtcttctgtaaactgagcttagtcatccatgtctcaaaaggtggctgaggggatttaatgagggaatccatgcccttagccaacatgcctggctgattatgaatttttaattagcagttttcactgctgtcatcattgctgattgttattagcaaagaaggcttgtgttcttcgtcaggtgcctgagagctgctctgttccacccgcagcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatggtaggatttgggaatgagattctgtgtgcctccacaatagtgatctaaatagtgcgtgtatggagggatggaggggggcattggggccctggctgccttggagtgtccacaaaaaggggtcatcttattgataagagcatttcagattaagtcacctttactgatcaccatagaattggttcataaggggaagactgataagcttcaggctggagaactgggaaattatagaactttacaaagatgcaaagtttcttattgagaagatgagaaaattattacctttactatgctcttttcaatggggtagcagatgaggtgataaaaatcattagaaatgatctttcatctgcatgcttaacaccccctcctgtgagacctgtgcctcattgcctaataggtatggcgggtattattagcatttttggaatgcactcagtttcccaatggaaaccctccagatcagtgtctgccatcctgggggacaataacagatgctttgtctaggtgttccctattcttcaggacatttatcttaagtaaaaaaaagcatcttatatgataagttgttcttagtggtcaatatctactgtcattgttctctggtggagctgtctttattttgtaggaaagtgatatccttgccctcatacatatgattcatcttgtgatacagaaaatcatacataagtcagtggaaggccggaggtcaaccatttactgagcaccttccatgcactaggtgctgtctgagctgtgctacaccaggcacaaatttccgcatattaacatgttgctttcctgtaaggtttatttctttgagctggcttagaatttagctaatttattttcttttgatcatgtaacttggatttttgttttgttttgaaagtacaatttatcggggtcacacctaagttacctaacatttcaggagttcatttaatttaatcagaggtttccctgaacctgcctggtgatagatatcacctgggacatttggtaacaataaggattcccaagggcctatccttcgagattctattcagtaggactggggggacttggaggtctgtgttttactaggtactcaaggtgatttatgaatcttaaccaagattgacaaattctgggtctttaaacccttatctttactgagggacacttgaaggcaggcaagtggaagtgacttgtccaagattttacatctagttggtacagagatggcttctcagtgccagcctctgtctcctggtccagttttgttccctgtgctacacactgctgctggctacttgtctctctgccgtctgtcatttaacagtgtctaagggccacaactttcccagataaaagggaagaagtgtgtggcaagagagaatcacaacacacagggggccacgtttctaggacaccatggggctttcaaagtctccaaaaccccaggatcttccttcttttcagcacccttagtttattatctctttatgcctcccactcagtctgactcttctttactctgtgatgtttgatcttggtgattaaggacaggaagggtttcttgcttcttgcttggatggttttccatcttcatccaatcattctctgcttattctattcaatcactaatttaataaatatttttgaggatctgttgtgggtcaaggtgggtccaaggttgctatagactaaatgattatgtccccccaaaattcatgttgacacctaatccccagtgtgatggtatttggatgtgggatcttggagagataattaggttctgagaatggagccctcctgaatgggattaatggccttgtaaaagaggccgcagagagctctatgtgaggacacagtgagaagtcacagcctgaacgaggaagctggccctcgccagtcaccgaatctgccagcaccttgattctggtctttccagcctccagaactgtgagcaataaagttgtgtggtttataagatacttggtctgtgttattctgtcatagccccccaaatggtgttgggcataaagccatgcataaagcagagaagattgctccctcaaagagattcttatgagaggaagcagaaaaactagtaaacaaacaaataaataaatgcgcaggatacagttggccatgactgggtctgttgaaagaatgaaagagattgatgggatggaggatgacttcaaatgtgaaggtcaaagaagacagtgaaactttacctgagatctgtgaggtaagaaggggccctgcccatggatgacgtgcaggaagaggtctgcagcttgaggctctaagagaagaaggaaccaggcgtgtgagagcctgaaggaaagccatggctattgttggcctgcagggagcaccttaaggtgaggctggatagggaggtagtgtgaggagcctgtccttggttctacgtgtgtgggaggaggctgtgtttcatgaaagctgattggattccttgaccctcctcaaaggagatggatatgcatgacagtagtagtcacctcaggccaccataacaaaataccacaggctgggtagcttcaccccggaaacttgattctctcattgtcctggaggctggaagtctgagatcaaggtgttggcagggttgattccttctgaggcttctctccttggcttgtggacagccatcctctccctgtgtcctcacatgtcagccctctgagagtgactgcatcctgatctcctctagagacaccagtcatgttggatgagggctcacccaattgacttcattttaccttaatcacttgttcaaagtcctgtcttcaaatacagtcacatcttgaaatactgggggttcaatgtataaattgtgggggggtacaactcagattaaaacaagcgactttccaggactaattccacggctacagaactcctaatgtgcaaaataggaaatatatttgtgaagttgaaaggaaacttcaggataagtagatgataataaatatgaccatctgatgtaacagctctcccttatttctttttatcttctcagctcttttacttggtttccgtctgcctgtgtgttgccgttattgtcgccttccagttaacagcttttactttccgcaagaacttggcagccacggccctcctgctgtcacttttcgggtatgtgatgagaaacgctgctgcagaattacggtttgttttctgaaagagaaaaccctcaggatggctttgaacctgctgtcgacttcatgatttcctctcttttgaagcaattatgttgcttctgcaagggacacggagcaaacaagcctgagcaggatgatgaatgccccgtggaggaaggaagggctgacctggtcgtgatgaagacagcactgccctgtctcagacaggcccttgagctgtttgacaaacttgtgcagctggaaatggattctctattattctcactttgacattaatcaggggctcaaatacataatccaattaactcggagattgcatttgtggaggttctctcagcaagctctctggcattttttctcctctcctctaatattagtagtttgaaaatgttttgtctaatttctatcacttttttttcagatgaaaaaatagcaaatggagaaaagtcattttatgaatttctgatttatgcatgctagtcaggatcattgctagtggcctcaaaattatatctatccggtatcaggatatatatgtcttcttatttgtcatgcacgtatgcttatatacaggctaactacataagagatgcttagtagggaaaatcattatcatactaatttattatacttcaaggctattttaaaagataaaacagcttgctcttatttaagaggattacaaatgaagtgatttttacagtttgtatttatataagtgccctagaattattcaaaacatctaattagagacagagttttacttaaacaaatatataccattactagatgattgtataggtgggtgggtggatggatggaagtatgtagataagagaaagaaagatagacagggagagagagattaacagagagagggaaagagacactaagagagagagggagagagagattaagagagagagagaaacaagacagacagacaaacttttgggggaacattgatattactactcactaaccccaatgctgtagctttggtaatactaattattctgtctaatcctcagttttttctttgtaaaacttcatgtcttttgctataaagattaaatagtttatatgaatatcatggacaatgactggtacaaaattcccattaaattaattttagccattattgttactctttagaattattttactctttagaagatgtaatatcctgagctataaaacatgcttatagtagacatatatttattatatttagctagaaatttatggacttgtgtataaagatctatgtgtgtgtacccagctctaagaacacagtttgatttcagtttattgatccaattgaatggatagtgttgtcatgtctccctctatttcaagtaaaatagactttgctataaaattatttttgaattttaggagagtatatctcaaaaactgagttaaaacttagatgaaatggttagaaagccttgaaaacacgcttttagaaatttttattagttgttttgattgtgaaaccctttaagaatttgaattaaactaagaattctcttcatacataactaccacatttttcaaagaatttctggagattcacaggtctgttgaagcacaatcataggcaataggggttacacgcttctggttaagaactcttaggttgcagagactggaaagatgtcagagataactcagaccgtgtttgtaatcatggctaatcccagggaagaagagcccccaaggaaagtttatcagggtcactgggtgacatccatgggaatgcagatttagaaggtagctctttcttcattggagcacagccagtggaactggtgacaacctcccccgccactgtaacaggaggggcagtgagagacccggtctggggaactgctgtctcctgtgtgcctggcaatctctgggtgaggatagcagaattggctcatgcctgctgtccttctaaggacctatgggtacacggagcccaagggcaaactcaggaaagctgaatcccgagctgaaacctaagagcacgtccaggcattaaatggctgcttaaaggcaggaatctgaaggaataagggatagtatacacgaattgattcttttaagagataacaagataaacatgcctaatcgcagtcttattgtttttcttctttctatcaaggacaatttgttatttaaactataaaagggagagtcagggagaattagcatccaaaagagggaagtaacacctaaaatgaatgaaagaaaacagagcctaacttacataaagatggaaaccttaagaacatatttgatgtatatttaccgctaaaagatgagattgcagaatcctgcttggtgtcttgggaaatccacaaagcatggggaagcggccgattttcaaaaggggaattttcttccgccataaattccatgatgttgtgaacagtaggccagtctctagcaaattttaaaatcattaaaatgatattatattttaataaaagcctggagattgttgaaattcattgtaattttcacaaaaaaataaatataagccaatttcatttttttcttataaaataggagacgggagctgctaatacgttaatttgagccaagtattttaaagataactaatgaaaatgtagtaaaaaaagtgatggaatcatagcccgttgaaaaccacactggaatactcttcattcatctagcaataggaactctcatgtggcttcatttaggacaatgtctctgattctttgtttttcttaaataatgctttgatccacttgtcaaatatttaaatgacataacccaacatggaaaccttatgtaataagtaactagatacagatcctgaaccatctcaaaggaagtagagcctaatgttgaggtggtaattagtcactcaagtgcagatcaggtatgcagactccacagcaagaccgggaggctgctgtacccttagattgtattgctggatgtggagatgctgatcaaagcagatgataatcttgctgtgtgttgtgccaggccaaccacatcatgttctctgtgaggtagctttacctaaactcccctaagtcccacaatgcaaaatttaacagagagagctggttgaatatcgtgttgttaaaggagcagagaaagacccagtcttttgtagtggaggtttaagcagaataacatggctatcctcagctatttaaaggactgtcacatggaaaagaaaagcaatttgtcacgtgctgttccagaatatagagtttgaatcagtagctataagttggagagagttttcattcactcttagaatgaattttatagcaattacagctgccccaaaatttggctcacaaacttctactactgcttatatttctgttgcaaaaatacttgcaattctgtgatttcatttgattctcaaaacagttgcgtgaaggagtgtagcacttgatttttgtctcagaaggcacagtaaaggaaagagggtaggtgtgtggtgtgggtgaatatgtgttggggtttgaattctctctgtggtagtttatttcagacagagatgttgataatgtacagccctaagaagtcatgacttatctctctggtaattattttgatttaattagttgattgtcttatgtagcaactgttttagaacagctcttgcctccattgtgtgctttgaaataattaatgcccacattttgaggcagattgctattgagtagagtgtctaaaacactatatgattttatatatcatattatatatatcttatgaactatgagaatgtatcttttaacccaggaaagcattccaacatcatggatgtcatatgaaagggggtgcatactagactaagagttaacttgagggcctggcatctcttatatcattttgaagtctcatacttttcagaacttgttaacatattaggaaaacctcagacattttgcaggcactgaagtgtttcaggttaatccaattattcaccataagaaaacagtgatacatttaccttgagtgagcagagaacttgttggagctccggatatatgagaatcttttgggaaagttgtgattcaaaatcagtgacttctctgctgatattaggaaccatcgttcaaagtgtacttcctttattgggtgcagtggtattatttcaggaaggagatgagggaagttgccatgagtgaaacctggctctagaattgaggagacggaatgaagaaaatgagatgttttccttttagggacatttgggtggtatcttagatcctgatgtcatctgacacatgtggggactgcttctagggttcaatgtttagcaatgcttcttactccccagctttggggccacatggaaatgaatcccatgttcatctacttatcacctgcaaagctcgatcaagtgtctgaactctgcaaatccccattgttctgcctgtaagatgacagttacagtgctgtctcctggcttgctggggactaaaggaagattagggcacactgaggagttacagatggtaccccctgtgcagtggatgctggaaggaggctttcagtttttatttttaggccttattttttttacgtagctctgcagctttttatattcttgatatcttttgattctcaatataatgaataagtattattcctgccttcctgatgagaagcagagcagagaagctccttttggagaagagaggttggagaagtcagccgactttctccaggccacagagccgacaagttcaggcccacgtacaacccgtgtgtgtgttgtgaccccatccggtgttctttattgcattgcagagtcctctgaagccccaggaagagtgtgttgtctttgaaaaataccgtggaatgtattatgtaaagttcatttctgttcaccaagtgaggaaaaattgctgggccaataaaattgcatctataattcagtcttacggctgtccccttatctgcatttttgctttcagagaattcggttacccacagtcaactgtggtctcaagatattaaatggaaaattccagaaataaacaattcatcagttttaaagggcacagtgttctgagtagcaggatgaaatcttgtactgtcttgctctatcccatcagagacgtgaatttcccctttgtcctgcatatcctcactttggacctgggagtcagtgagttaccaaattgactgtcgcagcatggcagtgcttgtgttcaagggacctttgttttactagatggccccaaagtgctagagtaggcacgctggcatattgctgtaattgttctattttatactactcattgttcttaatctctcactgtgcctaatttataaatcaaaccttatcataggttgtatgtatggggaaaaacatagtatatgtaggattcagtaatatctgcattttcagggattcaccccaaggtcttagaatgtatctgccatagataaaactactgtaaatgttacagtaaaacaaacattacttttcactttacttttcagatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaaggtcagtagctttgtagcatcacctctacacttctgcacctctagtgcaaagacggtgttaactcatgcctcttttgttgcttttctgactggaattcaatggaaatgcattggtatccactgtctttaaactccagagagataaatggattctaattaacaaaaaacacattgccgttataaaagccatgcctaggcttagcaacaattgacgaaaaaatgttctgtttcggccactccattcttgagggtagagccatgaagatgttcactgccgcatccctagcattttcatcagagactatttattgatgaattactgatgaatggtggaagagtgagtcattgaaacatgccctctcaatgttcaccatcgtttgggtcagacactacaagatagaatgggccacacaacacagctgaccatgctctcggggcacagcatgtctgaatgatgatctggcgggattctaccctcttctctgggatttctggaacaaatttaattttgctgttttccaagcatggcagccaagggctttcctgagcctgaggcccgtggtcaggaagaacttctccttgtgaggtcaacgccactctccaataggccgttctgattagcaagtcatttcttaaatgtcatctccagctggtgtctaggtcaaggtgaacccattagtcctgccacattcctttcactcctgtctcctcccttagtgaggcctgcctgggtgtttgcctctgctttaatacatctttcagcccctcagcatccccagtgctacctggagatacagacttcagattttgcactttcctctgcacccttattgcaatccttttcattctgttttcttttctcagctctgaccacactattctctcctgattccctgctgcttatatggagtctgattcctcagtagttcccaaatgtttggccagctcaggggctgagaaatgacctggaaaaggtactgagctcctagttttgaagcatgtgctgcagttctcatttcaaatcaaacagggactgatgcctatttaattgggatgagtctacttcctcatggctggactttcagagacttagtaaatttgccactgatagctaacattagtttttattactgtgcttcatatttggatagaagcagtgaactctgtaaacatctattatgcattcagtgatggtaataatctattttggtgatttttacagatttattattgacactgatttatattaatatgtctacactttaaagagaaaacttgcagaaccattgattggctttagcttgaggagaaaattgaaatcagtagagatagtgtacaatttccctcctccctcatcggatctctagcatgacatgaaccatcaggatgtcagtcatgaatcatggtgaaactgaaaagagactcacagtagataatcctattggtgaggaacttgaaagcagagagcttccctggggagtggagtcacagaagtgagatttagctccaaaagaaaaacgaagaagaattgtccatatccaaagaggaagctgaccaggaacctttccactcatgaggttttaccagtgtggcaagtggaaagccttgttacctttaattataaacagcattgcttacttgttaaaaaaaaaatcaacaggcaatgaagtgtttgccagaaaatggatctaaatcaattggtaacaagtaattaaaagcagcttattgcttttgtttgggtctttcttttcctttgctctttattttgatattatttgcttaggaagcaaccttattcaaatgtttatttcaaataatttcaaattttcatttgtaggttatggagctttgtagcattaattcttatagaattaatgaaagaaaccaaaaaaggtgactggattctcagatcactctttttcttaaaaaataaaaatattttaagttctggggtacatgtgcaggatatgcaggtttgttccatagataaatgtgtgccatggtggtttgctgcacctctcaacccatcacctaggtattaagcccagcatgcattagctatttttcgtaatgctctccctcccccaccccatcccccaacaggccccagtgtgtgttgttcctgtccttgtgttcatgcgttctcattgctcagctcccacttataagtgggaatatgcagtgtttggttttctgttcctacattagttttctgaggataatggctttcttgctccatccatgtccctgcaaaggacatgatctccttcctttttatggctgcattgtattctatggtgtatccatctatccagtctatcattgatgggcatttgggttgattccacgtctttgctattgtgaatagtgctgcagtgaacatatgtgtgcacatatctttggaatagaatgatttatattcctttgggtttatacccagtaatgagattgctgggtcaaatcgtatttctggttctagatctttgaggaattgccacaccatcttccacagtggtgaacaataagtctgaatatctagtgtaaccagtattaaccattgtgtttacaaattatagtgttaattaatcattttcattgttaccaaatcacagtttatatgatgacacattttgatttcaaacacaagatctggaacatctgtctttcccactggtgaggctccctgttggagcgagggggatgtgggggagcaaaaactcatgttttctaatttatttctttgtataattatcattttcacataatcctaaatcgaacacttatggattgttattctgtgagtttgtgcacctgcatcccccttctatgtatggattatttgttaactcagtgttcatatattgctaacacctttgttcatacttgtgtagagatcattgtgatttccttaaaagtagatgtaaaaatcatcactgttctcaagcaagaaaaccttgaaaggcaaataccagtagatctaattaatatctctaaacaaaatacctttgttttgatggctgtctgagaatatcagtgaatagttgggatagggaagacctggaacacagagctaaccaaggagaaaaagaagttattggtatatattatgaaaaggggaatagcttttaattggattttttttctttttttcactgtgcagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggtgggttctgaaggactcatcctcgagctgcacttactcctgcaaaatgagaggaagagaaaaattcatcctggaggttgtaaaataaaaattatatctgatcagcattatacatagttctaatgcgttaagattttattattttttaaacattgattggtgtcagtcacccacaccaggaaggaaaatttcaaaggataaggtgacaaactgtgagatgatctttccaattatttgtctcagcatattttctttttttaaaattttttttattgtactttaagttctatggtacatgtgcacaatgtgcaggtttgttacatatgtatacatgagccatgttggtgtgctgcacccattaactcatcgtttacattagatatatctctgaatgctatccctcccctctccaaccaccccacaacaggccccggtgtgtgatgttccccttcctgtgtccaagtgttctcattgttcaattccaacctatgagtgagaacatattttcactttgaaattgctgaatttctctgttactttgaagcagctaaggtaaatttggttaataccataacattatttttacaactaaatgccaagaactctgggagcaggaagataggaaaattcagtacagatgtctgtgtgtcctttgctggatcttgttgcttatgctgctgtactctgatctttgtcaggtgaggtcgaaagtcagtagcatggggcatgtgtagacatgtagatatataatgtggtttatacacatgcatgcacacacatgcattcctactactataaataggatttaatgtggccttgaaaggatatctgaaatattgtcagataaaacatttgaactgcataaggaagcaatgtgctttcctgtgtagggtccacaatggttggcttcccccccatacccaagtggcctgaattcattggcctgctctttccaagggctatgtatttccgtctgacctctacttgagggagggatcctttttggagaaattaccaattaagaccatgtcactagaaaatctattaaggattataaagacacatgattaataatttatggtgatctcttcatagaattatttttcctttcagccatttcctgacatattttgttacataaccccttttaataaagtaaaatagacaccgttttgagtataaatcccaatgtgcttttgaattggccacatcaccctggagtctgcagatttccaatagctgactgaacctggagtaaaatgcagagtgccctttaaacataatttgttctctgatgtcccttactagtttagtctattttataaaactgtaatgtaggatcccccttggcagatttcagggtactccattttcctatagtatcaaaagatttttctttaaagagaaaaatctgtattacctttactttctagagttgtaagtataagttgaattgtattttagaataatatccttgttacccacagtaaagagtcaatttttttctctacatgaaggttacagagcatagaaatttaagtgaatttagacactagttgcctactaccattttatggataactgtcataatgactgcatgacccagtcaatttacttttaagacccagatctaactaagccactaatcattgtttgaaaggtaaagcccaaggttcttagcaagcccccctgaagtgtggtgccttctgctcagtgaaggtgtctgtgatcctcctcccatcccacagggatatttgttgccctgcctctggggctgggctgatgccttctccgtgtttctgttacgccctctttctctattagggcacatctatgttggtttatggtatcgatatgctactcataattgaatcttgcaagaaaatagggagaccctgccctgtgcaactgggaatggatagatcctgccttcccagcctgagcagggcccctgtcacctgcacccactgctggacatgagtgctgagatcccacttccttgctgtccttccctaacctgcgctgactcctgtccagctgtcccactgtcctgctgctggccttgggttgtttgccatgaattcaggtttccattaggacctgagccctagttcctgcctattttgtctcctgcctagagctgcacttttgctgtctgtaccctaggtgctggctgggttggaacagccacactgttcagatatgagatatgctgcatatctggaaagttctgctatacctaggtcccatctgaattcttcctatttaatacagggatcgtttgttagtcattttcagttagaggataactaagtggcacatttctgggcatagttggattcctgtattaggacactggattgttgtgagtgggtggaccagaagtaagctcagtcaattgtctccaccaaccagaattacttgaagagatttaaatgaatgtgcacacctgggcccctccctagaactctgcaatgagaagctctggggatgagacccaggagctgttcataaagcttcccaggtaatcctcctgaggagagaatgagcaagctgatgtgggttactgtgaatactactctgccaggcaggagggaatacagtggcacaacttcctgttggagtgggaagacttccaaaagtccaggatagggtgaaaggtcaataaacacaccttcatctgggagagggaaataacattcaaacagaaaagtgtaaaattcaatgaattttcacaaattgaacacattgatgtagccccctctcactaataaactgaatactgccaacacttcagatggcctctcataaacttctccatcaatagctgcaccctaggtaactgcaatccttatttttatttttattgattcatttttcttgcctttgaacgttatataaatgaggtcatgtaagatagaattctgagtatctagctatatttttctcatcgtctatgttctctgtagaataaattatatattgtcaaatggtgattttatatgtggaaaaataataaagaaaagttgctggggatactgggagcttgccatggatattggattttatttttaataccttttttattttgaaatagtttaataatcagaagaagttgtaaaattattatcgaacattgctatgtaccttacacccagcttctcccaatgataatataataatatattacatggcaatttacactgtcaaagccaggtaattgatgttggttatgatactaactcagtcgttatcattaaaatataatcattaaatatattttaaatgattaaatataataattaaaatgttggcatattatagtttataggggaaattgaaatttattggaaagttaaatgtgtcagattgcaaattagaaagaagattaaaaagtgagcagctcagatttagagaaaataagagttgaaaattaaatttgcattcctctgatagatacttactgaatactttttgcaaagtattgtgcaaagtgctggttatataatccttttatgcgattcaacatatactataaacttacaatgtttcagtacttttatatacaatctacattattaaatgacttgtttagtaaaaagcacttaataagtaaatgccttataataattttgtgataagctattttaacatttagtacaattaatctggcatgatcttattcataaaattaaaaactagctctagtttagtgccaattcatttcagtatcttttaggaatgtatatatttcatttatgttagacaataaaaaatggattcttgcctgataatcaggatggcagaactggggtgctctggacaaagctgactgcccagaagtccgaaggtgatatcttcaattttttacaaatctctgacctttttgcctcttctagactattctggtatcatttgctaggtgtgaattcactctgatttcatcttcccaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagaggtaatgaagcttctatttttaatcttcttctgttgtgaacctgtacaactctagtagctgatctgcttgtgttagtctcagaatatttgaaatcagagccaaaaatagccttcaaattttagaaattcctacaaaatcagtaggagcagaaccaaatagagggtctgttgactatttcatagtaaaaacttggctgattgataggatttattttgttttataatgttaaaaatttcatgtgattgcatagttttaattatgacttgggctatgggataactttttgttgagcaaatatttttttgaatctaattaaggaaccacttttatctcttactgggacatcagtactctaagtgtccaattaagcccatctggcaaaatgctactcagaaaaggtaaagaacactcatccacctagcaatagctcaggaatttttgttcacaggtaagacattaattctagttataatgtttaatcagaactgacagaagccatataaattgttcctgatttatgcttaatgtgtaaagggaaatcagttctggaagtgattgccttcaattaactgttaaaaataaaagagcaccttgcattcatacggttcccagctcctgagaaattcaaaataggttatattgttatctgattggtatctatattctacttgtgatctgacagtaggtgtctcagatatgtgtattctgaggtaaagagaagccgagagatcaatctgaagtaatgcaggcatattcttactctctgaactatgatttctggtagattagaacaaaatgttaagaaaggatttttttttttagtagttgttagcttctgctctaagactggctatgcaatcttacccatcttattgaactattttttgtacccttgctttaaaaatcatgattattatagttttgccggtacctctccatagtagtttgaggcaaaggggtgtgggagggccaagattcactgaaaatcaactgacaaaaggcagagtaacaggaaaaaggcatatgaatttatttgattatagttttacgtgatacgagagccttcagaatgaagacccaaagatacagggaaactgtctgtttttatgcttaggttcaaccaagtacggacagccatgtagaaatatggttggacaaaaagagtatgacccaattaatgctattaggctgagaggggaagcccagcaaggcctctctgtttagatgcgctttttttttttttttttttttttgagttattatctacatgtttatgatgttttatttttattgttaaaaattttattttaagttctgggatacatttgcagaatgtgcaggtttgttacatagttgtaaatgtgtgctgtggtggtttgctgcacctctcaacccatcacctaggtattaaatcccacatgcattagctatttatcctgatgctctccctcccaccatccctctgacaggccccagtgtgtgttgttcccctccctgtgcccacgtgttctcattgttcagctcctacttataagtgagaatgtgcagtgtttggttttctgtttcttccttgtgggtgtggggcaggaccctctctggaatgcaggtctgtcttatgacctacagtcaaacaaggtaggacagataacttctttaggggtaatttttgtactgaaaaatatgtaaaaggggagaagttagggtaatatttttggttttatggtggctttggggaaaagaggttctagtttctatgaccagcctcaggggagaaggaggggccggagacagcagggcaggaaaaggtcagagtaaaacttttgattctgaggctgcctttggggccttcactttggggtattattttctgagtcccaacagggctaagagataaacttgtaaaacattgacagaatgatgctccaggtatcttaaatggtccaagatgccatttaaagttagattttattatcttaagctcttataagcattacagtttaattacctagatggagagtgctatgcaaaagtctgtggaaaatacagaaatgactaagatacagtcctgtgttgtttaacaatggggatattgtctgagaaatgtgtcattaggtgatttcattatataatatactttcacaaacctacatggtatagcctacgacacacctaggctgtatggtaagcccattcctccttggctacaaatctatacagtatgtgctgaatactgtaagcaattgtaacacaattgcaagtatttgtgtatctaaacatagacaaggtacagttaaaatatggtattgtcatcttgtaagatgaccattgtatatgcagttcatcattgcctgaactatcattgactgtatatccttctccatctagaaattaataatcagttaggaaacaaaatatcataagcatgtactatgttacatgggagcataagcattgtcccaaggcagggactgtgatataataatgtaatattttttggaagtcacagcatcataataattgttatcctcccaatttcatttttgtatatattaaagtactttctaaaaagaactgaaaggtgcatgagtggtattgtcttcaatgctgtcagtccagagagggtggctgtgcaggcagggaaggaaaggtgggaggacagggtatgtggggagagctttattaaaaatgtggtttatagctaagcctaaaagcgttggtagaatttggataggctgatggtggtgtaccctggaacatggacagggtaggcctgggggagacggactcatattgcaaatggtgggagagatgcagggaaagcggggaaaacatggtaattgaagcagatggcaactcatggggttgtgaaattcagaggtccaaaatagggtgaggtgatggttaggtggggcttggtggcagaaaatccagaagcagtcactttccaagatttgaggagccaggaagccagtttgtatccatagatcgcagctcctagccatcagaaaacagctgtcttggaaggagattgacagaaccagagagacactgtcaccaaggtggactctcaggcacagtatatgctgaggcacatgatagagacaaagtgtagaaaagacagcaagaaggccatttttcacattggctgtaaggcgagatttgatcaagaactgagttgactctatgctcaatgtcagaatatagaacgagagtttctcttttaattaatatcaagattagcttagactctgagttaggagtgaatttgcaggaatttacaggctcttcaatggaaaaagaagatatataagaaagctgtgagcactacacacacacatacacatacacagacaaacacatatgtatatacagtagaagatggaatcttttaagaaaatactttaaaatacacaaaaatgaaattaggagaataataattataatgatgtgacttcctaagaatattatattatctctgcataatttgggggtagttggcatttacttctcatcctcttgagttttccacacatgaatttattgtctgtaaattactgctgaaattcttataccattcaagtgccatgatgattttgagaggactttgtaatctatacagtgttttatacactattgtcattttaaaactccataaataacacaaaccagcaaagtcaactcaaagttggctaaaagcaagtgctgtttctgatataattttgattttatttaacttgttctatttatttagcttgtttgattgaatgtgctttacttaactttgtttcctcttagtgctttggacttctaggggtgaatggagctgggaagagcacgactttcaaaatgctgaatggtgaagtttctctaacttcaggacatgctatcatcaggactcccatggggtaagatacagatttcatcatttttgttgcttaaagagataataagcccagagaacccccagcattttccctcagtcccgtggaataaaatttgaaaacatcattttcctccaaatttaccttccaattaccactcctctgatgtggggaaaagtttccaaatatgaataaactgagctcagtacttccagctggagtaaagggccttggaggtcttatcacagagcagccaaaggcagacgtccctgggaggtatcagagtggattggaagtgcccagctcctctctgcagatggaactcaggggagcaggaaatggccaaggggtggttcttctttattctcctctggataaaacttcaaatgttcccatcagcctaagtggccagatggtttccctctttttaccacccagacttcctctttcaggtggtcatgactccttcagggtgggagcagtgaacacattaaaaaccaagaaagcggcctctaggggagtaggcaagatgtttattccccttgctttaacatatgtgaggtccctgggcaccctgcacactcagaggctgcctgaggccagatgacccctgcaggctctgtgggtaacatacactcatgcattcctttatgtcactcttacctgggccctttcactcccatttcacagggcacctgattcttcacctccttctaaactgtgtgcttggttgggaacattcagggcatggtgccttcacgcccctttctgcacctgtgtggtagtgtgtcttcctttttcccctgctctgatcaggactaatgttaatgatgtttctctctactgcaagaagaaatcccctgctctaaacctctctgtgctcaatttgctctttgatttgtgtgctatcaagtttaccctaacagcaaactgggctcaatatcacaaactaaaatcttagacctttaatttcatagccagtttctggtgattctttctccacataccactcctgtgctgtgccttctaatatggatgtcctcgtatcccattcttttttcagcactgtgttacaaggccccaggcatctatctttcttttttcccactacagcaaactcatggtaacttgatgggtagtcaaattcatagctgtctttatgaatttaaacccagcacccaccagccaacaggttgagatgcgacctccagctttctgttcagtttctgatccgcagagatatttatttttaagagaggttatatgttcttgaccctagttttgtagcaatgaatatggcaaataaaaatcgattaaacattgttttgtggatgtagagaaagaactgtaaaggattgtgtctacaatttcccactggaattttaattgactttatgttgcatttataaattaatttggaaagaactaacatttgacaatctctttttttttacaatcacttgctaaaataaatataattcatttgtgaaagtattttaattaatccttgcagtctattagaagagaatgctcttatcagtaattaatgaaacagttttctacactttctctacagtaatgtctcctttttaaattttattttttatttcaataggtttttggggaacaggtggtgtttggttacatgaataagttctttagtggtgatttctgagattttggtgcacctcacccaagcagtgtacacagtacctaattgtgtagtcttttatccctcactcctctcccaacatttctccccaagtccccaaaattcattgtatcattcttgtaattcattgtatcattcttatgcctttgtgtcctaatagcttaacttacaattatagtgagaacataagaatgcttggtttttcattcctgagttacttcacttagaataatagtctccagttccatccaggtggctgccaatgccattatttatttagttcctttttgtggctgagaggtgtttcatggtgtatatatatgtatatatatacacatatacatatatagatgtatatatacacatatatacatatatattctttatccacttgttgattgatgggcatttgagctggtttcaaatttttgcaattgcaaattatgctgctataaacgtgtgcgcaaatatctttttcatataatgactttttttcctttgggtagatacctagtagtgagattgctggatcaaatggtagacctacttttagtactttaaggaatctccacactgttttctatagtggttgtactagtttacattcccaccaacagtgtaaaagtgttccctttttaccacatccatgccaacatctattattttgattttttgattatggccattcttgcaggagtgaagtggtaccacattgtgttttgatttgcatttccctgatcattagtgatgttgagcattttttcatatgcttgttagtcatttgtctatcttcttttgagaattgtctattcatgtccttagcccactttgtgatggtattttttgtttctttcctgctgatttgtttgagttctttgtagattctggatcttagtcttttgtcagatgtatagattgtgaagattttctcccactctgtgggctggctgttaaccctgctgattgcttatttggctgtgcagaagctttttagcttaattaagtcccatctgtttatctttgtttttgttgcatttgctttttggttcttggtcatgcagtctttgcctaagccaatgtttagaggggtttttccgatgttatcttctagaatcattatggtttcaggtcttagatttaagtctttgatccaccttgagttgatgtttgtataaggtgagagatgaggatccagtttcattcttcaacatgtggcttgctaattatccctgcaccatttgttgaatatggtgtcctttcccatctttatgtttttttgtttgctttgtcaaagatcagttggctgtgagtatttggctttatttctgggttattgattctgttccattcgtctatgtgcctatttttatacaagtaccattctgttttggtgactatggccttatagcatagtttgaagttaggtaatgtgatgcctccaggtttgttctttttgcttagcaattgctttggctatgtgggcttctttttggttccatatgaattttaggatttttttttctagttctgtgaagaatgatggtggtattttgatgggaattccactgaaattgtagattgcttttagcagtatggtcattttcacaatattgattctacccatccatgagcatgggatgtgtttccatttgtttgtatcatctatgatttctttcagcagtgttttttacttttccttgtagaggtctttcacctccttgtttaggtatattcctaattttttttttttttttttttttgcggctgttgtaaaagatgttgagctcttgatttgattctccgtttggttgcttttggtgtatagcagagctactgatttgtgtacattaattttgtgtcctgaaaccttgctgaatttatttactagttctaggagttttctggatgagtctttagggttttctacgtatacaatcatatcatcagcaaacagtgacagtctgacttcctctttaccaatttggatgctctttatttttttctcctgtgtgattgctctggctaggacttccagtattatgttgaatagaagtgctgaaagtgggcatccttgtcttgttccaattctcagggggaatgctttcagcttgtccccattcagtataatattgtctatgggtttgtcatagatggcttttaataccttaagttatgtcccttctattcctattttgctgagggttttaatcataaagaatgctggattatgtcaaatgctttttctgcatctattgagatgatcatgtgaattttgtttttaattctgtttatgtggtgtatcacattaattggcttgcatgtgttaaatcaaccctgcatccctggtatgaaacacatttgatcatggtggattatctttttgatatgctttggattcagttagctagtatttttataaggattttttcatctatgttcattagggatattggtgtgttgtgttgtgttctttttttgttatgtcctttcctgattttggtattggggtgacactggcttcatagagtgatttagggaggattccctctttctctatcctgtagaatagtgtcaataggattggtcccaattcttctttgaatgtctgatagaattcagctgtaaattcctctggtactggatttgtttttgttggtaatttttttaattatcatttcaatcttgctgcttgttattggtctattcagagtttctgtttcttcctggtttaatctaggaggattatatatttccaggaatttattcatctccttcaggtttcctaatttatgtgtgtgaaggtgtttatactagaattgaatagtattttttatttctgtagtatcagtaataatatctcttttttcatttgtaattgagcttatttgaatcttctctcttcttttcttggttaatcttgctaatggtctatcaatttgatttgtcatttcagataaccagctttgtgtttcatttatcttttgcattttttttgtttaaatttcatttcattctgctctgatcttcattatttcttttcttctgctgggtatgagtttggtttgtttctctaagtctttgagatgtgactttacgttggctgtttgtgctctttcagatgttttgatgtaggcatttaaggctatgagctttccttttagcattgcctttgctgtatcccagaggttttgacaggttgtgtcactattatcattcagttcaaagaatttttgaatgttaatcttgatttcattgttgacccaatgatcattcaggagtaggttatttaatttctatgtatttgcatggttttgagggttcctgttggagttgatttcccattttattcaactgtggtctgagagagtacttaatataattgtgattttcttaaatttactcagacttgttttgtgtcctatcatatggtctatcttggagaatgttccatgtgctaatgaatagaatgtatattctgtagcacatgaatgttctgtaatcatctgttgagtccatttgttctagggtatagtttaagtccattgtttctttgttgactttctgtcttggtgacctgactagtgcagacagtggagtattaaagtcctccactatcattgtgttgctatctgtctcattttttaggtgtagtagtaattgttttataaatttaggagctccattgttaggtgcatatatgtttaggattgtgatattttcttgttgggctagtccttttgtcattatataatgtccttctttatcttttttttaactgcagttgctttaaagtttgttttgtctgatataaaaattgctactccagcttgcttttggtgtccatttgcatggaatatctctttccacccctttaccttaagcttatgtgtatccttatgtgttagatgagtctcctgaagacagcagaaatttggttgatgaattcttctctattctgccattctgtatcttttaagtggagcatttaagccatttacattcaatgttagtactatttgttgcctgaatgtcttgtttgtttgtctgtttcattgtgttattgttatataggtcctgtgagatttatgctttaaagaggttctattttggtgtattttgaggatttgttttaagatttagagcttgttttagcagttcttgtagagtggggctggtagtggcgaattctctcagcatttgtttgtctgtaaaagactgtatctttccttcattcatgaagcttagatttgctggatacaaaattcttggctgataattgctttgtttaaggaggttaaaaatagaaccctgatcccttctagctttcaggatttcttctgagaaatctgctgttattctgatagcttttcctttataggttacctgatgcttttgcctcatagctcttaagattctttcccttgtctttactttagataacctgataactatgtgcttatttgcatggttttgagggttccttaaaacgtaggtgatgatcttttttcaatgaatttcccaggtgttctttgagcttcttgtatttgaatgtctagatctctagcaaggccagggaagtttttcttgattattccctcatatatgttttccacacttgtagatttcccttcttcctcaggaaaaccaattagtcttaggtttagatgcttaacataatcccaaacttcttggaggctttgttcattttttaaaattcttttttctttgtctttgatgaattgggttaattagaaagtcttgcctttgagctctgaagttcttgcttctgcttttccagttctattgctgagactttccagtgcgtgttgcatttctctaagtgtgccttgatttccagaagttgtgattttaaaaaatttatggtatctattacactggagatttttccttccatgtcctgtattatatttttgatttatgtaagttagagttcacctttccctggctcctccttggttagcttaataattgaccttctaaattatttttctgacaattcagagattttgttttggttttgatccattgctggtgagctgatacgatcttttaggggtgttaaagaattatgttttgtcatattaccggaattgtttttctggtttcctcctcatttgggtagactatgtcagagggaagatctgggactctagctgctgtttagattcttttgtcccacagggtgctcccttcatgtggtgctcttccccttgccctaggaatggggcttcctgagagcccaactgtagtgattgtttttacccttttgtgtttagccacccagcagagctaccaggctccaggatggtattggggagtgtctgcaaagagtcctgtgatgtgatccatcttcaggtctttcagccgtggataccagcacctgctcaggtggaggtagcaggggaatgaagtggactctgaggttccttggttgtatttttgtttagtgtgctggttttgcattggttggcctccagccaggaggtggcgctttcaagagtgtatcggctgcccttgtggaagaaggatcaggtggtgggtggggccatagagttcccaagagattatgtgctttatcttcagctaccagggcaggtagagaaggaccatcagatgggggcagagttaggtgtgtctgagctcagactctcctttggtggggcttgctgtggtggcagtgggggtgggtgtgtggttctcaggccagtggatttatgttcctcaggggattatggctgcctctgctgagtcacacaggttgccagggaagtggggtaagtcggcagtcacaggctttaccccgctgccatacagcctgcagtcctaaagacaggtctcactcccaccgtggccctcccaacagcatcaagtcaatttctgggcagttggtgaccagggctgagaacttgccccagagaactcagccttcctgctgagaaagcaaatggactcatggttttccgatgtctcattgagccagcagcagtgatccagttccttcaaagggtctgtggattctctcagctttcctggtatgttcctagggtaattcttgtagcaaaagttcacgatatgagtcttcacatgcagctgtctgagcaggagctgcaggctagtcctgcctcctttccctctatggtaacatctctgattctaattctccttattgctttccttagaactatcaaaacaatgttaaatggcaatgcattttctcatttaatggtaatatttctatttatgaaatgatggattgaaaattatctacaaattttcatctaatgtagacattattttgttggcaattttataaaaagttcttacaagaatattttaaatttatcactttaaggccaggtgcagtggctcacacttgtaatcccagcattatgggaggccgaggtgggaggatcacctgaggtcagaagttcaagaccagcctggccaacatggtgaaaccccatctctactaaaaatacaaaaattacgtgggcgtggtggtgtgtgcctgtaatcccagctactcaggaggctgaagtgggagaatcacgtcaactctggaggcggaggttgcagtgagccaagatcacaccactgcaccccagcctgggtgacagagtgagactccatctcaaaaaaaaaaaaaattataacttcaacatttataaagttgcatgtattttatagttcttttccttttgacaaatttgttataaataagaggtagttgattatccacctatccttagctttccataataaattttatttttgttagatttttaatatttttgttaaatttcatatgctaatagtctatatagattttatatttattattcataagaaaaattaatttgttgaaaacatcattttcaatttttgctattaactattttgcatttttgtaattttgacaatttgtgtttccttagaaactcattaatttaatttaaaattgcaaattacttacataggattataactatggttctcctaaaatttgtatttccttcctatacctgtgtctgtatatttgtgttttatttctataagttatattttccagattctgacttttatttttaaaaggatgaaatattaatttatttagaaattcaaattatttttgcttttcaaatttatcaaactttgtcattcttcttaatcccccaccatgcttttctcaatctagttttgttgttttatttctaactttttgatttaagtgttttttgtgtttttcatcttaaaataaaaaatcaaattatgaggactaccaatatgctttttgtacagcttttaccttgatcctaaaaatgtaataaatcatagtattgttgttattctctaaatgatgttagaaatacattttcagtgccacaaaggaagtagcactcgaacatgaattttctcagcaaggcaattttacttctatagaaggatgcatctcacggatggagcaatggcgagagcacacctgaacaagggaggggaaggagtttttatccctgacgcaggtagcccctactgctgtgtcattcccctattgattagggttggaccacacagtctaagctaattcctactggctattttaaagagagcagggttacgagccagagtggtgggatgagcagttctggtgggaaagacggttacagaacaaatgactaaatgtgactcaggtcagaacaggtgaccaagggtgactcaggttgcagcaggtgatcaggggtgactcaggacagagcaggtgatcaggagtgactcaggatggagcaggtgaccaggggtgactcaggactgagcagatgaccagggaaacagttgtgaactactgattacaactggtggggaggttgtttactgaaactaggggaaggagatgaggagaacaaggaagttaaactttaaaatgaaggtcatagaactgaacatactgacatactgatactttgaagagaaacttagaactcactgtatttaacaatgacatatatgattttaatatagtatttttatcaaactttagaaggctttttttcagatactcattatcttatttttttctttctttctttccttttttttttttttttttgaggtggagtcttgctctagcacccagcctggagtgcagtggtgcgatctcagctcactgtaacctctgcctcctgagttaaagtgattctcctgcctcagcctcctgagtagctgggattacaggcgcatgccactgcacccgactacattttgtatttttagtagagatggggttttaccatgttggctaggctggtctcgaactgctgacctcaggtgatccacccacctcgacctcccaaagagctgggattacaggtgtgagccatcgcgcccagcctatcttatttcttccttcaatatttttacaaaataattttaaagacttttttgaagtttaatttacatatgaaaaagaacatccaatgacttttcataaaatgaatataattatataatctgtacctacctcaagaaacagaaccagaccaccaacccataaattccatctaatcacatccctgttgaggttaactcttatttgcatcttttttgtttttaatacaacttaatgtattattaaaggcaatcttgtaaacaaaactcaggacaagaagtagaactttggtagctaacttataagtcattctatgtactccattccaaatacaacctcttccatttaaatgattttttttgaattcattacgcaagagtctattcctagacaccatagtttaatcttgcatgtttgtaagatacttgatagggcctttaagttactcaattcacaggtcctttctccattcctttcatttctttacaaactctctgtcgaagaacctgaactgttggacatggtgagttggcctacaaactttgctgactgcatactgatgatggaatttaatatgttcatttgttctgtttcttgcaattgcagctggattcagaggtttagttagacgcaggttcaatcctttggcatgactaaacaggagatgatgttctctttcatcaagaggcacataatgtctgggccaggtgaggtggctcatgcctgtaatcctagcactttgggaggctgtggcgggcgaattgcttgagcccagagtttgagaccggtctgggaaacatggggaaaccctgtctctaccaaaaatacaaaaattagccaatctcataaccttgtgtaaaaataataaatattaaaatataaaactaaaaaataggcacataatagctggtctttagtctttttttttttgcttttagcagttttgatgtttaatgcttaggtgaattcatccattgcaaaatggtcatgttttaacctagtctttttgttttcatttactagtttggataattttgtacagagatgctttaactgtcttttatttggctactcagaggtacagttcatacaggaaaagagacagaatttatttacccagttttcacaataatcaattggttttcagctgtcctcagaaagtgacagattaggttttcatgtatttgtttccttgtatcattctgacttcattctgatagaattagaatgtatcacaagtgtcactttgtgcttagttatctcttttacttcttagaatttcccttttttattctctcgacattctcctctagtcatttcttcatccatatactagaaataataactcaaatgtttaaatgaaggttcaatgctataccacataaaatccaccttgtgcagaaacagacatgctgttgtcatttaactgcaactaacttatatgaagaaaattgcagacctgaaatcaaatctatcttgctccaaatgctacatgctatatctgtttctgtctgtcggcagataatgcagttttacttgggttaatctatgtcaataggtgaaaactcaacattaagagctaattatgtttgagaacagaaagtagagaaaatttattagttgagcaagtgtttgaggttggtatgtgtaaagagagttgtgatactacttactctgaaaggaaatcctgctgtatgggattgaatctctctcaagtgtttccttgatttttctctgcagtcatagaagaagtaagatatttttgttgaatttggaggtaggttttgaaaaaaaaaattctaacttctctatttacaagtacatgtagacaaaagaattttaacttataaagcaaaattaggtttatttcttcatccctggaagactgactctctcctttgtaattctatttcatcatttgtaaaataattggaaaatgaaattcaaataactactcttgaaaagaagaataaatttacatacaaataatggtctgcaagtcccttattatactccatatctgtgtaattagtttaattataactaaatcatgcttgcattaattatattttaaccttgattatttgtaatgttaattgcacattggtattcaaagaattaaataggtaattagcagcacaatggaatttttcactacttagagagttgaaatgtaccttcctgcccatgaagcccatagcttattgctacctaattgaaacacatctactcattcattcaatatattaaggtatttttgtctcttctttgaggttatattatctaaaacagggctcttttactttcctgtttaatttactaatctccatgaatgcacatcttcaaacttgagagtaatacatgtctaaatatatttcaaaattgtccactgtagtttggctcagagcatgtcatgttctcctgatatactgatagttgtctcaggccagaaatcacatgcatttttattattattattttctattctctgtagctcttcttcctactatcgtaactctcaactttttgtcttggcaagttgtcaaggctgcagcatgatagactaggtcccagaggaagtgaagacaaggaagtgaagtaaggaatttaagactaagatttgttttatgaatttgatcaacacagttgagaagcaggcataagaataaataattatttgacttaaaactagcagtctcatatctggaacactaaagtcctgctaaggtagtggcaagattaacaaaaggctctaaaaattggagacaagttttctgatgaaaatcttatgttgtgatatttacttaaaatatgaaaggctgtggcatttttatttggtcagcatagtgttaaaattttggatttggattggcgttggttccagtttgtcacagttgccaccattgcttgttgccttattgatggacaccatcaaacatttacttggactattacatctgaaattattgaaatttgtggctcctgaacaccataaatgttaatctcattagccatgatttactgtgtctctcttattcgccgagtattaagttaggggctttacattctagatcttatttgataattataatgacaaagaggttgttatcctaattttactgacaagaatctaagattcagaaaaattaagtggcttgccggaagtcaaacttctagaacatgatggagctttgaatccaagtttttgaaactctaaatcacatgcagttcctatccaccctttgactattagagaaaacaaagtagtcacaatcaatgagacagaacataaaatattttaaaagggagaagaaaaagagatatatatatacatataaaatatcatgtatataaatatcatatgatatatatcttagttatatctatatatatattttaaaaggaaagttgacagataacagagcaggcacatatttttataataaatattattgggagtatctttccttaaaaaatcagacactcagaaactgggttaaaaaaggtatttttttttttacatgacacaacacaccattacagtgaaattaaaaataatggccattatgcaaatgaaaacaaaacaaaactgtataaatacgttaacatttaaatatataattcaagtaaaggtacatatgaggcaaagacactactaaataaaatacattctttgatgtgaagtcattgcagtcaagaaattctgtatatgaaagacatagaatgataaggtgtaaagcaaagtctgttgggaaaaccagaaagagaatgagaggatacgttggaaggaagagaccttaactctttaattatctaatagttacaaagtgtaatatatttggagaatgagtttcacgtcatcaacacaagaaacaagactgtttatcatacaaacatgacaaatacaactcttcatttttatttatgaagtactagagtaattcctgttaaaataagaaacagaataacatgatcaacattattatttagcattttctggaatttaagttcctgctataagacatagtttaaaaaatagtatgagtatttatactgctaattattatcttttgtgtcatcatacacttaaatacccaagaagatcaattaagaaataatttcaactgaagtggccagaaaaaataataaatacattcaaggctatataatatgaaaaacaattacaatagaaaaaaacacatgcaaggtaatgaataaccttagaaggaaatatggtcaacctatatgttaaaatgtagatgatgttttcagcataaaagaataaataagtaataagataataccatgttgctgaatggaaaagctgaatcatcttactattactctcctctagcaagttttatagatttaatgtaattccaattgatattgcagagaatagagtaggctttacacagaatttctgaagttttaaacacaagaataaatagatgggtctaatcgtgacatttttcaaaaagaataggttgataatggctaaatgacttaagaaatatttcagtgcattatattgactttgtaataaaataatgtctttctaattggattgcttaatcgataagagaaaatcaaaatataaaaaaggtagtatacacattttacattagtgataaaaggaaaagaagttgcaaaattttcctgagattggtattttctatccctcaaagaaaattagaaataaggcaaataaacacattgtttattcaataaggacatttcttttagacattaaattaatgtaaaatttacagtagaaaatacagatatatttaaacatagaaatttaaatttcttctgtaagtcgaaacattaaaattgaaaggctgaaaacaaggatcaaataagacaaagcattaataggtataatatgtaaattactgtatagtgataaggaaaagactacaattacaatacaaataggctagctgggcacggtggctcacgcctgtaatcctagcactttgggaggccgaggcaggcagattgactgaggttaggagttcgagaccagcctggccagcatggtgaaatcctgtctctactaaaaatacaaaaattggctgagcatggtggtgggcacctgtaatcccaactactcgggaagctgaggcaggagaatcgcttgaacccaggagtcggaggttgcagtgagccgagatcgcaccgttgcactccagcctgggcaacagagggagactccatctcaaaaaagtaaaaaataaaaaaaataaaaaataggcataagacttaagcattaaacacaatatgaaagtgaatggttaataaacattttaaaaatagttgccatcattaatataaaaatgcaaaacaaacaacagatacatatatatttttaatcattataaacaactaaaatgtagtgcacaatttcatgaaggtatagtaaagtggacactgttatatgcttatctttggaatataaatcataattttactggagttaagcatggcaatatatataaaaaatacttgggctaataattttccttctgggaaatttgtgcctagggagataacagaaacttggataaaggtttaaatgaaaatatatttattctagtaaataattgagaaggtattgttcctatatatttaacaattacattaattacaaaatgttggtgcaaaatcatttaaaataatattaaatatattaaaatggaagattagcataacttgaaaatgctctcattactagataagaattatctaaaacgattatattagtacctatctgaggtcacaagaaaggagggaaatttccaggtgccataaaagaagaaaccaacaaacctgatgtgatactgtgcaatatatatttttgtcttagacccatttccaagcctacaactcctaaaattcttggaatgtccaaactgatgtaatttttatgctaatgatttatggcgctggcagcctctaggtcacttcaggatggggctggtcaccagaaagaccaaggcaggattacagggttgggacttccagccacacccctcaatctcaggggatgatgagacgctgaaggttaagttgatcacaaatgaccaacgatttattcaaccatgcctctgtaaaagctctgtaaaatcccccaaaactgtgttcagggagtttctggatacctgaacacttgatagttcctggagggtggttcccagagagggatggaagctccataccccttcccacatgctttcccttatacatcttttcatttctatcttttgtaatagtctttgtaataaactggtaaatgcaaataagtgtttccctgagttctgtgagccattctagcaaattaatcaaacccaagaagagggtcataggatccctggccgatcccaaaaggtcagaagctcaggtaaaacaacctgaggcttgtgactggcatctgaaagggagcggtcttggggactgagccctcaacttgtgggatctgattatgtctgcaggcagatagggtcagaatagaactgaactagagaacattcagctggtgtctgctgcagaaatgattgcttgattgttggtggggagaaatccccacacatttggtcacagaagtcttgtgttgattgttgtggtgtgagagcagaggaaaaacagagttttcacactttcattccagagtaattgcttgtgttgccacctaagaaaggggcaaagcatatgtaaatttctgatttggaggcataggttttaatgtccctgatggtgcaagagctatgactgcagctctgcatgtggagaagcattgaactgaaactctgtataaagctaggatcgttgaaaggctgcatccttactgaaggggtaggatctagaaaagaccttctactggcatagaaagataataggaaaacattaatttctgtctaggattagaggtgaaaagaaaaaaatctcccctggaattttgaaaacctgagcttataccctagaactgaaactcctagaattgtgggagtttaaatttgactacctgtgatctgagaaccacaactccccctacccaagaatataacataaacattgacctcagtttgatgatacccatgggcacttttaagaagaaaacacaaatctttgcaaggatggtctcacagctcatatatcattttttttcaagagcccattaaagtggagtgactaaacaaacattacaaaacacacaagacaactatctactatatagataaattaatggctatcacaaaaaggagaattggcacacaaagaatgtaatgtaagagaactacaatcacaaagaaaatgtaagaagtaccatgatatgagagagaatagatttgaaaaaaaaagtactaagattaaaaactgtggctattaaaaagaaaaacaatggttgggttaaaaacaaatgatgtactgctaataaaaaatatgaaaatgaaattatgtgaaatatggaggatagaaagaggtctaacataagtctaattagatttctgaacaaaagaatagagacaatgggagagaggcaccatttgaagaaataataggtgaggattttctagtgttaagactgttgcttccttcaattgaagaaacattacatttattgaatataataaatgagacattcatacttaggcactttgtgttgaaaccaagaattccaaaaacaaactcttaaaagaaacaaggtggcaggtcaccacaaagtaagaaatacacctgcatctgttcacaataatagccactagccacttgtagcatctaaaattaaatgtaaatatgttaaaatcaaatcaaattataatttttttctcagcagccactagcaacatttcaagagtacaagaaccttctgtttcaggcagcacagatacaaaacattttcattgttgcagaaagtttaatttggcagtgatgaattagaccaaagaccaacttcttgacagcaagaatataaacagaatccagtaaaatgaaagaacataatgaatcaaaatgcattaataggtcaatagttgttatatatagacacagaattataggttaagttttattttttcttaatccttcctgtactttccaaatcttgcgctatgatcgtgtgttagattatcagacaattaaataataaacgggatataaactcttaagacaaaagcctttctcttcacatttcaaactagcattttttgagtttgctccattttaatatatgcaactgggataaactgttttttccttaggttttcccgttttttaagtgaccgtatcatagaattcatgtgaacaataactatgaagtgctatgacaccatcaaaattctaagtattatgtatataatacttaaaaatttatgtataaattactgtgcttcatataaaccaatgcactaccaatatatacaaaaagacatggaactcatttattgcttttaaatgtttcatcttcctttagactaatatgaatcacaaattagagtagtttgaatcataacctcaccaactagcaactagttgacaatttaattttctccatttaaaattaaatgacaatttaacaatactaacctaggaaaacaatgaaagaaagtcctctctaattttacatcaaagtgatttttattcttgcagacaccagtttaaaaaaatggtctaactgtgcctctatgtttgtatgtatcaattatctgtctgcatgtacacatgcttgcatgtacatatacacaaaaatgctcatatacagtgtatatttttttcattcatttcattcagtttttaaatttacatcatcatatcaaaatgttttcagaactgctgcacagtcttcacattaatgcctaccttgtattccactggttttctatgccagcatgtactgagtcatttctctattacatagttatattctcatttgaatttcccttccctggaacaaagtatctcttagctgaaaaagtcttattctgtgaaagaaaatgctgcctcttccatgctatgtctaagatatggcagaatgtgcaaactagcagaaagcatctgtatttagccacaagcattgacttcagtcggccccatgtagatctgtattagatgggtttccctgctgcttgctgcctcaggcttccatggggagcacccagaatacagtatgtgcagaggtgttcttaatttcacactgaagatgctcactcctctgcacacatggtccgtgatgtcccaactttacactggtgtaaaaatgatacacatttcagtgagtaccatactttgggtacccatacaatcattcttttcactttcagtacagtatttactaaattacttgagatattcaggactttattatgaaataggttttatgttagatgattttgcctagctgtaggctaatgtaagtgttctgagcacacttaagataggctaggataagtgatgatgcttggtaggttaggtgcaataaatgcatcttcaacttacagtattttaaacttacaataggtttattgggatgtaaccccatcctaagttgagaagcatttgtatttgctacttgttgatgtttacttcctgtttgctaacacactacctgtggtgtggcttctgtcatccacgatgtcttttgtgtcttttcaagaacaacaaggttgatgcatagctagaactgataatatgttctttttagtggaaaatatcttctgtatataacaaactgctaactgctcatacacagcgagtattttcatttgttagttttcactggaaaatattgtttatcctataggaatacatatatttctatattcctatcccgatatgccactataattaaatcatcttgggtacagtctttgtttcattacgcagtggtattagaaaacttctgaaagtcccctggcggagaaatgtccctaagcattttgttaattaagggataatttcactgaagaggaatattggaaggaattgctttctttctcagacatttaaatataaaagccgagttgaagtctttgttaatctagaatctatttttctttctaaggctatgccaacataaaaccatattttctttagttaatgtaatacagtactgggagtgaaggatgataaaaacaccagcatgtaacacattttttttttttttgtccacagattgttaaacgtcaaaagcaacctcacgctatggcttatgtattgagctgtgtgagagttcacatgtcgacttccaatcttcaaattttagttaatatattgtttgagctccctagcgcttcatgggaagtcctcactgggagaccttatctccctttcagctgctctcgttacatagaaactaagccaccatgagcaatgtgcaggttccctcatgccagggtgttttctgcatgccttgcttgcacagcttctatgttccctacatgctccttacacctggggagctctaatcctgtcagtgccaggcacaggtgagtctactgactcacacaggaagggaggattattctcagcttctttctaagattgaaacttgactacatctctattaaaatagagatgggtggtggttgcctggtaaacctatagccagacaactctagcctatttaggagtcattattttttctttactttttttaaaaaaaatttactttaagttccaggatacaagtgcagaatgtgcaggtttgttacttaggtatacatatgccgtggtggtttgctgcacctattaacctgtcatctaggttttaggccttgcatgcattaggtatttgtcctaatgctttccctccccttgccctctacccgccaacaggcccaggtgtgtgttgttcccctccctgtgtccatgtgttctcattgttcaacttccacttatgagtgagaacatgtggtgtttggttttctgttcctttatgagtttgctgaggatgatggcttccagcttcatccatgtccctgcaaaaggacatgatctcgttcttttttatggctgcatagtattccatggagtacatgtaccacattttctttttccagtctatcattgatgggcatttgggttggttccatgtctttgctaccataaatagtgttgcaataaacatacgtgtgcatgtgtctttatagtagaatgatttattttcctttgggtatatacccagtaattggattgctggatcaaatgatatttctggttctagatctttgaggaatcaccacacgtcttccacaatggttgaacaaatttacattcccacaaacagtataaaagcgattttatttctccacagcctcaccagcatgtattgtttcctgacattttaataatcaccattctgactgacgtgagatggtatctcattgtggttttgatttacatttctctaaggatcagtgatgttgagcttctttcatgtttgttggccagttgaatgtcttcttttgagaaatgtctgttcatatcctttgcccactttttgatgggattgtttgtttctttcttgtaaatttgtttaagttccttgaaaattctggatattagacctttgtcaggtgggtagattgcaaaaattttctcccattctttaggttccctgttcagtctgatgctagtttcttttgctgtgcagaagctctttagtttaattaaaccgcatttgtcaattttgaattttgttgccattgcttttggtgttttagtcatgaagtcttcataggcagatgaagcatagctaacatttctgtcctatgcttaccacaaagtagctgaatatttatttttatagaaaattctgcgtttcatatattttcttctttaccaaactctttgaagtctctatttttcttttttttggaaatggagtctcgctctgttgcccaggctggattgcagtggtgcgatgtcagctcattgcaacctctccccaacctgattcaaatgattctcatgtctcagcctccagagtagctgggagtacaggcgcctgccaccatacctggctaatttttgtatttttagtagagacggggtttcatcatgttggccaggctggttttgaactcctggcctcaagtgatccgccccccctcagcctcccaaagtgctgggattacaggcgtgagccaccaagcctggtctctactttcttttttatctttgagtaacaaatctcttaatttatgtgtgtgttgttgtttattcttcttttttcagtggatgatgccactggctgaataatactgtgaatccatctatttatctatctacgtacctacatacctatctatctcatctatctatctttttaatctatccatccgtctgtccatccatccgtccatccatccatccatctgcttggcagacctgcacaggtcatccatgttatgtcacctccccacactatcagtgtgcaccaactgtcatcccaggcagatactgtttttaataattttacagataagactaatagaggccaactgaaaattttttttaccttccagctctttactgagcattctattttagtcatatttctaaatatttcaagaattattttttctctcttgacttatttatgaaaaaaatggcatcctactttttagaaatgcaatatctaaataaatcattttttctttaaatattgatgtatttttcttttaaattagtttatctgcattgtttcagctacctgaattttctggagttttttgtttgtttttgtattgttcatgtcatatatttccttcaaatagctaatgttttgtgattgtctactcctacttaatatgtgagcattaaaatccttaatgaaaacccttggtatatggctagggcttactgactgttcactatagagtgagctatcattttgatagaatttggtgaggcaataaaagtaaaatgtacatttaaacttcatctttaattagatgtctagattaattaaaaccacttttgcattgccactataatcccatgtgattatgttgtattcctttgaatttttcaaaaatttgaatttccagaatcaatagtgaaatatttttgagttacagacacataaatctaaggattattagatctgtcctttttctcttcagtcttgataatgttctttgattttagatttagactgcttttaggttattactttattattttttcttttcaaataaattcgtatgtattgcactcttttttttttttaagatatatgtctgttttaatttgtttctactgaccaccaactttttcattcattataataatgcttaattcccagtttggtaaaattaatcttagttgtgttttatttttgtaacaaaggatgactgcagtgagagattccctgtcctgattccctgactaccagagagtaggtttcagccttcccttctgaaagacaagaatgcacatgccattctaaggtcacacattttctcaccagactctgggcattatcctactgtcttctgacagtcagcatgcaatggagaggtccaaggcagcctcactttgattcttgttcagatatttacatgttttatgttctttcctctgaagttaaccaaaaaaagcaagaaaacaaaacccattaaactccttgtcaaatcatcaaggcttagtagtattttcatttgtccttttagcctttattcatagttttgtttttaatttaagaaaataattttggtttccttgcagtccttactaattttaacctattaacctgttgttctcattctggagggccttaaaaaaaaagttacaattttatctcagacattcctttccttgggttttatgtttctatttcattgaggctgcttcatcttgcattcttctggaaataccagtgtctttccttaatattcagatacatgttttgctgaatcttagagattttgttccttttccactgtttatttttagaggatgttgttttactcatctaagaaaatgtaaactttttattaagttgatgttgatcaacagcaatggacagtagaattctctctgcttactttggtggtggttggatacagaatttggacctacaacataggttgaatagaaatgtataggtcttagttcagtcttggtttttagcaaggttttactttgtacttcctttgtattgtaggagcattgttcctcacctttgttgccttttttttttttagaaaaaaatatgtattgacaaattataattgtatatatttacggggtacaaagtaatgttatgatttaagttgtttaatttttaatatttgttggtacataagggttatatatatttatggggtacatgagatactttgatataggcgtacagtgcataataatcacatcatgacaaatggggtatctgccccctcaaacacttatcctttttgttataacaatccaattatactattagttattttaaaatgtataattaagttattattgactgttatgctataaaatactaggtcttattcattctttacaactacttcttgtacccattaatcatccccacttccctccctacacacccactaccctccccagcctctggtaactatccttctattctctttctccatgaattcaattgttttaatttttagctcccacaaataagtgagaatatatgaagtttgtctttctgtacttggtttatttcacttaacacaatgaccaccagttccatacatgttgcaaataatgggattctcttttatggctgaatagcactccactgtgtatatgtgccacattttctttatctattcatctgctgatggacacttaggttacttccaaatcttacctattgtgaacagtgctgtgataaatgtgggagtgcagatatcccttttacatgctgatttcctttcttttgggtatatacctaggagtgagattgctaggtcctttggtagctctatttttagttttgaggaacttccaaacttttctccatagtgactaccaatttacattcctactaacagtgtatgagggttcccttttctctgcatcctctctagcatttgttgcttgttgcctgtcttttggataaaagccattttaactggggtgagatatctttttgtagttttggtttgcatttctctgatgatgagtgatgttgggaactttttcgtatacctgtttgtcatttgtatgccttcttttgcaaaatgtctattcagattttttgcccatttttaaatcaaattattagatttttcctgtatatctgtttgaacttgttatgtattctggttactaatcccttttcagatggatagtttgcaaatattttctcccatgctttgggctgtctcttcactttgttggttatttcttttccagtgcagaagttttttaacttgatgtgatcccatttgtctgtttttgctttggatcacttgtgttcgtggggtattactcaagaaatttttgcccagaccaatgtcctggagagttttccaaagtaatagtaatagtaactgttcaagtaatagtttcatattttgaggtgttagatttaattctttcattcgtttggttttacctttttatatgatgagaaaataggggtctagtttcattcctctgcatatggatatccagttttcccagaaccatttattgaagaccatcttcttctgaatgtatgttcttgacacctttgtcaaaaatgaatttcctatgggtgtatggatttgtttctgggatttctattctgtcgcattggcctatgtgcctgtttttatgccagtaccatgctgttttggttactatggctctgtagtatattttgaagtcaggtaaagtgattcctctagttttgttctttttgcttaggatagctttgtctattttgggtcttttgtggtttcatataaattttagggttgttttctctatttctgtaagaatgccattggtattttgatagggattgtattgaatctgtagattgttttgggaaatatggatattctaacaatattgattcttccaattcatgaatatggaatatctttccatttttttattccttctttgatttctttcaccaatgttttgccatttttattgtagagatctctcacttctttggttgggttaatttctagatatttaatcttatttgtggttatattaaatgggattactttcttgatttctttttcagattgttcactgttgtcatgtagaaatgctactgatttttgtatgttgattttgtatcttgaaactttaatttgtttatcagttctagtagttttttgtgctagagtgtttagatttttttcaaatataagataatattatctgcagcaaggataatttgagttcttcctttctagtgtggatgccctttattattattatttattattattattattattattatttgattgctctggctagaagttccagtactatgttaaataacagtggtgaaggtgtccttgttgtgttttagatcttagaggaaaggctttcaggttttccctcattcagtgtgatactagctgtgggtctgttgtatatgacttttattatgttaagggatgttccccagttttttgagggtttttaatcataaagggatgttgaatttactgaatactttttcagtatcaattgaaatgattatatggtgtttatccttcattctgttgttatgatgtatcacattgattgatttgtatatgttgaaacatccttacatccctaggataaatttcacttggtcatgatgaatgatctttttaattcattgttgaattcagtttgcttgtatgttgttgaggatttttgcatcaacattcatcagagatattggcacatagttttctttttttgatatattgtctgatgtgggtattaaggtaatactggcctcatagattgagtttggaagtagtctctcctcttctacttttcagaatagtttgagtaggattggtattaatttgttaaacatttggtagaattcagcagtgaaatcattgggtcccaggctttattttttgctgggatattttattatggcttcaatcttgttacttgttattcacatgttcagattttgaatttcttcatggttcaatcttggtaggttgtatgtgtctaggaatttatccatttcctctagattttccatttatgggcatatagtagccactaatgatcctttgaattgctgtggtatcagttgtaatttctcctttttcatctctgattttatttatttaggttttccctctttttttctcagtctggctacaggtttgtcaattttatttatcttttcaaaaaacaaatttttattttattgatcgtttatattattttctttatttcacattcatttatttctgttttaatctttatttattttttaccaattttgggtttggtttgctcttgcttttctagttctttaatatgattattaggttctttatttgacatttttcttcttttttgttgtagccatttatagctataaattttcttcttggtactgcttttgctgtatttcatagattttggtatgttgtgctctcattagcatttaaataaatttttcaatttctttcttaatttctttactaatctactggttatttgtgatcatattgtttaatttccatgtgtctctgtaatttccaaaattcttcttgttcttgatttctagctttattctcttgtggtcagggaagatatttgttattatttcaaagtttttgaatcttttaagatttgttttgtgatctcatgtatgttctttccttgacagtgatctacgtgctgagaaggagaatatatattctgaagctgtggagggaaaggttctgcagtatctgttagatccatttgttctatagtacagattaagtccaatgtttctttgttgattttctgtttataatatctgttcagtgctgcaagtggggcattgaagtccccaggtattgttatattgaggtctatctctctctttatctctcataatatttgctttatatatctgagtgctcctgtgttgggtacataaatatttacaattgttttaccttcttgctgaattgacccttttatcgtgatgtaatgaccttctttgtctcttcttatggattttgtcttgaaatccattttgtctgatataaatatagctactcatgctacattttggtttccatttgcatggaatatagtttttccatccctttattttcagtctatgtgtatttttataggaaaaatgtatttcttgtaggcagcagatcattgagtcttgtacattttttttcatttggccactctgttttttgattggagagttttgtcaacttacactcaatattattgataaaaaaggatttactcctgctatgttattgttttctgtttgttttggcatcttctcatctttcttttattcctttattgaagatgattttctctggttgtatgatttaattttctgctttttattttgttgtttatctgttgtatgttcattgatttgagttaccgtgaagcttgcaaatactattgtataacccactattttaaattgatgacaacttaacagtgattgcataaacaaacaggcaaaaggaaactactaaaaactctaggttttaatcttgtcctccagcttcttaactttttttgtttctctttaagttttttgtactatctatgtcttcaaaagttattgtagttattatttttgattgggttcatcacttagtctttctacttgataagagtagtttacacaccacaattacagtattataatattctgtatttttctgtgtgctcactattaccagtgagctttacactttcagataatttcttattgctcatgaacaaccttttctttcagattgaacaaatgtttttagcatttcttgtaggacaggtctgttattgatgaaatcattcggcttttctttgactgggaaagtctttttttttcccttcatgtttgatagatattttcactggatatactcttgtaggataaaagttttttctatcaacactttaaatatgtcttgccattccctttttgcctgtaaggtttccactgaaagtctgctgccagacatattggagcttcattgtatgttatttgtttcctttctcttgctgcttttagaatcctttttttattcttgacctttgggagtttgattattaaatggctcagagtagtcttcttttggttaaatctgcttggtgttctatttgtttggtgcaaaagtaatcacggtttttgacattaaaagtaattacttttggcaattaaaagtaattaccacaattacatttgcaccaacgtaatataaccttcttgtacttaaatgttgatatccttctctcagtttggtaagttctctgatattatccctttgaataaacttcctgcctctatctctttctcttcctccactttaaggtcaataactcttagatttgccctttcgaggctattttctaaatcttatatgcgtgcttcattcttgtctgttctttgttcttttgcctcctctgactgtatttttaagtagcctgtcttcaagctcatcaattctttcttctgcttgatcaattatactgttaagaggctctgatgcattctttagtatgtcaattgtaccttccccttccttccttccttcctttctccatccctccctccctccctccctcccttcctcccttccttccttcctctctctctccctttcactttctctttccctttctctttctctcttttttctttttctttttttttttttgacagagtctcagtctatcacccaggctggagtgcagtggtgcaatcttggctcactgcctcaccctgtcacccaggttggagtgcaatggcgcaatcttggctcactgcaacctctgcttcccaggttcaagtgactctcctgcctcagcctcccgagtaactgggattacaggtgcacaccaccacgcctggctaatttttgtattttttagtcaagatggggtttcaccatgttgcccaggctggtcttgaactcctgacctcaggtgatctacctgccttggcctcccaaagtgctgggattacagacatgagccactgcacccaggaatcaaatgtatttttcgactctagaattacttcttgattcttttgattttttcaatctctttattaaatttatctgatagaattctgaattccttctctatgttatcttgaatttctttgagtttcctcaaaacggctattttgaattatctatgtgaaaggtcacatatctctgtttctccaggattgatcctgccttagctcatttggtgaggtcatgttttcctggatggccttgatgttcagagatgtttgtcagtgtctggacgttgaagagttaagtatttattttagtgtttacagtctgggcttgtttgtgcccatatttttggggaaggctgggctactgtcatagtggcagcctttttgctttcttctttggccccctctcagctgctaatgtctatctaactacctaacataaccactacctgcctaccacctatgttcactcaaggccctagggctctacaatcagcaggtggagaaaccagccatgtttgtgtcattcccttcagggggtgagttcccccaggccctggctggacccagagaagctgtctgggatccagggattagagtcaagtatcttagaaatctacctggtactctattttgctgcggctaagctggctgtcaaaccacaagtcagaatccttccctccttttcctcccttttgactgtcagaggagcctctctcagtggccaccatcactactggctcacagggagttcttcaaggccaacgctgatgtccctttaaagcccaagaatcagcttgtgataaatgctgccaggcctgtgactcacccttcaaggcagtgggctcccttctggtccaagacaggtccagaaataatgtccaagagcctaggcttggactctgataccctaagagctcactcaggtaccataagcgctccaccccactatggctgagctggtacataagattcaagacaaagtcatctttcctttgccctctgcccttctcaagcagaaagattattttatcatagccactacagctaggaatgtgctggatctctcctgaagccaacacaactcagtctcatccaaggcccatggcatattacctgggtatcactgccagttattcaggactcaaaagttctttcgtcatcgagtgatgagtcctgccacgactggggccttcctttcaaggcagcgggttcccttctggctgaagttattctagaaatgtcatcccggagcaaaggcctagattggaggcctcatgaatttgcctggtgccctatttgattgtggctgagctgttaaaagtcctgtttattttttctctcctctctaacagaaggaaggagtcactttcattgccaccagctatgctgccttgggttgagggaagggtggtgcaagaacttccttagctgaccccactggtgtctccctaggtcacatgccaccctagtccactggctgtaatcccagcctagaattaggatttgcctgggaattttagtccttgtgttctaggctccctttcaagtttacctaggaccctagagccctttagccagagatggtaaggcttgctgaaactcaggttccaactgctgggatggatgactcccctccagctagggctggtccaaatgctacctccatgtgtgggcactgactgagccctgcatgattttgctctctgctgtgacagggcagcatttagttcagtgccaagtcccccagtcactgtgctcttcctcccccaagtgcacagattccctctccacaccatacagctgctgcaggggtatgggggagggatgtaatcagcgatttatgactgtctctcccaccctcttcagtgcctcttttagtgatatgaagttaaaaccaggtactgtaattgctcacctaatttttggttcttatgatggtgctttttttgtgtgtagttagttgttaaaatttggtgtttctgcaggagggacaatcagtagaggcttccattctaccatcttgttccacctctattgtgatttttgatgagaatatggaataactaaattaagctgattagcatacccattacttcaaatattttaacttttgtgtgataagcatattagacggttactttctagcaatattgaaatgtacagtactcagttattagctgtatttagcatgttgtgcaatagatctcaaaataaaatcagatttatttattctatctaattgagcctttgtatgctttgactattatcttctgattctcttcaccattcagtctttggtaatcatgattctactgtctgtttctgtgatttcagttgttttagattccacatgttagtgacaatatgtggtatttgtttttctgtatttgacttatttcccataacataatgttctctaattctgtccatatcatcacaaatgacataatttcttcctttttaagggctgaatagtattccattgtatgtatatgtatatatatgtatgtatgtatgcatatatattttttctttattcattttctttatttatccatcccttgatggacatgcaggttgattccataacttagctattgtgaatagcgctgcaatgaacatgggactacagctaactcttcaacataatgatttcaaatctttcagttaaatacccagaatcagaattgctgggtcaaataatattatatttttagtttttttgagtgatctttatactttctctttcataatgtttatactaatacactttcctatcaatagcatgtaagggttcccttttctccacatcctcaccaacacttgtcttttctctttttgataacagatttaacaaatgtaaagcgatatctcattgtgtttttaatttgcatctccctaatgattagaaatgttgaacatttcttcatgtatctgttagctattcagatgtcttatttttagaaatgtgtttcttgcccattacttaattagattattggttttctttctgagaaagtttgtttgaatttcttatatattttggatattaatagcttatcagatatatggcttacaaatattttctcccaatccatagattgtctcttcactgctgttttctttgatgtgcagtagctttttattttgatataatcccgtttgtctttgtttctattgcttgagtttttggagtcaagtctaaaaaatcattgcccagaccaaagtcatgtagttttttctcctatgtttttttttcctacgaatgttatagatttgggtcttatgtttcaatctgtaatctattttgaattgagttttggatatcgcataagataagtgtccaatttcattcttttgcaggctgtcttttctgaaagctttctgaataagtgtagaacatgaaaacaggccccgtctcataagcagcccccagtgtttgaggagcaaagtgccctgtcttctggttggaaagcttccttcctctgtgagccggggttcagaggacatatgcatatgtatggggggggaggtggatacaaagtttgcctgccttttttttcttcatatattctctctttatgatttgaatccttattatgatctgagctgcagttgtgatagtttttggttgttttagtgccactcttcacttctgtcttgtaactattaagacaccttctaatgttattattatactgcttttttgtgggctgagtttttaattctatgggcattttagggaaatattagaaatgtcattccttaatgacatctaaggttggaagttagagctttggttttgaataataaatccgataagataaagtgtgaatcaccatgggcaaaaactcttcttttcttcagatatctaggcaagggaccatggggaatgaaacaaagagaagagctgaggagttaaagaagcagaaatgacatatgcaaacatagattgggtaccatagaacctaactcttgaccagggccagtgaaaaaaatagaatcaaatataattctgaagtagagatgtttgagtcaggattttctgaagagtgacatgttaataagcaacagagaacatgaaaaaggaaccactgggggactagatgctgtctttacttttagatgttattattttattttttggtgtttgttacatgttcaaaggtacatatgcatcctgaaactgaaaggcataaagttgtgattttgatataatttgttacctgtgaatacggtagatggttgccaaaattatgtagcataaataatataaacatgtggtatcatcctctgtaatgatactaatatgttgtgatttccaaaaagaatgatgatgccttatagctttgagttattacatatatgtatgtgtgtatatatatatatatgtctgtgtatctacatatatatattatgtgtgtatatatatttatatatatgtcttgtgatattgctttagcatttgcatttggcatgatcatttaaaatatttttaaatatgcaatgcatggccatggtataaatatccaggctataaaaaggtacagtcaaggtgtgtcaaagtcactgaaaggtatagttttccccagtcatgcagcatttctcttcacagatttcttgtttagttttgtgtaccttctatgtgtagatttgtgttacagtgagaaggagttgttcttcagcacattctttccaatttctaaataataattggtcattgtttgctcatctgtgaggtcagtttgggttatttatatttcctgaagaaagagagggttaaaggctagggtggaaaagtattgggtacctagtcggagtagggaaatgtgtcattaaggttctcccttgctcctcccatgatgaggtctcagcagagatgatgaaggactcagataaagagataagaatgaagtcacctgggctagaaatgccaatacatgtaagagcatgcctggccaaaggagcctgagaccttgactgggacttctctcagagacttcagtgtgttggctgtgcaccaagtctcatagaggaagggcaactttcccccatgaggcctgtcaggtacagattttgtaatggcctgtggtcaggcctgaaaagttgcataagtctttaattggaagcaagactcctcaaatccccccaccccaatcatgtttaattatatccgtgtatggtctagcttttgttgtttttgtttactgcttgtgtgtgtgtgtgtgtgtgtgtgtgtgtgtgtgtgtgtgtgtgttttgcatggcctcatctttcttcctataatttggaggatttctagcctgtgtttagcttctgtggtttcctctacaaatataactctatataatgcttggtttcctacttctttacagggactatattaactcttcagtataaacaatagcaaagttatttagtatattcctaactccacatgtcatctcctctctttctttttaaatagatctcctttcatctttttccctctagcttttttcttttgggaaagcatcatggcatgagactagaagtgagacttggacccacagccagaggttctgggtgcaacacatctctcagatctaatctagcacattgatttggtccaatgtaactgtcatatatggtcctgaattctgtcccctttaaatctgtaaaataataataacctcaatttatccatgtctttttttttttgaggtaaaatacattagaatctctgaaagacactgacagatttaaagaatggtataaaactgaggcattatcatcttatggctactggttatcaacagcttattaacaaaaaaatgaagctcttttttctgatagctgtagtttcaactttttttttaataataatgattcttagtgtattttgacacataatatggtaaagtaacctgtgctcacataggaatttgtttttaatatcactttaggaaaataaaaatcttagtaagtttaccttcccttgcttaaatatctaaaaatatcagccaggtagagaatagttgtactaacattctcaatctatcaatatcttgtaaatagtaaagttttggtatttctttatataaaaatttcttatataattaaaaagttaaatagattagaaaatacgttagaaaaatttgaaatactaaagtttaaaaacctccctgacaatatctattatggaattaataatgcatttaaaatttttgaatctacatatatttggaaaataatacaaatatgtgtaagctatattacagacaattgttatgtgaattagtggctctcatatttactatccggaatctgtaaaatttaacagtgacttgcttgatctctaacactaactttgtggaagaattagatttggtaaaggagttctaagaaaactggaactgtattgttttctggatagtttttaaaactgaacctgtgtgtgtcataaattaagacaccaaatgaaagaaacattaaatgaaaagtctgagtgactgcggaaacggtgataaacataagccaccatttgttctttaaaaacatgtctttgatatattagtcttttcctccaataaattattaagtgggaagattggcagctgctatgaacagagcatgtgtgtaatttaatgagcttttttttttttttttttgccagtagtttataacattttcttcatgggcaagaacaaaaaaaaaaaatctcaggagtatgaaaatataattgtgtgttaatttttctgttttgaaaagatgtaacttaatcagatttgtgacgtctccctcagccaagcacaaaggaataaaatgaataaaaatcattactgaagtcccgaaatgaatgactgttttctcttatgttgcaattgtagtgatgtttaaataccaatctgaaatacccgagagaacttcaacttgtattagagggttatataggtgtgtatgtgtgtgtgtacctttaaaccggggggataaacttattctacctttcaaagaagataaggccgggcgtggttgctcatgtgtgtaatcccagcacccagactccatctcaaaacaaaacaaaacaaaacaaaaacaaaaacaaagaagaaggtaaaaacatattcctaatccatatgtaagaaacaaatcagcatgagagcatcgtaatctttctaaaacaatgtcaagctgtcatggagtgtatgctccctgaagctgtctttggattcagtttctttggttttggtcacaggctcagggccttctcctaacaaacacatggcccatgtttaagagctaacaagaccaacagacaggagcctgtgacattcctgttaacacacaaaaacaattcagatattcaggatccagtcacttgatgaaagggcaggtggtaaactgggggttaaccttcctataaagtatggccagtggcagtagagaatccagcagtttggaagcaaatgaatttaaaatactatctggaaagcaaatcaaatcaggaccattgagctgttctttcttgactctcattgacctactttcacggtttacagactgctgataatataaaggaaattaaatgcctgcagtgagaaggttcttgatctggcaaagacccctcagagtgctccaaacattttatttaatttccaaaatttcttgatctgttatgtcattaaataaagggggagaaacagctagtcagcatgcatcatgataaaagccacttgaagctcacttttctgtcccacccaggactaaaaaatgtcttgcctttccaagtggtgctgaagcgtaaagcatacagttatgactttcactgctaggttgagataactgaaatgcaagtgcatggaaaccgtaaaatggatgtgagcattttctaataatatcaatatgattgacagtgattttgattaaggagatgttggttagcatctcacagagatagattagaagatttatatagatgagctcacttcttctaggtcagtcagaatgagctctggtttagataataagctcttgccttgctgaaaggctttattatcatatgacctccttttgtatgcaaatctgcacaaggctgtacccacttagtgcttccatctggattataagaagacaccatggaaaatgggtcctgttcacttaaactgagttgtcaggttggtcttcgtagatccttatttgcccccaaaattcacataaagaaatttagctattcacagagcagcaggtatttaagccaataaaatagagcatgggaaatcacagtacagtttgacttaacatgtctttaaaatgctatttgagtactgacctctactgtggtttagcacactctggatcttctccgcaaacattctaccgaactacttatagtgatagacacatcactgcttaataaaatctaaagaattgatagatatgctgtgtgcaaaagttgagtgaggtgattcccactaactgcaaagcaactgcaaccattttaattgtacggcacacagaagataccctgctctgaaagtggaagtaaaggttcttcatttgttttcattatgaagtcatgcccttagtttaaaaatataatctaagtaattaaaaattaggcagctgtcattgaactggatgacgggttgctttgaaggcagaaagaccttttccattgttgaatccctgtgttcgcagagtgctgtatttcctgttttgaagtagaaagatactgagtagaaaaaaatgagtatgggccttgggcagtgcagaggctgcaagggtgctggggtcattggacaatgcaaagaatatctgaatatgtattccatatctttatatgttttagaacatttaaaatatatattatatggctttacattgttagggagctcattgagattggggagtagttggtaggagaccatccaaacacattctatcagaacttatataaaaccttttttagacatgaacatttgtgctaggtgattaattaatgtgtggagattaccaacaaattttaaaatatcaacttaaacattgagtatataatactcataaatcataaatatatgggttgatgaacttttatagtattagcatacatgtaactatcatcaggagagagacctttggcagacccccaagaaactcctttcatgaccctatctaaaccaaagataaacactgttctggcttttattagcataggttagttttacttgtttgtgaattttatataaatgagatcatacagtttatatttttacatgagcgattttttcctataaaatcatatttgtaaaatgcttccatattgtcacatgttgcaatagttttattgtcattaataatgacagatatttgttaggaacaatccccaatacgtatatgaatgaaattgcctccatagagcatgtgtgtgtttagcttttgtaaatactggtagtgttttggttaactaagacataattcacatactatcaaacttataattttttaaatgcaacaattcagtgatttttaccatattcataaagccatatgatgatttccactaactctagaacactttcattactttgaaaagaaaccctataccaattaacaatcattctccattgcgtccccccattgtcaaccattaatttactttctatctccatggatttgagtatcctggaaattccatataaataggttcatacaataacttccttttatctcaaattcttttcctgttttatcataaaagggtattgaattttgtcaaattctttttctgagtttaatgagatgtgtggtttttgcactttattccattaacatggtatagatgattggtagaatcaacaaataattaattttatatattaaactaactttgcattcctggaataaattacacttgagcatagtgcctacttctctttatatgggctggatttgatttacttgtattctgttgaggatttttaaacatctatttataagaaataatgttatatagttttctgtcatgtctttagttgtggtatcagggtgatactgaccttatgtaattagcttgggaattttttttctcttctactttttgaaatagtctagaagcattagtattaatccatttttaaatatttggtagaactcaccagtgaaaccatttggtagtgggcttttatttatgaaaaggttttttggcattgtttttattgtttttattattattattactaattcagtatctttatttgtggatctgtttagattttctttttctcatttggtcactttcagtattttctgtctttctaggaatttgtccgtgttatctaaatttcttaggattttggcatacgaatatttagactattaaaaaattttccatttctttaagattggtagaaatattttatttcttattttagtaattttaatattcttgttcccttttgttggtcattgtagctatgagtttgtagatttgattgaccttaaagaatcaagatttgattatgattattttctttattatttcttccctattttatttatttctgctcaaatcattatttttttattctgttttctttaggtttagtttgctttagtttttctaatttcttaatgtaaatggctaggttattgttctgacatctacctttttaaaaaataatacagatattacagctgtatcttctctttatgtacctttttagctgaataccatgttttgatatgttgtgtttttgttttcattcatctcaaagtattttttcattttccttttgatttcttctttgacccattggttatgaaatagtatgttgtttaatttctacacatttggaatttcccaaagattgcttctgtattgatttttaattttagtccattgtagtcaaagaacatactttgtatgatttcagtccttttcacttactgagtttttttgtttgcttgtttgtttgtttgttttttgatggagtgttgctctttcacccaggctggagtgcagtggcatgatctcggctcattgcaacccccacctctcacgttctagtgattctcctgcctcagccttccaagtagctgggaatacaggcatctgccaccatggccagctaatttttgcatttttggtagagagtgtttttcatcatatcgggcaggctggtcttgaactcctaacctaaaatggtctgctcaccttggtctcccaaagtgctagaattacaggcttgcgctactgcacccagctaataagtctttttatttgtttgtttgtttttttaatagccaaacacttgttctattctggagaattgcttctatatacatttgagaagaatgttcagtctgctctttttggatggagagttctaagtctctatagtctcttaggtctagttatcttgttgtattgttccaatctcctatatttttgttaatcttctagcatagttattctattaaatattgaatatagtgtattgaacttgttctattgttgaattgtctatttctccctttaatgctgtcagcatttgctttgtgtgttgtgtggctctgttcttaatttcatgtttttatgattagtctgtcttcctaaggaattgacccttctattgttataagatgtttttctttgtttttagtaacaatattttcttcaagtctattttgttatatattagtagagtcacctcagctctcttttggatactgatttcattgtatatctttttgcatcctctttttttttttttttttttttttgagatggagtctcactctgtcgcccaggctggagtgcagtggcgcaatcttggctcactgcaagctctgcctcccaggtttacaccattctcctgcctcagcctcccaagtagctgggactacaggcgcctgccaccacgcctggccaattttttgttttttagtagagacggggtttcaccatgttagccagggtggtcttgatctcctcacctcgtgatccacccgcctcggcctcccaaagtgctggtattacaggtgtgagccaccgcacccagctgcatccttttactttcaaactatttgtgactttgattctaaagtgtatattttatagacagcatacagttggataattaaaaaaaaatccagtctgccaatctatgaatttgttaaatggtagaattaattgataattatgtggtaattacattaaatgtaaatgagctaaataatctaattattgagatggtaaaattggtttccaccattttactatttgttttctatatttcctctatatttttcattcctctgttcttctattactgccatcttttgtgctaaataagtattttctaacataccactttaagtccttattgtgtttttttgctatatatatttttgagttattttcttagcagttttcctggggattgcaactaacatcttgagttaaaattctctaatttagattaataccaacttaatttcaatagtttataaaattgtgtttctacatagctcctctcccatttatgctattattattacaaattacatttttagagattgtgtgctcatcagcattgatttttaaattattctattatggaaatgcatttaactaaaacagaaaaaggaattacaagaaacacgtacatttatcttgtcatttatatttctttatatggtaatcttaaccagtgctttttgttttatttcattatgtggattcatgttactgttagtacttttcatttcagcttaaagacttcatttagtaattttgaggcagttccactgtcaacaaactctctcagtttttgttgagctgtgaatatcttaatctctcattaaattttaaaagatagtcatttcttctttatttcttctttactgtagaattctaggctagctttttttttttcttttaaccttttgacactttgtgtatgccatcctattgtgttctggcctctgtgatgtctgttaagaaagcagctattaaccttcctggagattctttttacactatgagtcacttctctcattgccatcatgattctccctttgtctgaagtctttgacagtttgattatgatttgtctaggtatagattattttgtatatattatacacataaggatctcattcctgaatatatacaacattattattttctttcaatctttataactttctttttcttgccttattgcactggccagcactggcattataatgttgaatagaagaggtggtaatggggaccttacttttgtttttgatatgaaagggaaaactttaaatattttatgattaacataggctgggtgcagtggctcatgtctgtaatcccagcactgtgggaggccgaggtggatggatcacttaaggttaggagttcaacagcagcctgcccaacgtggcaaaaccccatctctactaaaaataccaaaaaattagctgggcctggtggcacacgcatgtaatcccagctacttgggaggctgaggcatgagaatcatttgaatcctggaggcagaatttgcagtgagccgagaccgtgccaatgcattccagcctgggtgatggagtgaaactttgtctcaaataaaataaaatacatattttattattaacagaaatatatagcttttatggacttggcatacattttaaaatcagattaagaaagttcttttatattttcctttctagctcaatttttgacttttatttatttatttttataaagaatatatttagagacagggtcttgctctgtcacccaggctggagtacagcagcatgatcatagctcaccacagcctcaaacatctgggctcacataatctttctgcttcagccttctagtaggtgggactacatgcccagctatttttataagcaataattttaacattttactattttttctcaccttttctttatactcttagtatattatgtgacattaaataatttttaaattttatttaaaaaatattgaattcatggataaagttgacttggtcaaaatttaataccccttttatatatcacttgatttaattgggtaatagttactaaaattttgtggtgattattatatgaaattatcttgtgaattttacttattgtaacacatttgccaggtttaattgtcaaggaataatggcctcagtaagtaacttgaaaattgtttccagcctgttttccagaatagtgtatgatccatgtaatttttacatagatgtttcaaagaatgccctaatgaaagcatttgggtctaaatttatcaaaacaattttaattaatgattcaatttcgttttacatgtagaaatttttaggctttctatttcttccttttcttggtttattatgttttaagggatttttctattccatctaaattattccatttctatgcagaaatttggtgcataatatactaaaattttatttttaatatctatcttaagtgatgttagtattcctgatactggtattttgtatcaaattatattaatgtttctattcattactatgtttaaagtactctgttactgtcttaattttgcttattataactttccagttataaaatttttatttgattttttaaacagatttcaattttctagtataattcacctctttttcctcttttttgttcatttattaattaaactatgttaaagtctatgtctgataactccaatatctatatcacttgtgggtttatttttattttatttgttttttatcttatttatttatttttttaagtggtattcctggtgtattcattttctaggactactgtaaaaatataccactgtctgggtgcagtggctcatgcttgtaatcccagtgctctgggaggttaagatgggaggatcatttgaggctaggagtttgagaccagcctgggcaacatagcgagactccatctccacaaaacagaaacaaaacaaaacaaaacaacaacagcaacaacaaaacatttaattagccaggcctgatggtgcatatatgtagtctgagctacttgggaggctgaggtgggaggattgctggagcccaggagttcgaggctgcagtaagctatgattgtaccactgcactccaagctcagctacagagtgagactccatctcaaagcaacaacaacaagaacaacaacagaacacaaacttagtggcttaaaccaggaaaatttattctctcatggttctagaggcttgaactccgagatcaagctgttgccattagttccttctgattgctgtggggaagggatctgctacagccctgtctccttggcttataaaggaccatcttctctctgtgtgtttatatagtcttccctctatatatgtgtctgtgtccacattttcctttttttaaggacatcagtcataccagattaaagcccaccatagtagcctcatttggatttgattttctctgtgacattttatcttcaaataaggtcatattccaaggcatggggagttaggaccccaatattattattattattactattattttggatgggacacgattcaacccataacaactgataaattttgattaaatgaaaatatttagagtctctggatgattctgttttacttcaaagagaattctctttagctttgatatggaattagaatagataaaattatctcagaaaatgggatgatcttactaaatacgttttttaaagggcttgtctatttttacatttccggaggcttcactgttcaatggccctgactgaaagccacgttcatttgccagagtcccaacacctgaatgtctgcttaatgacagtttctgttatcccagctggttattccaggtttgttataaatttgataggtttagttactttttagattcttagatttgtgtcttgatttccctcttcaattatagacctgcattactcatacattaatgaacatctcaagcatgagacacctagagttacagggtttttcttactttcttccccctgggatattggcctctcaagtcctgtctgctctggtagccctgaatctcaatttttatctcttccaaagactaataacagctttgcttagctcctctgccttttagccatcactttctccacaacatcattacttcttcttcctcattttatatgtgtgactaatatttcgaggaaaaacaaacaaaacacatgtctcctctcagtgagtttcttctttttgggatttgaatctttaattcctagtctttaaatagatttttctgcattttatccagctgttccattgttttatgggctattgaaaacaactcccattttagcatcaattttgataataaagcaaaaggataatatagcacatggatggtatatttgaagccacaggtaatatatacattaacatttataaatattcccctatccagaaaatacttgaaacttgagtttccagtagacattttttttttgcataacacatgtaaacattttatggtacatacttagacttaacatttattcattgtctatctgaactataaacttaagtggatattttgtatttttttctggcaatcttgctctctttagaagaatgcataaacaataatacaccagaataattatggtacaaaagctgattggagcactatggaaagattctaactaaaaattatacatggatatttttattatttaaatataagggaatggttttttaaaagttgatactctaaagacttaaaggttaaaattttatgacataagtgtggaaactttcatgataaatgtgctagctgaatttgaaagataggagaatatggatgtaatagaaactaatgtaaaggaaattaagtacccagtagatcttaaattctgttttctcttatatttatcacatacaacagaattaaaagtgcggaatattaaattagcgctgccagtgataaacttgagaaattgttctactgtgtagattagaagccattgacatgatgagtaagagaatggtatacaatgtagaggatggagagatacatttaaaatttatagcttttcctgtgggtcagagatgtggaacatgaaaaaatgaaacaaaaactctactgaaaaaggtactgagttgtggcttttggtacaacatttaaagagcttgcaagttgtcactttcattttcacaacaggaaaataccttaaaaactaaaaattatcaactcttcttagatccctcagagatttgaggtcagaaagcaaactgctaccccagtactagagagacagtcaggggaccccctacacccatgggttcatatccatggattcaactaactgtgccacaaaatattcagaaaaaaagggatgattctgccggtactgaacatgtacagacttttcctgttgttagtattccctaaaaaatacagcataaccaccgtttatatagcatttacattgcattaggtattataagtcatctagaaatgatttaaagtatttgggaagatgtatgtaggttataagcaaattctacagtattttatataaaggacttgagcatctgtggatttttagtatccaaagggagtcctagacccaccccccatggatatagaaaaacgactgtactagaaggaagcccaggactgtgaatcaggagacccagaagcagaagtcaccatatgaggccaggatcagtaggaacacatccgctataatcaaaaagtgatgtaggctcagtgtggactaacttgaaagtagccttgggggctcctcactgatgagtattacctacaggaaccctaccagattctccatgtgaagacaggggaaaaatcctttcgtgctttcagcaggagttaattatatagaagtatgcccagacctctgtaagcattagaaagaccagcccaaaggggaaactgcttttccagagcctaactgacctgggaaaagggaaatgcccagctcaggctctagaagactgagacatgattgtgggaatatagaactcttcccctcaaccaactcctcaccaccacatcagtggtgctcctgtgtaataaccagggactaagagaactacaagcctcagactctatttaagatggaatctctaggcaaacccaaagacaactgggtataaacagaaggacactagaactaacaccactgagacagccaccagtaagcacaatataacttctagtcagataaactcaaacctcacactaaaagcccaaataacagcttaacaataaagaaatagacatcatccaaactatgctgtcaaaccacaatggaattaaactagaaataaaaaatagaaggatagctttagaaatccccaaatatttggacattaaataacctatttctgggtaacacacacgttaaaggaatcagaaaagaaattacaaaaattaagcttcaatgaaaatgaaatttaaacctatcacagtttgtggaatacagcaaaagttgtgcttaaaggaaaattcatggaatttgatgcatctgttagaaaagattagagacctaaaatagataatctaagcttatatgttactaaactagagggagaggagcaaattaaattgaaagtaagtagaagaaaagaaatgataaaaattagtggagaaatcaataaaattataaaaaggaaaataataaagaaaaatcaatgaaactaaaagctgaaatcaatgaattaaaagatgaaataaataaaattgataaactcctagtgagattatccatgaaaaaaagaaaatacaaattactaatatcaaaaaccaaagatgttatccttactactctcatgaacattaaaatattaataaggaaatattttgagcaactctatgcccacatctttgataacttacttgaaatgggccaattccctgaagacacaatttacccaaacacatacaaggagaaatagacaatccaaataggtatatatcattgaaagaaattgaatcaataactaatgaccataaaagcaaaagcactagacttaggtgatctcactggtgaattctaccatttaagaaagaaatgatatcaatttactgcaatgtcttttagaaaatagatacagaacaattatggttaactgtttttatgaggccagcattatcataatactgaaaccagacaagggcattacaagaaaggaaaactatagcctagtatctcttatgaatatacatgcaaaaattttcaacaaagtatcaaattgagtctaacaatgtacgaaaagaattatatactatgacaaagaaggacttattccagataggcaaggttcgttcaatttttgaaaatcaattaatataatccattacaacaatagaataaaaggaaaagatggtttgatcctattaacagatgcataacaacatttttcacaaaagccaacacttattcatgatactaactctcagcaaactaggaacagaaaggacattcctcaacttgataaagaacactgtaataaaccttcaagtgatatactaaatcatgagaagctagctacctttctcctaagtttgggaacaagatgtcctctctctccattcttacctcaatactctgccagcaagcagtcctacgtaatgcaataagagcagaaaagggagttaaaatcacacagattgtgaaggaataaataaaactgttattgcttatagatgacatgattatatatgtagaaactcccaaagaattgtcaaaaaaatactcctagaactaatagccatttatatcaaggtttcaggatacaacgttaatatagaaaagtcatgtttccctatatatctacaatgaataattggaatttgaaattttaaaaacatatcatttacattaacaatccccaaaatgaaatacttagctataaatctaacaaattatgtgaggaaaactacaaaatcctaatgaaataaatagaaaaagctctaaataaatagatattccatgttttggggtagaaaaacttaacatcaacaagatattggttcttcccaacctgaatgttaggtttaacacaaccccaatcaaaatcccagtgttactttgtggatattaacaaactgattttcaagtttatgtggaaagacaaaagatccatgataggcaacacagtatggaagaacaaagtctgaagactgacattacctgactttaagatttactataaaagcacagtaattcccagagatagccccacatcaatacagtcaactgatatatgacaaaagaacaaaggcaaccatgtgggcaaataatcatctttgcaacaaatggtgccagaacaaatggacatccacatgccagacaatgaatctgggcacttaacttatacctgtgacaaaaattaactccaagtggatctatgacctgattgtaaaatacaaattataaaagttctagaaaataacataggataaaatctaggtgaccttggatgtgacaatgcctttttagagacaatatcaaaagcatgatccataaaagaaaatgttggtaagtttgacttcattaaagtacatttctgctcctgcaaaagacactgttaagacattaaaaagtcaatccatagactgggaaaaaattttgcagacccatgtctcataaaagacttgtatatgaaatacataaagaatccttaaaattaaacaataagaaaacacagagttaaaacatgggtgaaagatatgaacagatgtatcaccaaagaagacagatgcaaataagttcataagatgctcaacatcatatgtcattggaaaattgcaaataaaagcaacaatgcaatgcatctatatagctaatagaatgagtaaaatacaaaacactgacaataccaaatgttgacaacagtgtagagcaataggaactctcatttgctgctgatgggaattcaaaatggtacaaccactttggcagacagtttggcagaatcttataaaactaaatatagtcttcccacctgattcagcaatacatattaataaaaaaacagtttgattatgtatgtagacacaggagtttcacacaaaaaataagactcaaggagctgcccagatgattgaggcttatgtaccatataaggctaaacaaagcaaaagggatttggggattctgggcaggggaggccagctatgggaaggtgaggggaggaaatgtatggtggactagggttgtctcattatgcagataagagtctctccagttcagagttttctgggaaagtagctctctttctggtagggagacatctttacaaatgaaaatttcctttgtaaatgtgaatttccttttcaaaagaagacatttatactgaatttttaggcagttaaggagagataaagagcttttcctttgtcctctggttctcagttgcctttagctcaaaataatccatatgccaaagaggcctattttggggtgacttcttgtattcttcacgtctcatgaaatgaacctattattgtgaaatgaactaattgttttaaataaactgcagtggacttgttattgatgagccacattttaaaaatgggttggtgccagtttgggaaactgctgttctcagcctgtgctgcttctctctgcagagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggtaaatctccctggggtcttctagataaagggacccattgaggaatgcttggtgaccacctctggctccaaggcagctctctcaccctatgaggagaaggaactgtagtatcagataaacttacctgcaagagattttctaatatgattatactgaagaaaacattaaatatatttcccttattttacattatatatttaaaaggtatctgtgtgaggcagtcatgtggtcggagttaaagcataaatacatcatttataactttgtatcccccttgctcttttcttcctctctaaatgccttttacatttattgaactacaaacttgtattcaggaagaaatatcacaaactctgtattttcagggcttgtgaaagtgtgggcacaaattatgtgtggaatctgggggactgctggaaggaatgacttcctgatgagtgggcggacagattcctcctgccaggggattccttctgccaggggattcctttctgggtggtcttaggggaatgaaggagtggcagaaactgagacccccacctccatcactgcctgtgacaggagagaggcaggtggagcagtgagagagcaaaagacagctgccacttcttctgtgtgagtagaggtcagcgaagcagagcggacagccttgattgacagctcaggatgttgtaccgtgagccaccaaaattgcagttacttaagcacatttttaccttttctgcacctcattatagaaagtctggggtgcgtgctcctcagatttctggattctgaactagaagcagaaataagtggcttatattatgcgtttgcaattagattctgcgggagagggaaaattctaggactcacaggagacaaaactaatagccttcgccttcactggtccatgaacgttcattctctgttctgtttttataatgcttcagcatttgtttcttatttatgctttctaactttaagtgaaactaaacagaatgtctgcacctcattgtaaggactctggccccttttcccatctcccgtcttaataaagcaaagataactgaccaccccacagagacctgctggttgtagttaaacagttattggcatccgtggctaattgttggatcaatttttaatcggtgtttatctctgtcagctcctctttgttagtttttgatgaaagaggcgggtgcttggcaaaggctttaagctggcacttttgtttttcgagggaaacatgcttatgaaaaagctctcgttaatgtaggtcggtgctttctgtcattcagggcaattgtgtcttgatattcatctgtcttacaactttgtttttctgaattgttctaccaataaaagttatttaaatggtaaccaattaggaactgccttcatttcctttataaaactgtaactgattttgcagacagtattgctacttgctcttgtttctaagatgtctgcacacttttgcatctgtttccaaaggagttagctccttttctggaaacaaattttcttttctatatattttgggaatatttaagttatagaacaggcatatccattttgaggtgcttatcacaagatgtccagaaagaattattataaaataatggaaaataaagttttatctttcagtatttattccacatcaggtactgttctaagtattttacagcaaccatatgaagtagatgcttattcccattttacaaactgagaaattagacacagtttaattgagacacagagacacaggaaaactgagacaccagagaaattaggccacttgcccatgttcacatggctagtatttggcaaggttttactttgaaaccatataaaccagctccagggtacaagttcttgactaagacattactctgacacttagtttattcaggctgttagttgtataagatggaatttctggtggtattaacagttcagtcttatttttataaccctgggatggccaaagaagtggaaactgtgtggggttagtgcatgacttctctaacatggggctcctcctgctgcctggctttccattggtctggagttggactcaacatgtgtgcctcacctccaggctttcagaactcatagatatgggggtaatctttagacacatctgctgctcaccttagttgttttcttcaggctgccatctattttcattgtaacatggagagccaccattgtaagctctatgattctagtgcaagaccctctgtgcttgcggggaggctcctttgttcagccttacagtcccctctcctccctcccggggaccctcagagcccatgccatggctgagccagtccacctgtgctccacttgctggtcatttctaagtatggtcaaattgctcacttcctcaacctttcaaaagtttgatgaggtaagaataagatgccacttcataaagcttgaacttaggtttgacaagttaacaatgatttccaaatttcccatgatttacactgcacaaaactgtgcagtgtacatatttgagcctcaatttaattaaccttgtaaagcatgttatattaagttatatcacttggttattaccaaatgatgcaagagatgagggctacatagtctgggatgctagagaaaatgtgtcagagttcatcatgctaggtagtttcaatgttagtgtcataccataacaaacaaccagtacttctaaatgggaagagatttggcaaattctgtgttttagttttccctggtatagaagaggtatggcccctcatcatcttagttttgttaatacctgcacattcctaccagggactgtccctactgtgtcttgcttccccttatcttctgtaaagacatgacttttatatttaagttttcttccattcacacagtcagtttagctagaaggagctagaatttataagatagtaggaatggggacaggaggtcatcttcagaggaagggccaggataaacatttccatctgaaatccttggttccctttccctactttacgactcattttggtctttaatctcacagaaatgttgacctggccattatgtgtgctagtggaaacactttggctttggagtctgatagatgtatgtgtgaatctcagggcaatttattttggctccagtgatgtttatggaagtcctactatgtgccaaacatgaataaacactggggatttccatcccagtgcatatcccattgagattcatcccaaaaccaatgcatccgcaaacgaaagcatcccaaaacaaatgcatcccagtaacttgcctgaagtatggtacaatttctagagcttcatgagagaaaaataccaaacctcagagagagattctgtgaacttttgacattttgggattttaggcagtattttgccaactgagattgctaaggcattgcttttgccattactttgacagtattgctgagtgcagaaaagactacagcaaaatacttcttattaggctattttcagttattttctgacaacatgacattcagaaaacattggatcaaactaatacatttgttcctgtatactctggaatctttcctatggttaaccaatccagaatttgcaggctgcaatatttaaccttttgtgaaattgggaaaacatgacatatgtttcctaacttcataaaaatatgcaataataatttggcaagtttattcaaaatgtaacttgcattctcaggtgcatttctccagaaccaggtacatatattattatttttatttcatttgtcagtttatcagttttcttttatgtatggctaatctttgaataacatggatgagagtaactaaacatttctttctaatacatgcacacatacacacattttcattctctttttcttgtaatatttatagatctaaaaataaccaaaacaatcattatcacaatttgtcatttttgccagcctcaccactgttagtacagcaggtccccaaataacattgtttagttcaacattgtttcattacaatgatgagaaaagtaaaattgattttctgccaggaccactgtcggagaggagtttgcacgctctctccatggctgcatacattttctccaggtacacttgttttctgtcatgtcccaaagctgtgtacattagtttctttggtgtgtctatattgagcccatgtgggtgagtatatgtgggcgtgtgagtgtaccctcgatggaatggcatgctgtccagggctggttcctgccttgtgcactgagcttccaggatgggctctgaccaccctcaaccctgaactggaataattgggtaaatcatgtttttgttaatctttcacaaatatatgtgtagctcacatttatttcagtgtttgctattagaagtttttttttatttagaagtttggagatgtttttgtgaccagacatatgacataggaacttttatttctaccaatcagcttatggtaaaattggtttcattaaatgttgattcggttaaagcggtctccaagaacatatagatgacattaagtaaggacttttttccgacagataaagctttctaacagggtctatcatgctcttagttttcttctcttttatggggacatctgcctccttttccaggaagcctccctggtttccttccttcatctctcatatgagtgtttatctagcactgatttacacttcttggccattcttctgtgagaaaaatttggacgaagctacatgactacttctgctatctctttaattcctgaaatgccaggcatttatatttcttcatttataagacccttcctttaatatttgtgtttgtttgcttgtgatgaataaaacgttttgttttgatattttaaaattcacttaagtgaatttttattcaacttgtgataattaaaatagttgttctgaatggagccaggaaaaaggatgattcatataaaacattctggggaaaatgactttactttcaataagaccaactactggccttgagaagattttcttaggcagatagcaggagattaaatatttcatctttatatatcttttaggccttgaaatctgcatttcctagaattatactattttaccataagaccagtccttgagcctcttcattcatttgcaacatattttgaagttgcacaagtaaagccatataataatttctgttgaaagattttactggggggcataatgattatcctaatatttgtagaggttcttaatgcttcattatcattattgttattatcctaacttttatgtacttgtcaaaaagagtatacacattagtttatatttattcagttatttgggatgcacaattattaaccaatctttttagtcctatagaatttttccctcttctcctaaatttgaattaaaatatgatcttggtcaatttggctatatgattatatctaaaaaatgaatctatattaatacttctatggtcataagagttaaataaaattgtttggaaaatttttaaattatgctaagttggaaacaaaaaaattgcttaccttggaccccaggaagaattaatccagcataggagatagaactggaaacagaaaatatagtgtggtacaaattacagtgggaaatgctaaataaaagtgttctatagacacatataatacacagaagaggtgacacatatatcacacagaagaagtgacaattattttttctgatgagagatatgggctgggccttctaggatgtgggacaagctggcagggtggaaggcagggaagaagaaagaagctgtgaaccgcaggctcttgggtacagtctgaactctcctgtggctggaggggtgaggtttgacaaatgctgccaccatccttgggtcttggcaaagtggttttcagcagttgcaaataagaaatatttcccattctcctccccatctctagttactttataaaccaaactctgagtttgcaaacattaacagtggcttctcaatgtcaaagggatatttctttccttgtgttaatattgaaaattccctccagccataaaaatgaacaaaatcacatcctttgcagcagcatggatgcagctggaggcatcatcctaagcaaattaacacaggaacacaaaaccaaataccgtgtgttctcgtttataggggggagcttaacattgggtacacatgggcacaaacatggcagcagtagacacgtgggaatccaaaagtgcggagggagggcgtgtgacaaggggtgaagaactacctgttgggttccatgctcactacttgggtgggatcattagaagcccaaacctcagtgtcacacaatatacccatgtagcaaacctgcacatagactccctgaatctaaaataataaagaaaattttctgcttcggttgtcttctccctttaagttttgacaccgctattagtttcattcccatttgtttccttctcagttttctttttggcatacccttctctgctcacctcaacatgcttatttatctggacccccaaccttgagtgtgtttcttgcccacccttctccctgaactctagatgtgattattctgaccatcacttagatgtctccagctgcagaaaactcccacctgttcactctcaattactgcctgtatggtaaagggggatgtttcaggagatgtacttgattgtatgtgtgaaggtcggcagggttagtgggaggtagaagcaggaatgaggactgagaccagctgtctggtgggcactttggtgaatgctggtgtgcacatggacatgcctctcttccaggttgctggagacctcatcaggcgcttacacctcgaagcccacgcggacaaacctgtggccacctacagtgggggaaccaagcggaaactctctacagccctggccctggtggggaaacctgacattcttttattggtgagtagaagaatgtcaatatcttggagtaagatacatattgcatattgatttataaactgattttaagggtttttctgggaagtaacttcagaacttgcaaagctggttctacaaactagtaaactgttttgccataagccagcatttcccaaatgtcatttgtattttacagaaataaaacatttattttttgctagattcacttatatttgtcaagctgaaaattctataaaattttaacattaaaacagtgttttaaaagattattagaattcatctgtaatctgaaaaccaattatgttttcctctagaatattgcttttatgtctttttctgtgtgtagatgtatgtttatcacagcagtagtgacacctgtcatggtgaatcttaaagatgggtgttgagagtgaaggatggatatgatgttgagagtagggaagaaaactccagcaagagggtagagtatatgcaatggtcttgagacagggtggtctataatcaatctgggaactgcagttaatttgatttgaatgaatcaaagcattaattggaggcaacaattgtcaagaaatggagttaattatcttgcatttcataaaacagctataactgttaatacaagtaatgccattgaaagaataaataaaggctattgttacatgccataaattggattctaatcagtagagtgcatctttggacttcacaccagtagagagtctgaggggtgtcaaaaagtgtggaaaacaaaacagattcctttttttctatctttcttcatcaaatgaatacacccttttagtggggtagtaaatggggattgagaaggtctgtgtgggaaaatggtctcatcgtttgctggttgtctcctggaaactcacctgaatattctttttaggtaccataaatttgcttttgcaatgtccaaattcctagactattgtatagtttcatattccagaatctgataataaaaactaccatttgcacaatcctgaagtttacaaattacattttattttcaacatgaggcaggattatgttgagtagttaacaagacgtgggcattcattactttctgtggaatttccctttgcccagcctcttacaatgcatctccttagttgaatgaaggggcctctgctctgtagccatgacctgctcactgcagaccctgacatgcttttctttgatacatccttgctctcagctttccttggatgcccaaacctgtgacagagtggtcaaggtggggactctggagtctgactgacaagctttgaattttgcttctgcagctgcccaacacttggccttgtatgttctatgcctgtttccttctcatctgaaaattttcctgataatagtgtctgtctcatggagtcattgaaagcagtaaataaaataaactacattaagcatatagcccagtgtctagcagatggtaaaccacagtaaatattcgtgactatgatgatggttactgttcagagcaataggttaaagagatttgttgccaggcctttggagttctcaacagagagactagaagtgattctcagagctgacatcaaggagggaatcaggaaaacgtaaattacacatacaactctcataatgagcattgcatgatcacaccttttatttacttatttttataactaatacacatatattgcttgatttgcagaaaagactagatatttattttcctgttcagtgcttctccccctacacttactgcttcccatctgtttctttctttatggaagtttatgaacctaagctcttaagaaatatgtgtttagtactccctggctaataaaagcacagaaatacatcttacagtttggcgagatttctctagaagtggttcatataaggaatactttggtgtctattgaaggagaaagcttcaagttctaagaaatattaatttatttgatgttgctaaataaatgaagcctttttctgctatcatatgtcttcctaggggatatcattccgaaattttatggaggttgaaaattcattttagaaacatcagggttggcttacctagccagatcatggaggagaaccaacctgacatgaaaatatagcccaattcccctcctctcagttttatggaagtataattaactgataaaaatggtatctatttaatgaattcaacatgtgttttgatatacataaatattctgatgtgttgactacaatcaaactaataaacatattgatgacatcacataattgccattttttcccctgtatgtgatgagaacacttaatatctaccctcttagcaaatttcaaatatgtaatacagcatcgttatctacagtccctctcttagttcactgtgctgctataacagactggataatttataaagaacagagaacagaaattcaggttttggagtctgggaagtccaagatcaaggcactgccaggtccaggtgtctgctgagggtgccaaccctgcttcctgaaacctgtgccctccagaggggaggaataggtgtcatcacaaggcaaaagtcagaagggcaaaaagaggtgaatgtccttcatcaggtccttttataaggtcacttaatcttataaactcattcacctcccaaaggtcacacctctcaatactgtttcattagggattgagttttaacatgaattctgtaggggacaaaacatccaaactatagcagccctatatcctgtatattaggtctccagaacttgtttgtcctgtataactgaaattttctgccctttgacaagtatctccccatttccacagcctggcacctttctactctctcttcctatgtgttcaactttttaatatttcactaagaagtagtgtttttccatgcatggcttatttcactttatgcttggcataaagtcctccagattcacttatgttgttgaaaatggaaggatttccttatttttcaggcagaataatatttcattacacacacacacacacacacagtgagagagaggagagagagagagacaaggaaacagggagagagagagaaagagagagagagagacatacacattttcttttcccatttatacacttagggatgcttaggttgtttctatatcttggcttctgtaaataatgttgtcatgaatatagcactgcaaatatcccttccagatattgattttatttcctttggatacacacacagaagtgagattactggatcagtggcagtagtatttttaatttgtagaggaacctccacactgttttccataatatgtgtacatttacatttccaccaattgtgtataagggttcacttttctccgaatccttgccattgctggttatcttctgtccttttaacaatagccattctaacaagtataagatgatatctcattgtggttttcatttgcatttccctgattattaataatgtcgaacatcttttcatatacctattggccatttgcatgtcttcttttgagaaaagtctgttcaagttttttgtctatttttaattattattatttgctatttagttttacgactttcatatataggatgtaaccccttattggatatatggttgcaaatattttatcccccgctgtagtttgtctgctttgttgatattttcctttcttgtgcagaaactcttttcgtttgaaatagtcccactttatgtttgcttctattttatgtgcttttggtgtcatatccaaaaaagaaacaagcaaaacattgccaagaccaatgtcaaggagctcttctttttttttttctacaagtttcatggtttctcatcttatgtttaaatctttaatacatgttcagttgatttttgtgtatggtgtaagataaggaccgagttttaattttttgtatgtagatattcagttttcccaaagccatatattgaagagactgtccttttcccagttttaatttcagtgtatttgtcaaagattaattgactatatgtgtgtgggtttatttctgtactgtctattcttttctatgaatctatacatctgtttttatacaagtaccatactttttaaattataatagcatagtagtatattttgaaaataggaaatgtgaggcctccagcaccattcttcttgcttactttctttagctatttgtggtcttttgggttttttaaatataaatttcagtattttggttttctatttcagtgaaaaaatgacaatggaattgtaggaatagcactgagtctgtagatcgctttgggtaatatggacatttaaaaatattaattctttcaatccatgtacatggatagctctccatttatttgtcttcaatttctttaatcaaaatgttatagttttcagtatacagatctttcacttcctttgttaaaattatgcctaagtattttattcattttgatcttattgtaaatgaaattgtctaaaatttccttttctgataacccattgttattttatggaagcactattgatatttgtatgttgattttgtatcatatgactttattgcatttgtttattaattctaatggattctttggtggagtctatagtgttttctgtatgttagatcatgcttttgaaaagatgattttacttcttttttgatttggatgccttttctttgtcttgactaattgctctggttaggacttctagtattatgttgaatagaagtggctagagtgggcatccttgtcttgttcttcttagatttgaagtttttagcttttcactgttgaatatgatgttagttgtgggcttatgatatatggccttttattcttttctatttctgctaactttgggattagttcatttctttatccagtttcttcaattgcaaaggtaagatatttatttgaaatctttctttttttcttaatgttgatgacttcttcctcaaatctgcttttacttcatcccataagttttgttttgtttccattttcatttgtctcaagatacatgtattttttaaaattttctttttaatttcatttttgacccattggttgttcaggaacatattgttaatttacacatatttgtgaattttacagttttcctccttattaatttctagtatcataccatggtggtctgaaatgatactggatatgatttcaatttttttaaaattgtttagacttgttttgtggcctaatatatggtctctcctggagagtattttatgtgttctggagaagaatgtgtattctgctattgttggatggaatgttctgtgtatggctgttaggtccatttggtctaaagggtagttcaagtacattgtttccttattgattttctgactggttattcaatgtatcattgaaagtggagccttgaactcccctattattattgtacttatgtcttttactcctttcagttttgttaatatttgcattacatatatagtactctaatgtttagtgcatatctatttacaattactcttttatcattttatataaattgaccattttatcattgtatttttctctttttacagtttttgacttaaagcatattttgtgtgacataaatatagataaacatgccctctgggtcatcatttgcttggagtatctttacctattgtttcacactcagtctatgtgtatccaaaaaaactgtactaagtctcttgcaaacagcataagattggatcttggtttttatccattcattcactttatgccttttgattggcaaatgctgtctatttacatttaatgtaattattaataggtaggatcatattcttgacattttgttaattgttttctggctatttttaaagttatttattcttttttttcctctattactgcttttcttttaatttgataatttttttttgtgttggtatgttggtatgctttgattcatttctgtttttttttcttttgtgtgtgtgtgtgtgtgtatgtgtgtgtgtgtgcatcttctataggttttttatttgtggttaccaagaatctatataaaacatcttatagttacaaaagtctatttttaacctgatagtaactgaacttatatcacattaaaaaaaaactacacttttgcttccaaccatctcattttatgttttagatgtcacaatttgcagctctttatattgtatttccattaaaaaattattatagctatagttatttttaatactttgtgttttaatctgaatattaccattataagtgatttatacaccaacattaaagcattaaagtatgctgaatgtggctgtatacttaactttactgtgagttttataatttcatgttgctaattagaatccttttattttgttttgaagaacccctttagcattttttttttataagacaggtattgtgtcaatgaactctttcagcttttgtttgggagcatttttttttttataagacaggtattgtgtcaatgaactctttcagcttttgtttgggaaattctttatctcttttttatctctgaagggcagctttgctgggtaaagtaggtaaagtatttttatttggcaggttttttttctttcataggcccactctttcccagtcctgaagatttcttctgaaaaatccactgatagccttgtggatgtatgtcatgagccttttttttcctcttgttgctgtgaaaattctgtttttcatttttgacagtttgattattgcgtatctcagtgaataatttgttgggttgaagctatttgggaacttttaagcttcatatatcttgatgttcaaatgtctatctctttatccaaatttgggaatgtttcagccattatttatttaataagcattctgctgcccctttttctcaccttttttattttgtaaatctcatattgtaaaagttaggtctctggataatgtgccataaaccctgtcaggctttctttgttcttcttaattcttttttacttttttaaaattttccttgactggataatttcaaataatctgccctcaagttcacagattttttttatctgcttgatcaaatgtgcttttctctattatattttttatttcattttatttttctgcgccagtatttctatttggttctttttttttataattttgatctgttttttgaatttctctggatgaggtgagaaagaagtggggctcctgggtagcatgctgcatggctggaggagtcaggccctcactcattgctctctcacattcccctatcattctggctttgttgagcagagtgcaacaaagccaattggagaggtgtcttttagagccagagcagagatttttctttcacctggggtctggcctcccatgtcattgtgtatatttctatttgtgtttttcaaatgctgattactctgtgttgcctttccttcaggatgagcccagctctgggatggatccctgctctaagcggtacctgtggcaaacaataatgaaggaggttcgggaaggctgtgctgcggtgctgacctcccacaggtgagttccagtttctcttgtagccatttcctgataagactgagtaacaaaggttaagaagtgcatttaggtacctgcacagtgttacacatggacatttcttaatctttacaacacaataatggtgatattattgttagccctcattgtataaattgagactgaagccatgagggattacgttatataaccaagtttacatagcaaataggtggcagagctagaatttgaacctagtgttctgtgtccaaagatgatattcttgcctcatccattgctactgttcaaggatgagtgctagactaccattttcaggtcttcctgagggatctttcagatcctttccatccaaggcctattatttcagcaggtagaattagctgaactaaaatacttaacaggttactgaatctggtttaacattttctttatcacagaattaagtttgtaattagatttcaaaaccattggcttctttttaactttctaatacactgttctagcccacaaagaattacaaatatagatttcataaaacctacttatggggagtgagcaatatgatttaactaatacaaattctaatgatgtaataaagaccaggctttaatgtttagacttgttttgtctttatgtttaagtaaaatatactgtgaataagatgtcaagagctgccaaagatctcacattttgcccttttgcaagctaacaaatttagcttgatacagttttatggatgttgacagaagaaatgagacttctgggtcggagatgaaagactttattgctcacagcaagaacagtagccagagtgtcagcatggtttctcattggttccctaaaccccagtttctattggactaatggatgcctgcacacagaggagaggaatgccaaatctggtgaaattactaccttataacatctgataaggaagccagcccttcgtttgggaggaggtgtcgcttcttccatggttgtttgctactagcataactttgagaaatggcccagttaaagagcagttagggccttatattcttggaattcatggcaagacacgtaggaacacaagggacccatggaaacatgcttcccaacagtctaaatcattcagtctatgcttgagtaccccagctcttgttaccaggagtgaaatataaagctagccctatcatttgaaacgtgagatttctgagaggacctcaggagactttactgattactgcagcattattagtttacgtaaaaatactattaaatgctataactcagcatgcataatcctattacacataaatcttacagccatttcctgtaacaagtgttactggctgcaaagccaatgtattgtgaagaactcagccattcacacatttctcacattgcttcatgtcaaagtagacttttcttaattttctatctctgggctctttcttttttaaaaaaattcattcactgataggtttgtctatactgcttaacattccccaattttcactgccagactaaactttacactgttgtttttttaaatgccattttctgaagtataatttacatttgatataacttaaccactgtaagtatggaattctatgattctttagtaaatttatagacttgtgcaaatattaccataaataagccttagaatatttgggtcacctcccccaaattttctcatgcttactttcagttaaattagcatttgaggctaggtgccgtggctcatgcctgtaatcccagcacgttgggaggccaaggcgggcggatcacgaggtcaggagatcaagaccatggagaaaccacatctctactaaaaatacaaaaaattagccaggcgtggtggcgggcgcctgtagtcccagctactcaagaggctgaggcaggagaatgtcatgagaccgggaggtggagcttgcagtgagccaagatcgggccactgcactccagcctgggcgtcagagcaagactccgtctcaaaaacaacaaccacaacaaaaaaattagcattcaaaacctccacctaggaaaacattgatggctttctgcctctgtaaatttgctttatatggatatttcattaactgaatcatataatcagtagtctgctgcatctcttttttttatttatcataacactttttttttttgagacagagtcttgctcagtcacccaggctggagtgcagtggcacgatcttggctcactgcaagctccgcctcctgggttcacgccattctcctgcctcagcctcccgggtagctgggactacaggcacctgccaccaagcctggctaattttttgtattttagtagagacggggtttcaccgtgttagccaggatggtctcgatctcctgaccttgtgatccgcccgcctgggcctcccaaagtgctgggattacaggcgtgagccaccatgcccggcctatggcaacacttttaaaggctatccattgcgttttatgtcaataggttgctccttttcattccaaacggtatcccattttatagctataccacttttatttatccattcaccagttgataagcatttgggttgtttccagtgttttgctattatgaataatatgttatgaacagtcatataaatgtctttgtatgtatagacatgttttaatttttttagatttttctgagtcaagttgctagattgaatagtaagttgtatttgagactttaagaaactgcagagttatttcccaaattggccttatcagtatatgttcccagcaacaatgatgagtctcctttattccacatccttgtcactactgtctgtcttttttcattataggcatcctagtgaagtggggttttaattcacattttcctaaggactaacgctgttagaatcttttcatgtgcctattggttatttgtattacttctttagtgaaatttttattccaatatctcctccatcctccattttttaaaaatggcttgatactttagaatagttttaggttcactgaaaaattgagaggaaggtacagaaattttttaaatccctccttgccttcacacatgcatatccttccctattatcagcatacattaccagagtgatacatttattaaaattgatgagcctacattgacagcacattaccaccccaatccaatttacatagggttctctcttgatgttggacattttatgggtttggacaaatatctaataagaatccaccattatagtatcagatagaattgtttctctgccctaaaaattttctgtgttccacctattcatctctccctcctgcctaacccctggtaaccactcatctttttactgtctccatagttttaccttttccacaatgccatatagttggaatcatatagtatgtagtcttttcaggttgacttttttcatttagtttctcccatgtcttctcatggcttgatagctcatttcatttcagtcctgagtcatattccactatctggatgtactacagcttatttatccactcatccgctgaaccacatcttggttgcttccaagttttgacaattttgaataaagctgcttaaggatccgtgtgcagttttttgtgtgaacatattttcaactcctttgggtaaataccaaggaatgtgattgctggatcggatggtaagagtatgttaatttttgtaaggatcctttatatttgaattgttttttatctattatttttgaattgtaatagttctttttatgtagcagatattcctatattctgaatagaagtcccttgctggataaatgatttgcaaatatgtatttccagtctatggctgtctttccattttattaataatgtctttcgaagtgcaaacattttaaattttgattacattcagtttatcaatttatttttatatggtttgtgcttttggtgtctcatctaagaactatttgttcaaatgaagtcctaaagattttcttctatcttttttttctaaaaattttagaattttggctcttatatttaagtctttgatctatttcaagctaagttttgtgtatagtatgagaaaaggatataaattcacttttatgcatgttaatatccaattatttcagcactcttccttgaaaagattatcttttatcccactgaattgtcatagcacctttattatattatttattgtatgatttatttttggactctcaattattatccattgatatgtatgcttattttctcacccaataatatcatgttgattatggttgttttctattaagttttgaaaacagtaagtgttattccttcagctttttccttctattataaaatttttcattatcttgaaatatttttcaatttctcttgtgattacttctttgacccttagtttatttagaagtgtcattcaattttcagatactgggagatttttaagagatttttttttctgttattcatctctgatttaatttggttgtcattagataaaataagttgtatgatttccatcattttaaatttgttatgactttttaatggcctaccagaggggttacagttttttttttataaaacaccatattttaattgttttttatctattatttttgaattgtaatagttctttttatgtagcagatattcctatattctgaatagaagtcccttgctggataaatgatttgcaaatatgtatttccagtctatggctgtctttccattttattaataatgtctttggaagtgcaaatattttaaattttgattacattcagtttatcaatttagaactagaaataccatttgaccaagcaatcccattactgagtatttggttttgcaagtcgtatggtgtgtactgcagtatccaactccactgtgtagtgtgaaagcttccaccagtattaggtaaatgcataattgtggttgtattccaataaaattttatttgttcctctcccccatcccccacaaaatggtggcaggctggatttagccaatgggctgcagttttttactccaggcttaacatatggtctatcctagagaattgtctatgcaaaggaatatgtattctgtagtagttggatggaatattgtatatacagcaagtcagcaagttagcttgacagtgttgtttaagtattctgtattcttgggaattttttcctgggtattctatcaattactgaaaataagatattgaaatattcaagtataattgttacatttttcttttccttctttagattctgtcagtttttgcttcatatatttggagtctgtgtagttaggtgaatatgcattcttaattgctatcatactaatattttgactttcttatcattatgaaatgtctctgttttactctagcagtatgttttatcttaaatcctattttgtttcttaaaatagccattgcctctgtcttttggataatgtttgtgtggtatatcttttcatattcttttactttcaaataatttgtgtctttgaataggagtgtttcctatagattgtgtatagttggatattgtttttttttttcccaatctgacaatgtctgccttttgtgggaggtatttaaactgtcccacatttaatgtaattattgatatggctgaagtaacattgactgttttgctattttttacataatgtctcctgtgtttcttgtatctgtttctacttggcagccttatatattaaatgaataatttgaagtatactgtatttaatgttttatctattttttttagttatgttcttactggctagtctaaggatgatagtatacgtcttgatgctaacttaattctagaaaagtgttgtaatcttgccctaatatggctctatttcctccctttttctttgtgctattattaccatatatattgcattttatatgctataaatccaataaggcatattttaagtttcactttatacacttttaaatcttttaaagaagataagaaaatatatcaaaaagacatatccacagtcttaaatagtaatccatacaattgtcatttctgacgcatatctgtccatatgaaaaatgtgagaaaattttggccattatttactcaaatactttttctggtcctatctatctttccttttcttttggtcttccattacgtgtatgttgaaactctgatcttatcgcacaagtctgagttcttgctcattttttttagtcttgtttttttctatttttggattggataatctttattgatctatgtgttcactgactcctctgccattttgaatctggtgttgacccctctagtgaatttttccttaatttcttgtaatctttaactgatttattttttttataatttttatccccttcttcagaatccccacttactaatgtggttgtcagacttttctttaattctttttattttttattattatacttaaagttatggggtatgtgtgcagaacgtgcaggtttgttacataggtatacatgtgccatggtggtttgcagcacccatcaacctgtcatctacattaggtatttctcctaatgctatccgtcacccagcctcccacccccgcaacaggccccggtgtgtgatgctctctgtgtccatgtgtcctcattgttcaactcccacttatgagtgagaacatgtggtgtttggttttctgatttgtgttactttgctgagaatgatgatttccagcttcatccatgtccctgcaagggacatgaactaattcttttttatggctgcataatattccatgatgtatatgtaccacattttctttatccagtctatcattgatgggcatttgggttggttccaagtctttgcttttgtgaacagttcctcagtaaacatatgtgtgcatgtgtcatcatagtagaataatctgtaatcctttgggtatatacccagtaatgggattgctgggtcaaatggtatttctagttctagatccttgaggaattgccacactgtcttccacaattggtgaactaatttacactcccacccacagtgcaaaagtgttcctatttctccacatcctctccagcatctgttgttttctgactttttaatgatcaccattctaactggcctgagatggtatctcattgtggatttgatttgcatttctctaatgaccagtgatgatgagctttttttcatatgtttgttggctgcataaatgttttcttttgagaagtgtctgttcatatcctttgcccactttttgatggggttgtttctttttttcttgtaaatttgtttaagttctttgtagattctggatattagccctttgtcagatagaaagattgcaaaaattttctcccattctgtaggttgcctgttcactctgatggtagtttcgtttgctgtgcagaagctctttagtttaattagataccatttgtcaattttggattttgttgccattgcttttggtgttttagtcatgaagtctttgcccatgcctatgtcgtgaatggtattgcctaggttttcttctagggtttttatggttttaggtcttacatttaagtctttaatccatcttgagttaattttcctataaggtgtaaggaagtgatccagtttcagctttctgcatatagctacccagttttcccgacaccatttattaaatagggaattctttccccattgcttgtttttgccagttttgtcaaagatcagatggttgtagatgtgtggtgttatttctgaggcctctgttctgttcccttggtctatatatctgtattggtaccagtaccatgctgtttctgttaccatagctttgtagtatagtttgaagtcaggtagcgtgatgcccccagctttgttctttttgcttaggattgtcttggttacgcgggctcttttttggttccatatgaaatttaaagtggttttttttttccaattctgtgaagaaagtcagtggtagcttgatggggatagcattgaatctataaattattttggacagtatggccattttcatgatattgattcttcctatccatgagcatggaatgtttttttcacttgattgtgtcctcttttatttccttgagcagtggtttgtagttgtccttgaagaggtacttcacattccttgtaagttgtattcctatgaattttattctctttgtagcaattgtgaatgggagttcattcatgatttgactctctgtttgtctgttattggtatataggaatgtttgtaatttttgcgcattgattttgtatcctgagactttgcttgagttgcctctcagctttaggagatttagggttgagatgatggggtttgctaaatatatagtcatgtcaactgcaagcagaggcaatttgacttcctcttttcctaactgaatatgctttatttctttctcttgcctgatagccctggccagaactttcaacactatgttgaatagtagtggtgagagagggcatcctcatcttgtgctggttttcaaagagaatgcttctaggttttgcgcattcaatatgatagtgcctgtgggtttttcataaataatcttattattttgcagtatgttccatcaatacctagtttattgagagtttttagcatgaagggctgttgaattttgtcgaaggctttttctgcatctattgagataatcatgtggttttcgtcgttgattctgtttatgtgatggattatgtttattgatttgcatattttgaaccagccttgcatcccagggatgaagctgacttgattgtggtggataagctttttgatgtgctgctggattcagtttgtcagtattttattgaggattttcgcatcaatgtttatcagggatattggcctaaaattttctttttttgttctttttctgccaggttttggtatcaggatgatgctggcctcataaaatgagttacagaggattccctctttttctattgattggaatagtttcagaaggaatggtaccagctcctctttgtacctctagtagaatttggctgtgaattcgtctggtcctggactttttttggttggtaggctattaattactgcctcaatttcagaatttgttattggtctattcagggatttgacttctttctggtttagtctttggagggtgtatattatttcagtaatttatccatttctcctagattttctagtttagttgcatagaggtgtttatagtattctctgatggtagtttgtatttctgtgggatcagtggtggtatcccctttatcattttttattgcatctatttgattcttctctcttttcttctttattaatctggctagtagtctgtctattttgttgatcttttcaaaaagcagctcctggattcattgattttttgaaggatttgttgtgtctctatctccttcagttctgctgtgatcttagttatttattgtcttctgctcgcttttgaatttgtttgctcttgcttctctagttctttcaattgtgatgttagggtgtcaattttagatctttccagctttctcttgtgggcatttagtgctataaatttccctctacacacggctttaaatgtgtcccagagattctggtacactgtgcctttgttctcactggtttcaaagaacatctttatttctgccttcattttgttatttacccagtaatcattcaggagcaggttgttcagtttccatgtagttgtgcggttttgagtgagtttcttaatcctgagttctaatttgattgcactgtggtctgagagactgttatgatttccgttcttttgcagttgctgaggagtgttttacttccaattatgtggtcaattttagaataagcatgatgtggtactgagaagaatgtatattctgttgatttggggtggagagttctgtagatgtctgttaggtctgcttggtccagagctgagttcaagtcctggatatccttgttaattttctgtctcagtgatctgtctaatattgacagtagggtgttaaagtctactactattattgtgtgggagtataaatctctttgtaggtctctaagaatttgctttatgaatctgggtgctcctgtgttgggtgaataaatatttaggatagttagctcttcttgttgcattgatccctttaccattatgtaatggccttctttgtctcttttgatctttgttggtttaaagtctgttttatcagagactaggattgcaatctctgctttcttttgctttccatttgcttggtaaatattcctccatccctttattttgagcctattttgtgtctttgtacatgagatgggtctcctgaataaagcacacccatgggtcttgactctttatctaatttgccagtctgtgtcttttaattggggcacgtagcccatttacatttaaggttaatattgttatgtgtgaatttgatcctatcattatgatgctagctggttattttgcctgttagttgatgcagtttcttcatagcatcgatggtctttacaatttggtatgtttttgcagtggctgataccagttgttcctttacatgttcagtgcttccttcaggagctcttgtaaggcagccctggtggtgacaaaatctctcagcatttgcttgtctgtaaaggatttgcttgtctgtaaaggctggatatgaaattctaggttgaaaattctgtacattaagaatgctgaatattgtcccccattctcctctggcttgtagggtttctgcagagagatccactgttagtctgatgggcttccctttttgggtaacccgacttttctctctggctgcccttaacattttttccttcatttccaccttggtgaatctgatgattatgtgtcttggggttgctcttctcaaggaatatctttgtggtgttctctgtatttcctgtattggaatgttgaccttccttcctaggtttgtgaagttctcctggataatatcctgaagagtgttttccaacttggttccattctccccatcactttcaggtacaccaatcaaatgtagatttggtcttttcacatagtcccatatttcttggatgctttcttcatttcttttcactctttttctctaatcatgtcttcttgctttatttcattgaattgatcttcagtctctgatatcctttcttccacttgatcaattcagctagtgatacttgtgcatgcttcacgaagttctcttgctgtgtttttcagctccatcaggtcatttatattcttctctacactgattattttagttagcagttcatctaaccttttttcaaggttcttagcttccttgcattgggttagaacttgctcctttagctcggaggagtttgtgattacccaccttctgaagcctacttctgtccgttcgtcaaacttattctccatccagttttgttcccttgatggcgaggagttgtgatcctttggaggagaagaggtgttctggtttttggaattttcaagcctttttgctctggtttcaccccatcttcatggatttatctacctttggtctttgatgttggtggccttcagatgtggtctctgagtgggcgtcctttttgttgatgttgatactattcctttctgtttgttagtttttcttctaacagtcaggcccctctgctgcaggtctgctggagtttgctggagatccgctccagaccctgtttgggtgtcagtggtggaggctgcagaacagcaaagattgctgcctgttctttcctctggaagcttcatcccagagggtcacctaccaaataccagccagagctttcctgtattaggtgtctgtcagcccctaccgggagctatctcccagtcaggatacacaggggtcagagacccacttgaggaggcagtctgtcccttatcggagctcgaacactgtgctgggagaaccactgctgtcttcagagctgtcagacagggacgtttaagtctgctgaagctgcacccccaaccaccccttcccccaggtgctctgtctcagggagatgggggttttatctataagtccctgactggggctgctgccgtttttccagagatgccctgccgagagaggaggaatctagagagacacttagccttgctgagctgcagtgggctccacccagttcgaacttcctgagggctttgtttacactttgagggtgaaaccgcgtactgaagcctcagcaaggacggatgcccctctcccaaccaagcttgagcatcccaggtccacctcagactgctgtgctagcagcaagaatttcaagcccgtggatcttagtttgctgggctctgtgggggtgggacccgctgagccaggtgccaggcactggaggaaatctcttggcctgctggttgcaaagaccacaggaaaagcgcagtatctgggccggagtgcacgttcctaccagtacggtctctcacagattcctttggctaggaaagggaaatcccctgaccccttgcacttccacggttgaggcaatgccccaccctgcttcagctcaccctccatgggctgcacccactgtccaaccagtctcaatgagatgaaccgggtacctcagttggaaatgcagaatcacccaccttctgcgtcgatctctctgggtgctgcagactggagctgttcctattcggccatcttgccagctctctctttaattctttaaacttggttttcgttagttctttgatgatgtttataatagctgcatttaaattttttcttctaaatctagcatctgagaacacttatgaacaatttcttttgactgctttttcctccccagttatggggagaaactttcttgtttctttgcatgccttaaaaatttatattgagaactgcacattttagataattgtagcaggtctggattctgattctccctcccctgtggtggttattgttgccaatttgtaaaaagtttatttgtttattttgtgtttgtgtcttacttatttgcctgagataaatctgtgaaaactctcctttagtgagtagctacctactcctctactcattttcttattttttatttttatttttggaccgtctcattctgttgcccaggctggagtacagcaatgcaatctctgcttactgcaacgtctgccttgtgggttcaagtgattctcctgccttagcctcccaagtagctgggattacaggcgcctgccaccatgcccagctaaattttgtatttttagtagagacagggtttcaccatgttggtcaggctggtctggaactcctgacctcaggtgatccacccacctcggcttcccaaagtgctgggattacaggcataagccaccatgcccagccagtttgttttttaagactggctcataggagtcactctgtttatgcataggctagttgctagtgagtgactgggcacaagttgtgctcaaccacctgaggccaacaaggtttttgtctttgcaaatgtatctgtgtgtgggtagtgaagaaattagaagttcaggctattttcatgttagcctaactttactggctccttttgtgtctctcctatgtgcatgtggacagcctctgggttcacaaagaacatgtggctggcctgggccctctccaatctcagctgcacatacatgcagccgcagctatatgcatgctacatccacgtaattccagtctagtagaggccagatactggaggaattggctttttctgtttgtttggctcccaaataatcaggtatatcaacagtgtcactggacctgggcattacccaatggtccaaattgtttgcatcctcttcagctggggcagagaagctgctgatcctcatggtctgcccttcctgccagtagttgcatgttttcgaaactagggagagtggggagcagcctatggctggaatgccactgattatcagtcttcttatcctaagtttagcaatttgtcagctaaaagtgcttcttagattgtggtatgctttttgttcaattttcagaattttgaaatggctatttttgttaattttgtccagattcatcattgctttttgagaaaacaatttaccagtttcttcatttgaccctagttggaagtcctaccctgggatttgttgttgttgttgttgtttttcttgtattttacttcagaaaataaaattttacattgaaatgaattaaatttgataaaccttctactttatcataatgcatacatgtgtttacttaaaacgatcattttgctttgccagttctagaaactctctacattcttgtatttattttgctggagtttgctggcatgagaacatgagccttcatgttcatgcagaggttctaagattggataaactggtgtcatgacaaaaatttcatttatttctcatataattattagattgttctcagaaagactgcatatcattgcaatttctcttttaaatcctcctattcatttggtttcacattaaatatatatatattcatttccataaatctgtccatatccatgcagtacaaaggtcaaaattactcactgtcgatgaagagtggggaagcttatgatttatcctgtgattctaaaatggcagactttgttgaaaaaaagtctcgtattggacattttcccctgaattttgagtttatttatcattgcctcttctggttccttaccccagggaatcttggtaaagcatggagcaggaaactgaggataagaaccttgcgtactacttttcttactaagggagttgaaatcagtataatcaagaatgaccaacactacttttttctcacacatccaacatcatgaattccaatataactcctgaaatatctgcattgcctagccatatttctgtactaattagattatccagccatacaggaaattttgtgtttattttttgaagctagcacatcttacgtggccagagaaggagaaagagtgtcaaggggaaggtgctacacatttgttaacaaccagatctcatgagaactcactcactatcacaagaatagcaacagggaaacctgccccatgatcaaatcatctccggccaggcccttccaccaacattggggattacaatttgacatgatatttgggcagggacacaaatctaaatcatattatttcataactggcctctcccatatctcatgtttttctcacactgcaaaacacaatcatcccttctcaagattcccccatgtcttaactcatttcagcatgaactcaaaagtccacagtccagagtttcatctgagaaaagtcaaggcccttctgcatgagcctgtaaaataaaaaacaaattagttacttccaagatacaatgagagtacagacattgggcaaatacacctgaacaaaaaggaagaaatcagctaaaagaaagaggctacaggccctgagcaagcccaaaacccagcagagtagtcattaaattttaaagctccaaaataatctcctttgattccatgtcccacattcaggccacactgaagcaaggggtagattgcaaggccttgagcagctccgcccctgtggttctgtggggctcggctcccaaggctgctttcaagggctggcattgagtgcctgtggcttttccaggagcgcagtgcaagctgtcagtggatgtaccattctgtggtttggagggtggtagccctcttctcacagttctactaggcactgccccagtggggactctgtgtgggtgctcaaatcccacatttctcttctacactgccctagtagaggttttccacgagagccacgtccatgcagcagacttctgtttggacagccaggtgtttccatacatcctctgaaatctaggtggaggctcctaagcctcaactcttgccctctgtgcatccgcaggcttactgccatgtggaagccaccaaggcttactgcttgcactctctggaccagtagcctgggatttatctgggacaatttaaccatggctggagctggagcagctgcaacacagtgagcagtgtcctgaggttatgcagggcagtggggccctgggcctagcccacaaaatcattcttccctcctaggcttccaggcctatgatgcgaggggggctgcctagaaggtctctgaaatgcttttgaggcattttccccattgtcttggctattaacattcagctcttctttacttatgcaaatttcttcagccattcctcctcagaaaatgtgtttttcttttctaccatgatgtcaggctgcaaattttccaaacttctatgctctgtttcccttttaaataaaaattttaatttcagatcatgtcttcgctcatgcataacaaaactgaactatgctccagtttccaataagtttctcatctctatctgagatctcctcacccttgacttattgtctgtatcactatcagcattttggtcacagcaatttaacaagcctctaggaagttccaaactcccttattttcccatcttctcctgagccctccaaactgttccaacctctgcccattatccagttccaaagctgctttcacattttcaggtatctttattgcaatgcccctctgtctgtaccaattttctgtattagtttcttttcacactgccatagagaaaagaagtttaacaggctcacggttccacaggctgtacaggaagcatggctagggaggtttcaggaaacttacaatcatggcagaaggcaaaggggcagtgggcacgtcttacatggccagagcaggaggaagagagtgaaaggggaagtgctacacacttttaaacaaacagatctcacaagaactcactatcatgagaaaagcaagggggaaatcggtcaccatgatccagttacctcccaccaggcccctcctccaacacaggtgatcacaatttgatatgagattttggtggggacaccaacacaaaccatatcagacctccacttgtctgaactatgtttaagaaactaatatataagtgacttaacattctacctctttaattagagtacctacagtgcacccataagatgattacttttaaattgaaattaattaaagaaatatgtgtttgtacaggaaaatatataaagcatatttggaaaatttatgacatgtatctcttggacttcatgctaagcaactataacaaagaaacctcaacttacagtggcccagacaagacacattttttcctctcgctaaattcatgtcagtgggctgtgcatcatcaggccaaccaaggccttgggttctttccaccgtgccaccatcaccatcatcatggttgatgttgactcatcagcaccgtatctacatcctagctcaagggaagtggagaaaaacaaaatccaggtcaagtggcttgctgtatttcaacatgacccagaaattgtgcattccattgagctgagtttgttgcatgtccacattgaggtgcatggaaggctgagaaatatcttgatctgaatgcccattaacccacctaggagactgctttatgactgttctccaataatataaataacacatgcttcctgtagagcatttggttatgcaaaatggtaaaataagtaaagaaaatccatcattaatttcatttttgagatattgacagtcatacttttttgtgtgtttttcttactaggtagttttttaacatacctgtgcaattctctgaatacacattgtcattttaccattgctatactatgaacttttctccatgtgattaattgactttagtgaacctcattttaatagctaacacatggatgaactcttacttaaatgagtgatatattctcctactgtgaaacattaacctgtttccagatgcttactattataaataagttgttacatgcatttatattttcagtgttttctagggtaagttcttaggaaagtaattactgccaaattggtgttcaaaaagttatgccaatttttactcccaccagcaatatatgagatgacatattgagaattactgagaaaatggccttaactttctgggtatttttttttttatttgagaactcattgtttttgaagtgacgattggaaataaaaacccctcgtttttctctacaatacacaaaagtacacatgaacacttttccagcaagaaaatagttttaaaatcaatttgatttaatggtttatattttataatttgttggcatgtttattacccacgagcagttctttgaatggtctctacatgttatttacccttttttctctattatatttttattattttgttttaaactaacatatattagttctttatagtaagtatatcaacctctacccagtaggtctattggaatttttttctttcttttttttttgagatggagtcttactcttctcacccaggctggagtgcagtggcaaaatctcggctcactgcaacctccgcctcccgggttcaagtgattctcctgcctcagcctcttgagtagctgggattacaggtgccccccaccacacctggctaaatttttgtacttttagaagagacagggtttcatcatgttggctaggctggtctcgaactcctgacctcaggtgatccacccacctcggcctcccaaagtgctgggattacaggcatgagccaccacgcctggctggaattttttaatgctagtttgctgtgttaagacacaacgactacaaatcccttaatagcttcttccattgcttttctgcttagaaaatatcttcccatattcaaatcattatgtatataagatagtaacatcttgttccttgtaattctttagtgtattactgaattgcaattattttagttgtatagaaaatatttatgttttctggagcaagtcttctttcatgattcctctttcattttttttcttcctttcactaagtaattttaaaggtatactttataattattttaaaattttctcatgggagtgataaatgtaaaattttgattagatttactatatctgtattataatatattttcattattataataatataattatagattaccaattttgtaacatatttcaaattgaaatgtcaaaatataatttaaattataattacacattaaaatgttatttatggtattatattttatattatgcaccatattaaaatacaacttatttatattttacatataattaatttacttatgttttatgtttacacttaaggtaatatttaatatttatactaacatattaatattattttatattacactaattttcatattataacagtttttccattttcaaaatatccattcttttcttttcttccatgcctccttccattgattcaatatttcatttgtgcctattagtaaggcttccttgtttcttttcataaaacattcacattgctttgttaagattattcttattttgtatttttgtactattgctaaatgcttctctcctatatattttatagctggtcttcctggtataagaaaatactgatttttgttagaatggcaatcattaaaaagtcaggaaacaacaggtgctggagaggatgtggagaaataggaacacttttacactgttggtgggactgtaaactagttcaaccattgtggaagtcagtgtagcgattcttcagggatctagaactagaaataccatttgacccagccatcccattactgggtatatacccaaaggactataaatcatgctgctataaagacacatgcacacgtatgtttattgtggcactgttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctgagtaaactatcgcaagaacaaaaaaccaaacaccgcatgttctcactcataggtgggaattgaacaatgagaacacatggacacaggaaagggaacatcacattctggggactgttgtggggtggggggaggggggagggataacattaggagatatacctaatgctaagtgacgagttaatgggtgcagcacaccagcatggcacatgtatacatatgtaacaaacctgcacattgtgcacatgtaccctaaaacttaaagtataataataataaaataaaaaaataaataaataaaaaagaaaatactgattttttgttaattgtaaaattggctgtctaaataaaaccttattgttttcaaaagcttttgatttggttaccatgagatttctgtgtaaaaaaattaagtaatttgccctaatggtatcttgtctcctttttgttttgaaaagtttgactcaaccctcccctcttcaggaaatggctcatttttgtctcttttccttctttacagcatggaggagtgtgaggctctttgcacaagactggccataatggttaacggcagcttcaaatgtcttggttctcctcagcacatcaaaaataggtgcgttgaagttctccttttgcttagatatttactatgaaatcaatagcatgatgcagggttatgactggagatgctttagaggcaagtatgttccaattacctgctggcataaaataggagatgaaggctctgaggggataaaatactgtggctagtaagtcaaacacatagcaactcccaaacacagtctagtgttctccctgtaagggagacattttgcttttctcttgccaggtagacattgctccctccttgtagtgacattggtaggggtgagaataagattgcagagtcaagatgatgacaggacacaaaatgtcctctttacacacaaaatgccttatgaaaaggctgtgctgatatgtccctcatctgcagtgaatcaaagttcccattttatcctaccaaacactatccttttgaaaaagaccatcaatttataagggtaggagagggttgttatggttgctttccatttggattatgaaagactaaagacttctttcctgtgctcattgatcctttatatttcttcctggttaattctcttcatgtattttctttatttcctttttggaatcttaataattttgttatcaatttgtgtgagcattgttacatcctggtataacattaaaaaaattaaagttgcctaaatacacgtccaattttcctttgatttgtttaacctgtcattctatgtagaataatttattcatttatgttgataaatctcttattttcatttattcagtgtttttaaggttaggattctcaagcagagatttggtaaatagtcatatgtaaattttaaatacttttaatttatggagaaaatagctgatgctcaggattgagatgacatagtagggagtgagtgtccatttttagagttaggcactgctgggatggtcagcctcacagttgcttgctgcttcgggtcaaccactggtcagatgcacctactggaaactattctcggtatgtactctgcccatctttaataagtatcatcaaaagaaaaataatatttcatggtctccaacctttatgaatgcctacataaagttttataacccattcttgattgttgggtgatttatgtctgatttatgtttacaaaagtttcccacaagagccagcaggacgaagcacatggggataggttttctctagctgttgcattctacatactggaaaatctgtgcctacttcggagtttgggttcccataatgtgatatatgggttgagcatgaattgttagtggatatgaactgtaggactatattaaacaagaaatggcttgtgggttattcactgaaacatcaaacttaataaaatttaaaaaataatttgtggccgggtatggtggctcacacctgtaattctaacactttgggaggatgaagtgggaggatcacttgaggcccagagtttgagaccagcctgagcaacatagtgagacctcattcctacaaaacattttttaaaaattaattttaaaaaattatatccaggtgtggtggggtgcatctgtagtgctagctacttaggaggtaggagaatcagttgtgtccaagagatcgaggctgcagtaagccatgattgtgccactacactccagcctgcgtgacagagtcagaaaacaattaaaaagtaaaataaaataatttgtaaaatgcttattctcctataactataaacctataataaacaaacacatgatgatgcctgtttctataatattgagataaagaataaaggattgatcatgacatagatggtaacaataactagatttttcataaacttcggcatccatacctgggagttagcaacatcagaacccatttctctgacgtggaggtgttgagatggatgagagaacttgtagtgggtctccttcctcctcctctccatccctttctttccatgaacatgaattgttaggaacgtgaataaggaagagtagggtctgggtgagggaagaggttctgaggagataactcaggagaaggcgagggttttggagggaagattatggctgaatttgggcagggatctgggtgtcaggatttccccgtggagaggcaggaggctggtgaggagggtcccaggcttgggctgggagacatctgcccagagggagaacggaagagaggagctacagaaatcccacagaggggggacccagagggcagggcttgggcttcagagaccagctccccttgggaggggcaggtgcaacaagagcctgcaatgagagcctagtggagtgaagccaggagagcacgagggtttagtcacctttagcttctgaattgcagtgctgaccttgacctcatgaacagtcgggaacccttcagtgcaggtctcagcaaattcgcccgtgacaggaagctgaggcttgcacctgctacgtcagttcactcggacaaagcagccatttttcagggtgaagtggggaaagtggaaaaggaatgtaaggatcagaaaaatgaggagccacagaaatatagagggaagaatgtccgtggcaagtagggacagatacataagaggaaaaaacaaaatagaaagtgaagtgaaatttcccaaaccaaagaacttttcctacctcactctctgccccaggcacagccctcagagaaatggggcctcagatgagaaacagctcttccatgggacttcagaccccacctgggctccctgagttcatcccaccttcctgagcctggggagtaagacccaagcacagggatcactttctaccccaatctgcaggtggcactgtctttccttcccaccctctgtcggttcagtcagccccgtaaacccatgcctgactctgctctgattctcttccttcctgctgtgctcatttgagttgctttcttgggtcttaagcaaaaccttggtacatgcacttcaccatctgagaagggtttccgcagaggacaccaaatcccattcccatgctcctaacagagcattaacaccccagcatcctgcttcattcctggactgacctcatccttagcccactgttttaaaatatagtgtgttaatagaaaaattgaagtacaataaggccaatagatcaggaaacgactgcctttgaaaataccatgtattacagtttccaataataggggcatggcacacagggtcccatgagggagcatcaggtcagccaggaggcagagggcagctggaaggaaacctgagcaagggattttattgtgatttctattggaaggaaggggtgaaatagggcaagcaggcctaggatctgctactttgaataactttagtgggctgtgcagcataggggttgtccctagttgtctagtacctgtgcctggggtgactgggggaggtggattgtggcttaacatgtgagagccccttagaggaggtgtttgagatgatgtgtgctctgggtcagctggtttgtatttgaaaaagtgaatttatttgcaagttgtttactatctttaggaattggctagctctgggaggggcagttcttccagagtcagcaagtccccactttttcaaagtattagaatacagaagataataggcatggttaatacacacactccaggactcactgaggctgagtggagccataagggcagggccaatcacattctgcctgcctggaggaagccaggcttgcccactttgcagaggaaggcagggagctctggctgtgccaagggttctgaagtcccccttctcttccttggtacagacttttgttcttcctgggaatctttaatagcttgtttcagagctattatctacatagtgaatttccaaacactttgagattatagagttgtattaaaaagcaagttccttggacccctgatctatggataacctaaagctctctgtgaccggtctgtaccaatcatccatggagaagggcctctgagaaaaaaaaatgcaataggccactatctagtgtgtatgtctatccattgatatcaagttgttatgttaactgtgatgttgtttcttacctgagtcacaatttaagaaaagtcaatcaatattagatcttttgctcgtaaaactgaggctgtttgcttctgacatttaatatttctttaacaaatgtttattgaaacccagcaagggcatgcagaggtaggtctgatgcagtttatgcctgctttggtactcacaagtgcagagagtgagtccggcacatgcccggtgacatcacaaggcctaacagggcaggcaacatagaaaaggtatcaactagagtgttccgtgaaagtgtcatatatgccaagtggcctccaaacccaggaaaagccgagaaatcaaagaaggaggaagacacatccagtttgttggtaaagggcgatttcctggggtcacttatgaatggaagtgtggtcttgggaagcagcaagacaggtagacctctgcaacattactccccagacccagggctcttatatcacagggaaagggcacctaccctagagagacaattgaagacacccctccataacaggcaagagtttttcatgcgttatgggctatcatttgtgcaataacttaagggttgccttgatctaaaggcaggagcacttgttcttacaggaaggacaggaagtgaagtaggaatcaggaggcatttgcgggcctaggctaaccagaagtcaatgtggtagattagcatccatgatgcagtcacttttgtctccacatggagctctgaggaggaggaggaggaggccttttttagtttgaggaaatagcgaaatatcttagacctggagtacaggtaaaatttggttaaaaggggatttaattctggattgtatttagtaacaaaaaatcactacagaattggaatttgagagcaagtaagagggacagataccagtcaaagcaaagtttagatttcaatatgaaaaataaagaaaatcctcaggctaagtaaaagcagcatgaccattttaaatgttccttgagcaaccctcggcttcatggtcttaacttcgtttctgcagctcagcactgtttcgttttgggttggataattcttggttgtgggaggttgtcctgggcatgtaagatgtttagcaccatccctggcctgtgcagcaccctcaccccaattgtgacaactaaaaatatctcttgacattggcaaatgtcttttgggcagcaaattgtcctgggtgagaaccactgtctcagctgttactttgttctatgtccccagagacatggaacacactaggaaacctagttacaataatagttagaccagattccaaaaacattaggcagtcaaccctgtctttcctatggccagatctgaaacgtgtcctgctcagtggctaagaggaggcaggtgtatgaagtaggaggatgtcagcaaatgggcacaaggatgggtagagggcgttgcacacagggcattgtcttaccagaggcaaacactctgggctgtggagtgatctcattttgcagaagtccaagatccatgagaaaggagtgccctcttctcctttcagtcttagtacagccctagtatgagatgtatgaagtcatagtggaaagccagaggtcctgagaggagctgcaactctgcaggccagcatcactcaggtgctttctcatgcttctctaaatacatccctaccccacctcagtgcctgttctcacttgaacaccttgcttggaccactccccatcactgattacacaatactcccacccacagacaccgaggatgattcttcctttttccttgagacttctctggctttttcattgcttggcattttcttccctttgcttgtgtttttttctttatagcaataatcttttcctcttctttggcataagtttgcatcctgcctgccaaaagatctgttcgtagagtgtttaatatccacaatcttacctcgttccaattcagtgttctgctcctagagagcacagactttgtcttttatcagtcctacttttgcgatatgctcaagtatccatgtgatttaggagataaaatatgagggcaatgacaaccagtccagtcctggaggtcttggtgtctgaaaacccaggggtaccacaataaagaggatatgtgtggtcctgaaatgtttaggttttagttcaccaggaggtttaatactgccaaattctacattcattatttactaagttggtgtcctatgctcttctcaagctctagatcttcttgttatagttccttaaattatttttttgatacttctaagtagttaaacaatgattttaactttagattggtattccaatgtatttctaaactgctgtatgtgttcataagttaagaactaaccaaattaaagtttaaagaatcatgtctatggtttatcacttcaacaaaataagccaacaatggatttctattagtgggatttagctaaaagcattttcctgatgctggtttgggacctcatcatgcttttcctggcttcagccaacaccaactgccccaatcctgagtctggtgcaggtggaaatatttgttcaaaattggtaattgatttcccagaaggacagacagcatctagagtatagaatttcggggacccaacctcatagggaaaagtgtatttgctccctccctggtcatcttgacctcattccagcgcttcccttcttctctcccacccttatgaccctctggcctatttcaactggagaaatcatcaagtccctccttgtcccctctccagcctgcaggactcttgctaagcctgcaaggttgtcacagagtgctcctcagatgcattcttcagctgtccttcctgtggcattaccaaaacacaccctcaaaggattattattatttgttctttctgccgaaccttctctctcctaatccattctctacttctcagtttctctagcctggacccagtttacacctgggctacacctgtgccattttcctcttggagcagaaggggttagaatgctgctggatgtcctccctttgggctcaataaactcctggaaaattctcttctccccttttactccctggcaaaggaaaatttaccccttataaaatctgtagagtgtgtcctaacgcgcaatactggaccatctcttagtgatgttatgtccccttgtcttgcatcactatattcccttcttcttgcctttctagcctatagatattccccctttcctaattgtcctcatcctcatcttttatctcttttgtcttcaccatttattatagtctgttacctactgctctgagcaagatatatagattatctagcaatctggataataatattgagaactaattcttatatagtgcttactgtatgccagctgtaagtgctttatacacatgaatcaatttattcctcatgacaatcctacaaagtagctgttattattacccttcatcttataggcataaaaaagtagtcatagaaaggttgagtgacttttccaggattaccatctagtaagtagagggactgacatttgaaccccagcattctggtgctactttgctctatgatgcatcatctcatgattgtccacatttaacaaatgaaagaagtgagcctcctacctgtggtggagctgcctttcaactgcagccagtctgactccaagcttgcaggcctggtcaccatttccgcttccttcctgctggagcacttcccagagccgtaagcatgaacatgcaaactctcgctgcatcttcaatggtgtctgcaccagcaactctctcttgttgacatgtcttttggcaaaattttaatatcttttccattcctattgagacctcatcatcctactcatttaacaagtaatttctaatttcctgagagacacctcttgtcagctagctttttgatgggctctcacaaagtttttatttcttcgttatccttttctttctttgtatctatgtctgagaaagaaatctgcttaattattgagtgtttttattctgtttgatgataacataatcgatttcccttgggatgccttctgtcagtggttttattctgctttacatccttgatcttttcacagtcaagagcagttaataacagaacatcaaccacattgacttaaccatattcatcgttatttgtagtaagaatccagaggtaactggttattggcattccttaagaggtcctaggcctgacagtgtgggtgttcccaaagtggctgctgtagctccacccaatatatatatgttctaggcaacaactaagaaaagcagagaaaagcaaaaagagcacatgccaactgtctgttccctcttaaagtagctttctgtcagagtcccacccagcaacttgtacttaggtttatttgtcacctggctacaaagaagtctaagaaatgtagactctagctgggcactttgctacttaaataaggttaggtttctgttcccaaggaagatagggatcatggttgtggagtgggaagcctgcagcctcacttattcacctgactggattcttttcctccattgagggtaggtcgttaggttgagcagctgagctgaacggactcttgggctttcaatttaagattgtcatatgctatgaaagagccctatatggtatagagattcatgagtttacgtgtgagcacatgatagagtgtgtgtgtgtgtgtgtgtgtgtgtgtgtgtgtgtgtgtggctcagttaataacagaggagagctggagtggagtggcactcacctaatagccacaggtggctaaaactatccttttgggcactgatgttttgtcccaggcaattagggatgcatcctcaaatcctctgcatgtcataaattgagcacataatggtgccctggtagctagctgcctttgtacttgcagacactgagcatattcccaacttacctggagggaaccattaacagctgcatgcggcatctatttgcttttctcctcccttgaacctgattgacataggaggcttaagtctgacttggtaaaaacactcctgtcatggaaaggaaataaaacatgcttctgaagcacagagtttacaatgtgaaatactccaggccaatttatgattttggggtgagggaggataaaggctgtgtattttgttgtcgttgttgttgttttcttttttctttttttttttttagacagagttttgctcttgttgcccaggctggtgtgcgagtgcaatgacacgatctcggctcactgcaacctctctgtcccaggttcaagcgattctcctgccttagcctcccaagtagctgggattacaggcatgcaccaccatgcccagctaattttgtatttttagtagagatgaggtttcaccatgttggtcaggcaggtcttgaactcctgacctcaggtgatctgcccgcctcagtctcccaaagtgctgggattacaggtgtgactcaaggcacccagcctgtttgtttgtttttctttctttctttcttttttattttttataaagaaaacacagcttcaaatgatttaaagaaaattgttaagattatgagaatttacatttccttgagttatcaactgtaaactttgagaaccaagaataaaagtagaataaagttcaaaggatcccatcatagatgtgttatatagccatctaagttaaaatataaagaatagtgtagaagggtttgtttgtggatttttttcctaaaaaaaatgaaaggaggcagaatcttgtttgagctctcaagctaccactgtctgagtagctgcaaattaatgtatcaccttatgtgacaccatatgctttagtgtggcaactttgacttaatatatctataaaccattactataatcataacatctcggattaagattgcatcaccacataatgaagtggatcatttaaaagtgaaatagataattcagtatgtttatgtcactttcacaaatggggaaggaagtttgcacatgagcacaaaaataatttctgccatgatgtggaactatggaatgatgtgctactgagttatatttttctatattttactttagtttaaagcatcatataattcacctgctgctactaaccactgaattaattctctttactagaaatgattttaagagagatagtgcacctccatatcctcagcgtgtttcacctcacctgctatgtgtaatttgtcatctcatttgttgtcacaacatcatgttgtatgaacacagcattgctctgacataattagctgggaagactttctgattctcatgccattctcatgctggacattttggttagctgcctctggtcttggaaattcaggtcatgaacagtatcacccagagctgtcactttatcaaaagtaaacattcggcattcattttttaatattttctgtaagaataaacagaatgcttttcactcacaatgaagatggaaaatagaagtgttggagatatttttagatgggtgaagttgttggggactcagactcacatcatgagtcctgttcattcatacacatttattgagtaaccacttaattagagatgatgaaaatgtgattcctaatctcaataaactcggcatagtgtacaggcagaaacataacaatgaatacaacacaatatgataattgttctaagagactggtgaacgaaatgctgtgttgtgcatctcagtttaaacctgcaaacattactgaatgtttacatagtgccagggtcttgggattgagtgggtaataaggcatgagccctgtaagaactgggctagacactcaaataaaaaaattatgtaagaaagaccattagcacgacaagaaggtttcaaagcccatgaggtaggagttaggaggaggaagaatgcacacacattgttttaggggaaggattggcacaggtagttttatgggtgaggaggaatttaaatcacgtgtatgcttagccagctaatcaactatgaatgcattagaggtagtggcacagagatgaacaatgtaaaccatgtttgaaatagcttgatggcaagtggaatacaggtggaatcatgcggcataaacttgaagggaatctttgggaccaaattatgggaaatattaattctaaggtaaaaaaaaggcaaaataatggaggaacaaagggaagcaaaaagaaacaggagaataactggcctattaaacagaaatttttgttctctagtaggaagttaaataagacaaactgaagtcaactggtgaccaagcacatggagaaggcagcatgggtgcaggagacgctgaagaacacgataatagaactttacagccggctgatctgagcttgagaaaaggaggtgcctttgggtttgggacatggaaagatagtgatgtctttagagaaacagaagttgggtgggctgtgagggtgaggaggattctgggtgttgagtatgttcctagggacactgatgggctgtttggagaattcctacgaggaagggctgttgatattcatgttctctttgctatggcaagaagcaggagagaaaacttaaagttgggggtgattattgcgtatggttgagacggaggaataagtagctgaactcatcacaactttgaagcaatatttataaactctgaagtagagtgagctgagctcagattcatgttgctgcatttattttaattattactaaatataggcaatttgccaaatgctttctgtgcatggtcttatttaatctttattacgtaatggctattattgtacccacttcacaataaagaaactgagacctaaagaatttaagcagttggccccaaaacagagtcagtattgagaaaagcagttttcaaactcaatttcttgactctaagtttcttattctttctataccacttcaatagtctcaaccaaccttatgtataactgactaaagaacaaagctttgcttcaagtacatgtcgtgggcacctgcgtgatgaaacctacacactttactctttgttgaatttacttcctgtgtatttaccgagaaaacagactatcttcttttaaaaagatgcacagactctgctttgaaagcctggtttgatgaaataaaagatatttagagtaagactcttactcacttactacgtatgtaacttggaaaaagttaacatctctggaggtagtctttttcttcagtggagataataatacgtattttatagtattttgaaaagaaatggaggaatataccaatcattttctcacctgcgttaatccatttgctgttactataacagaataccagagactgggtagtttataaaggaaagaggttcatttagtttagaattctggaggctaggaagtcctagatttggtggctgcctctggtcggcttctggtgagggcctagtgctgctggatagcctggcagaagcacagacatatgagtgcaagctaaaagagacaagcacaaggggtcaagcttgctatgtaacaacccactttaatgagaactagccaagttccctgagaactaacccagtctctaaagaatagcattaatccattcatgggggaagagtctccatgacccaaacacttcccacttagtcctatgtcccagtgctaccacattgaggaattgaggttctgatacctgaacttcggggggacacgctcaaaccgtagcaccacttgagcatgctatgctttctctttcccccgctgtaaagttctttcccaagaaaaacacatgactagttccttcagttctctgctctactgtcccctcttcagagaggtctccagcatcgattgtaattattcatagaagaagaagaacacctggatgttagctgacaacatgcctacataggaataagactgttttccagctttccctacagctacatgtggccgaagagttatagtaagaagagatgtccacaatgtcagggatatgaatttgcaaggagggacatccctgattcttccctttctttcttccttttactttatacagagctgatggctagagatggctagagatgaagcagccatcttgagccacgaggaaatcttagcaatggagacctgtgaagcggagcaataacacagaatgagccaaatgaatgctttttctactctggctgcctgacttcagactttaaacattaacatccttactatttggggctttctgtcactgtacatgaatctgaacagactaatattccctgtgacatattaaatatagcattaatttatgtacttagaggttattgtctatctctgcccagtagcatgtaaactttctgagggtaaaaccttttcttctgtttacttctgtatccttaccatttgaaatagtgccaggtacataaatgtgctcaacgtatttgttgaacaaatgaatgaatgtattaataatgaatgtaaaattcctagtacatggcagctttttgcttaacgggaattcctttcagaatgctgcaactagactgtaaaagacgaatcagatgaggccactcaagcattcagcttctgcctagcttaatgaacaacaaccactaacaagaacaataactgacccctttgatggagacttttactctgatgccatttatctttagacagggtgaagcctgctttctctcaaaacagtctgcattattcatgactagtttgctgcttttcgaaactggactctgtctgcctttggcatctccactaacagaaactatcaggtgtacgattcagtcctaattgctgccatggccttggcaatattgtgctgtcaccttctctgctggacagccagacttagtgctggtgtacaccggcttgccaagaattaatgtgcattgcagacagcaaaaatatgccattccagaatccaactgtacactatgggattatgatttcctattgtaaatatagcctaggcacaagaaaacatagcctaaccaaggaaatggatttctttattccaggtttaaaatgtatcaggattgggatttgggagaagcttttcttactctgagttcaaactatgagcataaaatgcgtgtgtgagtgtgtatttttaaatgcaccagcccacaacatttgtttcatagttatcttacaaattttattttttcattccatttttataaaagaacaaaaaaaattcctaaagcatcagttacattttggcaaaaaaaaaaaaaaaaaaaaaagctgcaaagtccaaaaaaactcagtggcttaaaaaatcatttgccctcaagagcctgcaggttttatggagatgggctggcctgggctggatttgtgcacctgtcccttgtcatcctgggattggtgtctggaatgttgaggcaccagaatggacaggccaaactgcacaaggatgaaccaagcctctggtcacatcaccactactaatgtccttttagccaaatcaagtcacgtggctagcccaaagtaaaagggtaggaaggtagtcccacccatagtggaagaacaccacgtatagctacatggcaaaggacacagatgtaggaatgagaagaattggggcaatatttacaatctgctacaacctccaaacattttcaccaatttttaaaattattattatctatttcttggtctattttgttctacttttccttttaggagagtttcctagatttaaaatttttatgtgttttgaaaatcttttttgtttttggattactactctaaatattttatataatatcctgtcagtatttcaaggataaaatgtcttttattaatttttaaaaaattttagttttaggggtataggtgtggatttcttatataggtaaatttcatgtcatgggggtttggtgtacacgttatttcatcacccaggcaatgcaaatagcatcctataggtagtttctcaatcctcactctcctcccatcctccaccctcaagtaggctccagtgtctattgttcctttctttgttttcatgcatactcgttgtttaactcccacatataagtgtgaacatgtggtatgtggttttctgtttctgcattagttcagttaggttaatgggccccagctccatccatgttgctgcagaagacacgatcttgttcttttttacgactgcacagtattccatggtatatatgtaccacattttctttatttagctgatggtcatttaggttgattccatgtctttgctaccatgaataccttctgcaaaaaacatatacatgcatgtgtctttatggtgaaatgatttgtattcctttgggtatatacccaataatgggattactaggttgaatggtagctctgttttaagtttttgagaagtcaccaaactgctttccacagtggctgaactaatttacattcccaccaacagtggataggcattcccatttctccacagccttgccagcatctgttttttttttttctttttaataatagccatcctgactcgtgtgaaatagtatttcactgtgggtttgatttgcacttctctgttgattagtgatgatgagtatttttttcatatgtttgttggctgcttatagatcttcttttgagaagtgtctcttcttgtcttttgcccatttttttaatggggttatttgttttttgcttgttaagttccttatagattctgtatattagacctttgttgggtgcatagtttggaaatattttctctcattctgtgggttgtctttttatttttaactctgttgatagtttcttttgctttgcaaaagcccttcagtttacttaggtctcacttgtcagtttttatttttgttggaattgcttttgaggacttagtcataaattctttgtcaaggctgatgtccagaatgatatttcctagattttcttctatgatttttttagtttgtagtgttatatttaagtctttaatccattttaatttttatacatggtgaaagatgggggtccagtttcattcttttgcatgtggctagcctcttatcccagcactatttattaaataggtagtcctttccccattgtttatttttgtcagctttgctaaagattagatagttgtaggtgtacaattttatttctggattctgtattcttttccattggtctatgtgtctgtttttgtaccagtaccatgatgttttggttattgtagccttatagcatagtttgaattcagataatgtaatggctccagctttgttcttttttattaagattgctttaactattggagctttttctttctttttgtttttttggttccatatgagttttagaatagtttttttttaattctatgaataatgatattggaattttgataggaattacattgaatctgtagattgcttttagaaatgtggtcatttttatggtgttgattcttctaatccataagcatgggatgtatttccatttatttgtgccatatatgatttctttcattagcatttgtaattttctttgtagagatccttcacttccctggctaagtatattcctaggtattttgtgtttttgcagctttgtgaagggaattgagttcttgatttgattctcagcttggttgttgttagtgtatagcagtgctactgatttgtgcacattgattttgtaaactgagactttactgaattcatttatcaagtccaggagtcttctggaggagtctttagtgttttctagttacacattcatatcattggcaaacagagatagatttacttcctcttttctgatttgaatgctctttacttttttctcttgcctgattgctttggctaggacttctggctgcctaagtctctgtaggtctagaagtacttgttttatgagtctgggtgctctttggccatttttatattggtttatttgtctttattattgagttgagatctatatctatatctatcttctggatgccaatttcttatcagttgaatttttcccattttatgggctgtcttttcacactttgggtattgcccttgaaagcacaaacatgtttaattttgatgatacttaattaatctttttttcttttgttgtttgtggttttcgtgtcatatccaaggattcattgccaaatccgaggtcatgaagatttacccccagatttttttctaaatgttttatagttttagcacttacatttaagtcttcgattcatctttagtaattcttttttgtattaactgtgtgtgaggtagggtcccaacttcatttatttgcatgtggtactcacaataggatatacctgtagatcagtgaaatagaattaagagtccaggagtaaaccctgggctttatggtcaactgatttttgcaagggtgctaagaacatttgatgttgaaaagactattcagacatttggtgtatgtgcttggctgaggagccaatggggtggataggattttcaaatcgtgttttcaataagtagtgctaggagaactggacagtcacatgcaaaagtatgaagctgggcccctacctctcacacagttaatacaaaaaaattactgaaggtgaatgaatgacttaaatgtaaatgctaaaactgtaaaactcttagaagaaaacatagggataaatcttcatgaccttgaaactgtcagtggattctcagatatgacaccaaaaacacaacaaacaacaaaagacaaaaagtaaattaattgtcatcaacattaaacatgtttatgctttaaatgacactatcaaaagtgtgaaaagataacagaataggaaaaatttacctgataagaaattggcatccagaagatagatagctgtagatatatatctcaactcaataataaaaagataaataaacaaatatggaatgaccaaaggcactcaaattcataaaacaagtacttctagaactatgaaaagacttaggcagccacataataatactgggggacttcaacaccccactgacagcattagacagataattgaggcagaaagctaacaaagaaattctagacttaactttgacacttgacaaattggacctaataggcatccacagactactttacccatcaaccacagaatgtacattattctcatctgctcatgaaacatactctcaaatcaaccacatgctcagccataaagccagtctcaataaattcaaaaaattgaaatcttgaaccacaatggaatataaaaaataaaaattaggctgggtgcggtagctcacccctgtaatcccagcattttcggaggccaaggtggatggatctcttgaggcaaggagtttgagaccagcctggccaacgtggtgaaactctttctctactaaaaaaaaaaaaaaaaatacaaaaattagctaggtgtggtggcacgcacctataatcccagctacttgggaggttgaggcaggagaatcaccttaacctgggagacagaaattgcagtgagccaagattgcactgctgcactccactctgggtgacagagtgagtgagacacttctctttcatagataggtagatagatacatagatagatagatacatagatagatagatagatagatagatagatagatagatagatagatagatgacagagagatgtaaataaaataaaaatcaataccaagatttctcaaaaccacacaattacatggaaattaaacaacttgctcctgaatgacttctgggtaaacaaaaaaattaatgacttttgaatgataaacaaactgcatttctagaataaatctcacttgatcatgatgtataatttttttcaatattattggatttaattttctagtattgtgttgaggatttttgtgttcatattcttaagagacattggtctgtaatgttcctttcttttgagattgcgtgtgtgtgatgtctttggttttggtattgtggtaacactggcctcaaagagtgaggtggaaagtgttcctccacttctattttttaaacacgtttgtgaaaaattggtattatttcttaaaacatttggtttaccagtaaaaccatcaaggatggcttgtttttgtaaggtcagcagtaatgctttctctttcatttctgatactagtaatttgaatcatctctctttttttcttggtcaattatgctaaatatttatcacatttgttgattttttttcatagccatattccatatggcattccaaacttccacaatcaactttagtttcatttttctctattgtttttatattcttgattttatcaatgtccactccaactttattatttcctgtcttcttgctttaggtttagtttgcttttctttttccagtttcttaaggtatacagttgagtattattttgtaatttttcttacatgttaatggaagtattattactataaatgtttctccaagcactgctttagctacgtctcataagctttggaatgttgtcccttcattttcattcatctcaaagtattttataaagtaacttgggattgcttctgcctcgttgttttacccacacgcagctggtaagattcactcattgctgtattgttttcaacaatatcatgggcataaattgttctacatataaatctcataaaatttaggctgtgttaaaggactccttcctgagatcagtgtttgagatttgttttaatcacaaatttgccactgggagggctccttccagtggtctccctggttctctctggtaaattagacagcctgtagtttagcctgtatctccgatgaatctatcaatctcccaattgcctttcaccacaggttccagttattaagaacacccttatggttgaacttctccacattttgttgccaaaaaaaaaaaaaaaaaacctaaaaactaaaacaacaaaacagtccctttggggatagattagcagttatctgtttatggcttgcttctttagaggcaaggaaacatatatgagccacatttctggagctagaaatgggagcaacatcatgtttctttctgaatgaccctcccactttaggagctgaacactcatgggagagggaggacagtgacctcagattctctcagcttgcttctcccatgtggaaaccccacaccatgatatgaggcaagaacaagggggaccccaatattctcggcaatgctgttcttaatttaaagcctctgtctaatgagcctttgtctaatgaggtagagctgggtaaaaaaagggcaccatcacctctcatctgtactcactggcagcttaacctcatgaacatgtagctggggccagaatgagaggggaagacagctcacttacagagagctaaggtgggagagagccctgtgttcttggatgcagcaggctggagtggagtttccatttccctgagctgggaggtagcagaagagtagatcttgttttaaatgccacagactattactgttcttactcagttttagtagactttcttgaataactatattttttatcttgctgtatacagaaaaatagcattttggagactttactgttttttaaaaaatagttttcagcagtcttactgggaaatgagtctgcagaactcctcatactgtcctgatggaagccttggctaaatgctttcaaagacatctatttatatctatttcatgctggtattgtacctgcacctaaagtgactgtgcccgtaaaatagggagtctagttctattgtttttgagtccaattttaacatccatattgactttttacagcccctgctttcttctcattattgtaaatatttatagtattaattttattgtgtacagaggcatatttgaatgattaaaaggcaagcaccagccttttgagaagactttatcaatcactctagcacaactgttcacaaagcaaggagtcagccgcctcccatataggcatcccccaaccataacgtggagaagcagatcccagttagtactttctatgttatagctcctctagtttgtaattagtgtttgaaaggatccagagtaacatggaaaagattcactgtcttgattcactttcataactcagctgtcacttgggtctttcctgcccatgggagatttaggaaaatgtgcctgatttcatgccagggagtccaggacccttgtctcaagggttctatgaactcctggtgagtcagaggcctgtgtgccctgccctgtttttgagcctgtgcagtcctgcctgggcatgtgctccagtgcctggggagccagccacattatcacccccgccaccatacacccaaatgtatcaataattccatgaatttagtaattttccaacatttttgaatgtgggcctgaagagagaagtaattgtgaatccctgggctgtccgtccacctggcccctccctgcatcctcagctgtttcccctcttgtgcccctggctgccagggtgctgtcattactcaggcatccagttggaaagttccaggcacatttcggcccagagtcacttacccagagcctggcttatcaaagccttttcttaacaatgggagggaggttgaatcttaaagcaattcttctctgttaaggcaattatgcattttttcttattattacattatttatttaagggctgtattacatgggatctgactggagacgatagaggttatttgcaaagcctttgaaaatgaactcagaagaagtttaatccactctcccaagggaaccatgtccctacaaaaacttaaaactgcagcaaaacagaatagagagggtttgcttgtgtgcctgcagcagagcacccccttccttatgtaaacacttacaaagctgccatctttgcacagatggtggctgagtggggtgctggctttgaaggctccctgttttaatactggtgttttcctcctcaggtctcacgcacgaagtactgtaagcttctctatgggcagcactcatcaagccagaaagtagcttgccatggcttcttctatggggtgttttctttattatgttcataaagcaaaaaaaaaaaaaaaaaaaaaaaaacagagagagaaagaaaagaaaatcagaagacaatgactactttagctctcttggcctctcaaggtgactggtgtgagaatagcttggtggctaaggacagaaaaaaaaatcttttgtttatctagactctagggtatttctgaaatgaagggaaatgttcagagaccattaaaaatgcaagaggccacataaggggctgagtcatatagctgtcacctcaccaccttggaaacaaaacgctctatcatgtttgtttagctggtgacaatgatataatgctggagatgaggctatgtatttttttttatcccactgacttggctattgttccttactttaaaatgatcccctttggttactctaaagaacaaaggaaaaaaacaatagatatgcattttgctgtttagttaagaaggaaatattgttttcattacaccaaagtctgacaaggaatttaattcactcattactccattaaatatgaactgggcatctgcaggggtgttagagtcagtggcagaagggtttatgtgtcctgtattcttggagctctactgtaacaactgatggcattgaaggatgcaccatacacctgcatgtacacaggaagggctttcacagccagaatagggccttgcacaagtgagcactgaattagtactgaatggatggaggaaaggagatctggttgtgggtagcatgaaggatactcttagatgcgaagtcagagaggaaggcactcgttacatcatggagagcctcatggacaagctgaagagtttgatattgagtcagagtctttcagacatgaagctgacatggcctccggagttctgagacagttctgttggcctttcctggaggtgacgttgacccaaccactttaatttggatctatgaatggtggagtcatttaagaaagtgacacatccagccacagagagcagtgtttatggagtgatgtgtattaacatgaatcaagcttcttttttattgtgaagctgtcatgtccctatacgatctcgtctttaaactcagaagtgtattgaggctgttttcaaagaggttttcttctccaggaggaatgtgagtgccagctgccaaacactgttttgttgttgttgttatttgtcaaaggctctctttatgttaataccttgggtctgtaatcctcacagccattctgatttgcatatgcaatgattggaaaatgatccaaatcaaacttaactgaagttgaaataataaaggtgcttgcagtgaagggacatggttgtgaggtaagccccatggtctcagctctgctagttaataagctgagtgacaaagaaaaaatctcctgatctctttgggcctcaaatttttgcattttatagagaggaattggtatccattctagtccatgtacaggtgtgataagagtaaaatgaaattattgatgtgaaagtattaatataaaggatataagagcattaacgattagatgagatcctgcttcaggctggagttttgaggttaattactcagctggaactgtaactccctccattcccttggagttgtgtgacccaaacaagttatgtagcttctctgagatccacctcgcttctgtaaatcagaggcagagatagcagcatcagtattttgtggggattaattgggataatgtgtttggtgcctcactcacagaggatacaggacagagctcatgtcctcagtcttctcttttggtttccttttctttccagtgggtaatcatgaggactgagattacaatgaggaagtttctattaataatacagagatgccagctacacatcaagtgctcacataaatgtttgcatcccgctgtttgctcagccacccttcctcagtgccatcctctcctcctcttcatgcatccaaaggaaacctattacaattcagtagctgaggacagatcactggaatttggtactttgttgaggcaccaacccatgaggagtggggtgtggtgtggtaaggcaggaagatgagaattagggaccaatgtagtctgaggcagcggggaccccatattccacagtcagtgctgtaacacttgtgctggatgagagcttaacgtgagaccacgggaggcctggtccccctccgctctctgctcttgccctgtggtggatgagggagaagtcatctttaaaggtatttcctactcagatatgtgtagggaatagcacatgtatggggttgtggatgtgagtgtgaatagactcctcgtggggcagatgatggaaatcagtgggcatatatctataaacacataatacaaatattacatattttacaaatcctgttattttctaaagtctaagattagtttctataccaagaagaattttatgcgtttaatttttagaggcaatgtgacaaaaagttcctaaataaatgatttttaaaatcagaaactgaaatacagtcgtagagtatgagacattagtatgttcctttaattctcttagaagccatgtatattttttctttctaatgataaagttttatgtgctcattattttagaattcaaaatagtataaagaataaaacctaatggttatgcgattatttcttgtccggataacattccagaatttatttcagtctgactgtaaatatgtgcaaacatacttacatcattaatgtaatactgagtctatgattttctattttgcacttaatattatataatagccattttctcttcattaaatattatttgtagagatttttaatagttgaggctgaaatcaatgtatttgttataaattatgacttttaatttggggggaaggacttttataaggggagccttaagctcaggaatgcaaagcttcataggcacttggtataacttgacaagtgatttttcagaaatgtctctgcaggtgcattgccacctcttttgttctgctcttgaagtgtctgactttcaaaatatatgtgtgtatgttttttcttcctctcatgtattattcctgcttctgttttagcattaattaatatattacatttaatgtttgtggttccaaaatgttgtacctcaaaaaattgtagaatatttcttgtaagcacctttacctacagataatgccatttatttatctctatttaatcaccgattatacaaataatgtggacataacgtattatctagaaatgttagatcaatgagtgaacatagaaataaatgactccttggctattttgcaacattttattctgtggaagtatgaaaatcaaataaatccttcagggaatttagattattgacataactgtgtatgttatagatagaaatgaaaaagtcaagctaatattaattagatatttacatcataatgaatttaataatcttcgaagagtgtctaaattgttgaaggtgccatgcttttataattttacgtttagaagtcttcttaactattaactgttctagagagatcctgagtaacctatttcaacctatctcctatctgtttcaggcatattttctctagagtgtttctattttggaagactggtagaatttactttttgtttaatttctgtgtaatttttcttttttcgtaattcatgttcttcacagtaaagttggaattcttttagttcaaacgaaattttaatttgaaagaattttaattattaatgtgcatatgtgcttatagagaatttattagataattactggaatttagcatgaatttttcaaaagtcattagcaaaatatacttaaagggctgcagtttctactaatggtaaaaatggatcctaatatgcataagaacatacagccatctctgtgccactgtctcctcataccattgtatttttatataatgcttcctattcatgtttgaattgttttatctgcttttatctaagttctccaaataaatagtggccttcttcactccaagaagaacattcttctgttctggtcatattctgaatagatcctaaatttcactgcttatttatctacttagttacacagtgccagacattgttccaagtaatttgcaaggattaattcagtcagtcctctcacaaccttattaggcagatactataattaatctatttgctagatgaggcaactgaggttagaaaatttaccagactttccagggtcaaacaactggtacgtggaggagctggattcagtagtgcaaacactacattttgtcatgccatcagaatcattaataaacatgagaccagaaacacatctccatgcaacacatcccctctgccctggaacataatgttatgcccagacacagctgagagctctcccaggagcatttacaaagctccagtgacatggtgcttcaccttgggaagccccttcaaccacctaggcctcaatcccttcttttcatgaaacgtggacatatagacccactttgggggatttggtgaagacacaatgggttgatcgtgttattcagcagcatagcttgtaacatactgctgagaagggggatggccacagaatatatacctcttgtaccaacccaatgtgttggcctttaacaattctgagagatagccaaatagaaatgttagagaggtgcatgtccgtatgcttttatgtatattttgtcagtgtcctcaccaacctctcagccatgtgaagattagaaaccattaactcgaatgatgggaggctactgtggccatgcacagacctcagagggaagtgacatctgacagcctgaaattaagacaagaggacagaaaaacagaacaccagggcaaagagctccatgggtgctcacaagggtgatctatgtcactgaaacaaggtcacattgtcttgggtcccctgtctttaccagacagacttgaaaaataatttgaccataaatctgttagggatcagcctcatttaggggaaatttacttaagtgtaacacattttcccccagcaatgctttgtaaatgagatgagtatgattgctaagactgggcatgccatttcattcattaaactaatatttaccagtgctaggtactaggtactcatactgtgcttggtacttagaaaagatgcttcagtgaacaaaatggacagagattttagtcatcagagtatattcatgtatttctgattttttttgggatgctatgatgtgcccaacaccacctgagataagggagtagaataattcatatagtttttggaggacccctacattcctggagattgctatttgaggttaccttagggtatgagtatgagctcatgtcttgctgatgggacaccagtggaactactgtctataactctacaatgtgaggaacagagccccttaggcaggagacttcctttgcagtcatagggcctgtccacctaggctgggttgaagtacaattgggataacttttttatataacaaacaaacaagtgcctggtaattacatatgcaatccctttcatcttttcccagccaaattttaatcagtacagaccttgaagcaataaggccagcaatcatgcttcccagggccagtttccagcccagcttcccacttccactagctcaggactttgctttcaccgtttgcattttcaccttccctcttttattgactgggtgttgattctgggacttgctgataatttttttaaggtaattcagtgtctgtgtcaatataaatggaaaacaactaactgtataattgacttacaattaatttctgtgtcttatattgagaatccaaactcccaacaatttggagtaattacttcctttttctccctctgtgtgaaaatggacttagaatttactcatcttaggtcaatatgataataatcatgtttctattttatttaactctcaggtttggtgatggttatacagtcaaagtttggctctgtaaggaagcaaatcaacattgcactgtttctgaccacttgaagctttattttccaggaattcagttcaaggtagtgctaatatcttgtattatttctttgttttcagctaaaaaaaaataataaatgtacctgtctttttttgtttttattctatgctgttataagatactacttgttaccttagccacattgcaaagtataggccctgcctccctaccaaaaatagcatggatagctgatattgcttgaccactctgaagagtgacaagcctgcttaattgcttcctggattggccagagcagcctgtgattacatatcacgcctcttatctgtgggcacaggtccattgcataactcatcttgttcagcatagaagattgcaaaagctaatctcttccatatatttgctgtagggtttataggcttgatggtttcagcattgcttcacagaaatagccctatgcttgagatcacaatcctctataaacttgctgtcatcaagtatggtcactgaaccagcagcatcttcattgcctgggacctgttagacatgcagaatcacaggccccaacctattgaatgggaatctgcattttaacaaggtgacccggagattcctatgaacactgaagtttgagaagcactgtctaaaaatctcttggataactgtgggatgctagtttattataacttctaggaggctgtagtccataaagtagttatgttctatttatttcaacaactgtcatttagtgaaatcctactatgcaagaagcatgctgtgtgagactgtcattcatgctcaattatgactctgagtcaccctataaaacagacataattatctccattggcatacatgaagacaaggatcagaggtttaaatatcttcccaagtgttgctcagctaatgatgagaatagtgagagataagcccaagtcccagtgtaaaactcagggcccttccatccgtctctgttaggccatgttaaattcctacatttcaaatatctttgggcatcttatgattccttaaacagggcttccccatgctgttgcaaggttagagcatatcagggggcagaacagcaatgccactcagttgaacgttgtttgtcaaatataccccatgaaaaattgtcatcaataagcattcattggagactcacaaaattaagtgtaggttgagaaaacgtaactgaatttttttgccaattaaatgtagtatgatcaattttgtttaataatgctagttatatgatactttttttttttttttttttgcttttagggacagcacctgaatttattagaatatcatgtgccaaaaagatggggatgcctagctgacttgttcaaagttatagagaacaataaaaccttcttgaatattaagcattattccattaaccaaaccactttggagcaggtatagtatcttgaatgattcaggaggttgaattttggtctgttcatcagacctaatgtagccaattttaaaattaatcgaattgcttcaattcaccactttattcaattcatcttgttaaattttataaaattatgataaggatggtgagtgtcagaaagtttgtttactgtatacccttctacttaagatagatattcagtagagtttcaatttgttcatattattttgggcatttaactaattaaatcatgtcacgttaaccttcctatctccaccttactcagccccacaagacttttcgggggggcttcactgtaatcaaatgatagctaacttctggggaaacaaaaagcgtttcatttactaagagtaccaggaatataaaaatacatcacgacatatttctaaaaccaggcttaaggtattgagaacttctaggtgatttattattataattgtctagaaatatgaatgttcttagagttgtgtcctcaatggatttatatatttatgtgatttgggagggaatggtatgaattaatgatctgtggtttttagggcaagttggccagtgttctgagacaatgtctcctttctaataagtgagaccaaagggttgtattcttataagtaaacaacatttttatggtttttttcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaaccc

SEQ ID NO: 1212 - DNA, 310689 bp, Homo sapiens
gtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgcggcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagttggccgcaatagccatgacttccgattcctaaccatgtcagcattattggactgcagttaaaaaaagagggagggggtcactgcggatcggaagcaaacgcggttcagtgtgaagcgtgtaatggaaggatgagttagtgggtaatatgagccagggctgcaatgtcctggctactagaaaccatcagaagacccaaaagaattgatttgttcctggggtattggagaaataagacaaacatattggcggcagcccggagtggaattacaacgtttggcaccgtgaatacggcatggatgggtggggaagacaagagaggcattaaccagaaaagacattaaataaagggctccggttgtgggtctggtctaggattcctctcttctctgtgtttgcatccctacattgctttttggacactctctcgagctgctgccacagcaggaccactctgacaggcgacagccagccactccaaggaagggtcatttttggagccagctattagatcccgctcacttggtcagcttctcctcttccgttctcttcccacactactccttgacattgaggccgtctgaaatcatatttcaagttagagataaagtcatgttttcagacatcaggaccttcgtaccaaacccaagaaaccttagatgcagcctttatccctctgcgtatctgattgtgtagatgcaatttaatcctcagaaaggctgctaaagcagaagtgagagatggtgtagcattgtaggagtcacagtcatggatttcaggccccacctagcctgatactgctgttattgatttcctactccagcaattgaatgtctctgagcctcagtttccctatctctgcaatggaaacaaagatgttccttactcactttgaagcattattgagaggatcatgtaatatctgtatctcttccaaagggctttgtaaattgtaagatatgtacaaatttaaggaactagtgtcatgtttaagagctgggctctagagtcagattggctggtttgaggcttctgacactttgctgaatgatgttaatctccctgggcctcattttccccatctggaaaatgggaataataatagtaactatttcatgtactttttgtgaacattaaggaagttaatgatgtaaattgatacatacacatataaggttcttagaacagagcctggcataaaataagctcaataaatatcatctattatctatgaatattatctattattattaggttggtgcaacagtaattgcagtttttgccattactttcaacggcaaaaaccgcaaattactgttgcaccaacctaatactacagtctacagcatttattggggtttcggattggcaccaagctattcttcattttagacagggtctcactctgtcacccaggctggagtgcaatggcgctatcatggctcactgcagtattgacctcctgggctcaaacaatcctcccacctcagccttctgatgggactacaggcatgcacaaccatgcccagctaatttttaatttttcatacagacgggattgtcctatgttgctcaggctagtcttgaactcctgggctcaagcaatcctcctgccccggtcttgctgggattataggtgtgagccaccatgcccagtcttttttttttttttttaatttataaagaaatacatggtgtggtggttcatgactgcaatctcagtgctttgaggacagaggtggtaggaagtcttgatgagcccaggagtttgagaatgcgctgagctataattgcaccactgcactgggtgacagagcaaaacctcatctcaaaaaaagaaagaaaggaaggaaggaaggaagaagaaaaagagaaagaaagaaagagaaagaaagaaagaaagagggggagggagggagtgagggagggaaggaaggaaagaaagggaaagacaatgcctgaagggcaattgagagtaacataattcccaagataccactgttgatgtgagaactagcaagaagccacagcaggcttggatatacggaacagactcggcctgatgcacacttcattcttgttcctcactgtcattttcttagacatggagactgtcctttacaagagactgaacatagatctagtcctctcactgggtagcgctaaaggagagcctggtcatttgccagggcagcaactttcatctttatgctctcacatggataatctaatatttgatatgtttctcccagacttagcacttgggtgctcaataactggaacagcacacaggattggtaagtttacaaaggtcctcagctttttcccacattccctctgagtctcctggctaaggtttcctccaggtgtgctaagctcacacctggaactccttgtgaacaaagaccttcctcatcacattcttcttgctccacaggatccaaattactgcctcaattagcctccttctccctaatcaacttggcctcagctttcccattcccaagcaacattccaaagttctcacttcctggttaaccttcccaatttccaactctgttttctgccctacttcgtttgcttccttaatgtattaggctgttcctgcattgttataaagaaatacctgagacagggtaatttatgaagaaaagagctttaattggctgatgattctgcaggctgtatagaagtgtggtacaggagtcagctcagcttccggtgaggcctcaggaagctttcagtcatggagaaaggtgaagcagaaggctggcaagttgtatggtgggagcaggagcaagagcaaggggtggcgggggtgtcacagactttaaacaaccagatctcaggggaactcactcactattgcgagtgaacaccaaggccccatccccaggattcacccccaggaccaaaacacttcccaccaggccccatgtacaacactggggattacatctcaacatgatacctggagggggacatccaatctacatcacttaatatagtgagctttttctttcttttttcccttttagaatatcatcttttcctgtccctccttgggtctcacaacatttcccttgtgccaaatactgcccctacccttcaatctaaacactccccagatttcatctccggtagaaaagcccactttgaatatgagtgaaatagggactccattccccttacttactgtaaccaacttatatttataaacatttattaaaagagggaattaaattcacttcttttatgttttaatttaaccaacaaacgtttgttgagattagcactggtcaacaaaacagtcatgattctctttgtctgatgagagatagatgttaaatcagtaaatatgtgtgtatactgattgaatttctcctcagaaaaggggtttttcttttctatcacattgtcaggctgcaaattttctcaacttttatgctctgcttcccttataaaaccgaatgcctttaacagcacccaagtcacctcttgaatgctttgctgcttaggaatttcttccaccagatgccctaaatcatctctctcaagttcaaagttccacaaatctctagggcaagggaaaaatgctgccagtttctttgctaaaacataacaagagtcacctttgctccagttcccaacaaaattttcatttccatctgagacctcctcagcctggatttcattgtccatatcgttatcagcattttggtcaaggccattcagcaagtctctagggagttccgaactttcccacattttcctgtcttcttctgagccctccaaactgtttcaacctctgcctgttacccaattccaaagttggcttcacagttttgactattttttcagcaacacccaactctactggtaccaatgtactgtattagtctgttttcatgctgctgattaagacatacctgagactgggcaatttacaaaggaaagaggtttaatggtgaactcacagttccatgtggctggggaagcctcacaatcatggcagaaggcaaggaggagcaagtcacatcttatgtggagggcagcaggcaaaaagaaagcttgtgcagagaaacttcaattttaaaaaccaccagatctcatgagacccattcactatcatgagaccagcaagggaaaggcctgcccccatgattcaatcatctcccaccaggtgctttccaacacatgggaattgtgggagctacaagacgagatttgggtggggacacagagagaaaccatatcaccaaggtttccaatttaaaatgaaacctagtgaaaatgaggatacatagtcatttttttcacaagtattgttggttttagtaaaataagagcttcttagtttaagaaaaaaaaaaaaaccccagccataaaagagaataaaatcatgtcctttacagcaatgtggatggagctggatgccattatcctaaatgagctaactcagaaacagaaaaccaaatattgcatgttctcatttataagtgagagctaaatgatgtgtacacatggacataaagatgaaaataatagatactgggaacctcaaaacagggaagggtgggaaggcacaagggttgaaaaattacctattgagtacagtgttcactatttgggtaatgggtacattagaagcccagtccccaccagtatacaatatacccatgtaacaaacttgcgcatgtactcacctgaatctaaaataaaataaaatttacaaaaggtctatcttggaaaagaagaaaagtctaatttccaccttaagaggctagaagagcaaactaaatccaaagcaagcagaaaaagaaataaaagaaagaaagaaaaatctaggtaataaacaagaaaagagggtactaactgattgaagttaaaatttttcttagtgacatgctctgtactggatgtgtagaacagagaagacctactggaaaaccagaaggtagggttggtgtcatgttctgtaccatgtcagtgttcttgtgtggtacatgaaacatcaggcaatggcaggtacttgctgccctcctgggtgggttgggtatgagatccatgtgtttgtaggaatgcactttaacacctgcagttattaatttgatgccacacctatagattttgcctcacacttctctggaatggtcttcaaaacagtatgggatccaaaaggcacaaagaacataacacgagaactctaagttgttgcgatccctgtaagccctggggctctgacaatgtgggtggcagccttggaccagaagtggcattccccatcaccagtcagatgcctgttatcacatggacttaggcttatagcatccagtggtgatcatgaaacatctgaagtttgattctgcaaatgaataaatctaggttcatgaaagaataagtgcagtagggacattaagttacagataacttaaggttcttaacatatgccttcattcattcatccagtaactcatttagttagcaaatatttattgaatactttctatgtatgaagcactgtgataggtacttgcgataaatggtgattaaaaacatcccttaccctgtcttcaaggagcttacggcttagtctatgtgtgactatggatactttgtgagtttgaactatttttcttgctgaatcagtcttctgatgacacaaaatgtggcatttcgtgtgctcagcatatggtgggcattaaacaaatgtgtttagaaatgtgtaagacttttagaagttaatttctatgatgaaagtaatgtatgctttttaaaacaattcaaatattacggaagtttatgaagtaaatatccccattttccattctctcactcatatctcagttcctagaggtgattaccatgaacgcttgggaaacctctttccagatattttccatgcaaacatcatagagttggaaacacttatatatatatataggtttaaatatttcttttacataaatgaaatcataccacatatgttgttctgcagcttgctttttccacttcatattatattctacatactttttcttatcaatgtatgtcagcctgtgtagctcagtggtaaagcacatgctttgaatatcaatatatacacatctacttcattcacttttataaaactgcttagtatttacttttggaatatcattaaccagttcttcatgatgaagagttagacttgtttccactttttgctactattttcaatgctacaatgaacatccttgtccacactgcaaataagtctgcatacaattttctagaaatgaaattgctgggtgagtgaatatgcacattgtgaattttgttagatattgcccaggtgcctccggaagtattgtatccctttacattgccattcatcatgtttgagagcccctgtttccccaaatccttgacaaccctagccacattatatattcatatttgaatatttatgtttgactagtctaacttgatgtacatcatcactgtcagtggtcgtggtctgtgctcttgctctgtctacttgtcactttctcagagagccctagtaagccacaaggtgcaaatgttcagaagacagtgaaaatcacttacaaagacaaagcttaaaatatctcattgacttttaaaagtgatcaagtgattgttttacagttcatcaaatttagactttattgatagatttcttaccttaaagttgaggaaatgagcacatgtcacttagccccccttttaccatttgttgcagttatagtgtgatatagtttggctctgtgtccccacccaaatatcatctcaaactgtagtccccatgtgttcaggaagggacctggtaggaggtgactggattatggggatggtttcccccatgctgttctcatgatagtgagtgaattctcacaagatctgatagtttaaaagtggcagtttcccctgctctttctctctgtcctgctgccatgtaagacgtgcctgcttccccttccaccatgattgtaagtttcctgaggcctctccagccatgcagaactgtgagtcaataaaacctctttgtttacaaattatctagtctcaggtagtatctttataatagtgtgaaaatggactaatacttagtgttagttttatgttttcaaagtttttagcatttgcaaatttgaacataattctcttaattcattcaatcgacggattctttttgagtgcccttttcatcctaggcactgctccaagcactgagaatacagcagtaaattgtcaaagaggcaaaggagcttatattgtgttagaggagacagacaatacatatattacatatatactttgtcaggaagcaataaatgttaaaaaaattaagcacattaggagactggagagtgatgggagggttatttttgatagtgtcatcagggaacaggtttctgacttggtaagtttggatagagacttgaacaaggtgaggggatgagacatacagaagaaggaagagcagttgcaaaggtcctgaggcagggccatgctttgtgggctcagtgttagtcttggatctaaatgcagtcagaacaccaccagccctttcatcaatgacatcctcttttttgagcatcttataggttgatttagtgtttagttaaaagggtttgttttcaaacagggccaaagtgtattaaattctaaatgcctgttggttgtttctatgaacaaacaagttgaatgtgtataaaattatagaatcatgtttttagcccctcataattctccaagatgtcattccattgtgttctggcattgacccttgctctgggaaggtctgaggctagactatttcttctttgtagatggcttgcctactcccatccctcccactcctgcaatttttttttttggctttgatgctgatcaagttatttttaaacactgaaagtttggtaacttctctttgatatttcttactgtaagtcattgtgttgttgttttttttttctggaaaatggtagttcctttgttctgaagagtcatattttcctttatttttttgtaaagatattttccctgtggctttcaattgaagaatctatttgttctgttatctaccacagggacatctattacccattgctctccataactattaattctgaatttttctcatttttttcctgatgttcctatgagtttccttacatttaaaagtctgtcatgtagatagttgactctctttttaagcagcagtttctaagtagggctcacttctgaaatggttttatggttatcttcaatttattttctggcttggctagcacattttgcactttttaaaataaagagttcatgtatccaatttttttgaatgtatggagagtagtttatcagaaaattatctgtattttttgggctatttttctgaaatgtatttatctgccatttgctggtaactcatttttataaaaataataactctgcatatagaatctatgcatgttaatggctttgcatttattatccatttccaaatagaggtaattctatccaaacctactatttgcccaagaataggtagaggggatggagacagtgatttgggggagacattagctttggattggatattttgtctcataaaaaattcttacaactctgcaatatcttctgttcaaaaaagttgtgtagagagtgagcagatcattcagacagatcacatatcccagcttactgagtgtgtgtgagttgcgggagggtagacagatttttggtgctttaccactacttgatgacttggtttagcatttatgaagagagtggcagggcaaatcgactacaaaggtaattgctcttttccttctattttcctacatctcttgccttgagatgattcctccatgttaaggttttcagttttcgggttttgcagataataaacattaaggattcacacagtagtgccatcggtgtcactttctccatcagttcactctggtagggaaccagccccttcacacagatgtcccccacgttttgccagttctcaccaccaaacattgggcctttgtgtactctctccttacttagagagaaatttgaaagccagttaagatctgtagaggactatatcaccttttagggttgtccactgatttaataaaaattatactctgtttggcagataattcttatagcttgtgatttgagaattgtagctctttgctagtttcatagtagatcaatttattcatttatttatttgttttttagagatgaagacttgctctgtcacctaggctggagcatagtagcacaatcagagctcactgcagccttgaattcctgggctcaagagatcttcttgccgcagggcccaaagtagatgggactataggcatacaccatcatgcctggctaatttttaaattattttcatttttattagagataggctctcactaagttgtccaagttggtctcaaattcctggccttaagcaatcctcccacttcagcatcccaaagtgctgggattatagaggtgagccaccatacctagcctcacagtagacacaattttccttccaatttttccttcttttagttcatttcagcggctttgagggaagcacagagaagactttaccatatctttgagttaatgaatcaatgaatcttgtgtttctacgaaaataatattagtaactaccaaatgtcattgttattaacaaatctgttgttattatatatctttattctctctcaattcttaggaatgtgtatggcaaaaaaagagttcatgaatgagattataaatactttgcagtagaagtattttggaaagggtgtatctggtgatgttctccatctcatccttcaaatccattttctacccttccctgcctatgtgcctcatgaggctgtgctttgtgccctgtgaggctgacctctatggactccctcagcttgcctctcttactctttgacttcctgttgagttggctcaatggaaggcaccagcaggagaaccatggatgagagaaaattgaggtcagtgtacggtttaatctatggtttctcttcctacagggcagtgggttggccagggcatctttcctcttctgaaggccacagcagcccttcctactgctacagctacagctctctcccactgctggtagccacttccttcctttgctcctctgggacttgatgtggcgatggctcccttatcactttgttagcccctgggtgcttcaccattgctgtgggttactgtcagctctgcctttgcctttgtaaagcagtctctttattaagattatttcaattatccagttggagtatgccatctgcttccagctgggatcctagctcacacagcatgtgaggatagaagcactgaaagtcttatgagaacccttcttattgccgggatggaatctggtgatttctgtttgttcatacattctggtcattggacctcaaggttccaatatagggaagagatattgagtgttgttatgtgcacactcaaatatttaagaaggagacactcctattccacagatatcaaagtgctcatttacttcccactgaaagatgtcattttcttatatataacttataataaaaattccccaaatttgatgccttagagggaagaccaatctcagttatgagtaggcttaatcaaaattttattttatttaaagaaatgaaatctcatttctcttcattataggaaggaacattcctggtcgaaattctgtttttgtaaataggtctttatagtatttgatgtgctatttaaaaatgtgataatttaacctattaatagtacataaatggatgctacctaaattactgccaagtcaattaagtctataccatcatgtgtaatctttttcacagatagtacaaaagcataaaatatagtgtaatgaaaatgtgtgtttcacaagttctgaataaatgggttataaattaaatatatcacaatccactgacttttatatagtattttgatatagtttggatatttgtcctcccacccagatctcatgttgaaatgtgatccccagtgttggcagtggggcctagtgagaagtgtttgagtcatgagggtggatccctcatgaatggcttggtaccttccctgaagtaataaattagctcatgcaagagctgactgtttaacagagcctggcacctcctcccctctctcttgccatgtgacactcctgctccccttcaccttctgccgtgagtggaagcttcctgaggcctcaccagaagcagatgctggtgttatgcttcttgaacagtctgcagaactgtgagccaaataaatctgttttccttataaattacctagtctccagtatttctttatagcaatgcaaaaacagactaatacatatctcatacttgaaaagtcagttgttgtttagactgcttgccctacttttaatacttcaatttctctgtcaatcatgtttatttattaattcattcaactcataattattaagtacctggtatgtgccagacacttttatgggtatctgtggtacaaataggagtaagacattgtctttgccttcataggggtcacaatctaatgagaaacatagttggtcaggtaattataataaaacatggcaagtgtttattcaaaggaaaggtttgatggaatactatctgtcagaggcacatagccttggggcaggagcctaaatgaattttaggagtccagggattctaagatgaggtcaaaatccaagcctatttcatagcccttgaaattaatttagcataaaaaaatctttaatgtttggactagtcatcttacaactggttaagtcatttacttaaaaaattagcaacccaaatcctgtattaaaactagtttgaataaccgacttaaccttcaactcttttagtttgcactatgactaatgctgcctccgtgatcatgggtgaggcagcattgtggagaatgcctgcccccttgaggaatcagaaactcagctttcagatgatggtgcaaagtgggatcacaaacaaaatgaaacaaaaaacaaagaacaaaaaggaaacaacacaaaaaccaaaacagaacaaacaaaacgatatgaagatttggtgggcactgctaaaccctttgtagatacttggttttagtcacgtttgctgagatcacatcgaaagcctctgaacctctgaaaggcattaaaagttgtcccactgcacctatgagccatccagagaaacgttaaataagttggtccagaaacacttttgaagtcctccatcctttcaatacttttcttacttctttgcttctgagcgggaggtgcagcatttaaaatcaaagacattaataataaggtctcatttcctaagacagcatctttcccactgcaatgtgcatatgaatcatttggggtcatgttgaaaagcagatcctgattctgtagatagggggtgtagttggggggttcctgtgttcccaacaagcttcccaggaggtgatgctgatgctgctggtctgcagaccacactctgagtagcaacattctcagtgcaaatatagagcacagggctttatataacacaagatgtgggtgtggggttcctcatccttttacatttcccatcctaagacaatctcatagtaggcgagtctgatgatgaattggagttcaacaatctgtgtgtggaacaagtaaacacacagagcaaaacctggctcttcattttaattggcacaacttagcagttacatgtggataggcaaagtctctattttttgggaaatcagaatggggtaggggttagccaataagtgtatatgagatagataaatgcaatcttatcttttaaaatatgatttgaaaattttgtggtcataaataatttatatcctaaaaatattcttctttggtcagtcctttaatattttaaaagtagtgaatctaattgtttatggcctcatgtggctgtaagccataatatcttggtataaatctctagttatgattatatggatataatatgaatatgatgtgttaggcccaagaagctcgtggtattccattttctgaacaagatcaataaactctgggatccttactattaaaagcaagggaaaagcaacttgttttgtaaaagataattcaaacatgttagtaagttgtgttttcatttatgtgagatgagaattatctccaaaactctttcattgtaatgggagctaagctttataaagacaatgcatatttgttaattagactgcacagaacaaggttcagttatggattcttgattgcttggtaaaatgatggctcttcaaacctaattacatttgggtgagctaaagcacagttctgaaggactcaatatgttcactcccagccttcatcagctgtacaatttgctttcctgttagttttactttagatcttgaaattaaaagcattttgttatatcaggatggtgtgtctatgacttcagtgcaagtagaggaggagtgttctaccctggaataacacaaattagaggtgcctgtatgtatgtgtatggtgtgtgtgtgtgtgtgtgtgtgtgtgtatatgtattaaacttcatgctttttaaagcctccttctaaaatgccatctttcagatgtgcctatctgtgtcttattttggtagtttttcttttctttccccattcaaccgtctcttgggaattagaaaaggattcctaagatcaaaatccccaattttctggaaaagctttggcacttgttactctctccccacattttcctgcttcctaagattggtcaagggcaggggccgggcgcggtggctcacgcctgtaatcccagcactttgggaggccgaggcaggtggatcacgaggtcaggagattgagaccatcctggctgatggtctcagggtttcaccatgtctctactaaaagtacaaaaaaattagccgggtgtggtggcgggcgcctgtagtcccagctactcgggaggctgaggcaggagaatggcatgaacctgggaggtggagcttgcaccgcgtgagccgagatcggccactgcactccaggctgggcgacagagcgagactcggtctcaaaaaaaaaaaaaaaaaaaagattgctcaagggcagccataggccctctgggtgacaaggaacagagatttatatagtccatcttacaaaatatggataaagggtctctttctctctatatatatgtattttgtgtgtgtggtaaaatatacatagcataaaatttaccattgtaaccatttataagtgcataattcagtggcattaagtacattaaccatgttgtgcaatcatcaccatttccagaactttttcatcatcccagactgaaactctctacccataaaacatcatctccctattctccccaccccctaccccccattctacttttggtttctgtgaaactgcctactctaggtgccccatatatgtagaatcaaacactatttattcttttgtgtctggataatttcactttgtgtaatgctttgaaggtttatccctgttgtagcctgtgtcaaaattttattcctttttaaggctgaataatattccattgtatggctataccacgttttattattcattcatctattgatggacatttgggttgtttcccccttttgggtatcatgaatagtgctgccatgaacactggtgtacaagtatgtgtttgagctttatattcttttgggcataagggttaatagatatttattgaaagcctattatgagccagtacagtattttctagaagttgaggctattgaggaaatggacagcatcccagcccttgtataaacacaagaatgataaataagcaattctagataccaataaaatcctaccagaaaaagaaaatttaaaaatgggttagagtatctgacgttggggcaaaaagtgggtatgggcaacctcatgtaacataggaggaaggagagctccaggcaaaaggaatggccagtgcgaagcctgagctagaaagggcgccatggtggtggaaggggctcgagggtggtgactgggggagatgctgggggagaagaggtcagaggctaggtcagccagaccttctaggccacttaggtccaggtgtcacaaggctcaaagtttatgcaactttgaaggcccttgcagaggaagaataaaaacatatcttccttttgcaaactttacaaaaacatgcccatcccttgaaaacacattactaggtcccttccagagttttcaggggctccaagtgaggggccgtggctcttaagcttcagtgggtccacagtgatctgtctctgagtgctgtagcaagagtctggcttttgtttagatgatgaaaggaaactattgggggattttaagcagaggagttacacaatctgatatgtagtttaacaagatggttatggttgttgtgtgaagaacgggctgtagagggcaaagaggaattaggggatgagaggaggctggagacctgttgcaggtgagaactgaagggtgtgattgatggctgtgccagtccggatggtgagaagtggtcggatttcacaacagtctctgaggagagaattcaaaattggtactgctaatgatggcataatagacaaacacactgtgatattgatgaggaggattcttcctttcctttcatcttagcctcctcaagcctctggtctcaccattatattgtagcaatattgtcaatcatttgagtttaggagctaagaggtccctcccaactatattgaagctgtatgatgttcaccttggctacagtcaacacttatttctcaaatgaagttacattgccttgtggctaaaagctttgacactgaaaaatgtattctctgtaaaagagatgtcagtgtatcatattaaaggtcagagatgccccagggtcagaatctctgtggtcctagccaaacattttgtaagaaaaaaattctcaaccactgtgagattgtttcagattcaggagcaaagcaaccatttgtcatttgcaatttatgatattttgcttcttcaggcaccagcctgatggcctttcatctggaccatgaaatatcatgactgattggttttttgaggagggagaatgttcacacttttcaaaccagcacatctgggggctaagaaggaagctttgcttgggaggaatcagccagttgtttagtgtggtggctttatgttttctgagaacaaaagcaatatggtatttgtgtgtgtgtgtgtgtgtgtgtgtgtaaaatcaatggagggtcttgggagcaggggagacagagggagagaaatacagcggaagagaggatgacagagagagagagacagacagacagagacagaaagaacatacccatactgtgtaaacacatttctaggaaacagaaacggaaagacaggttgattgccttgagggagcgagttggtatagttaaatgatagggtttgggggtttgaatcctcagagaagctcaggtagaggcaatgatagttgggtgtttgctgatgagcagaaggctaggtaactgagtgctagaacctaagctctccctgctcatagcagtttttctttgggtctcaggatgtcaggcaagaagtgaggatggctgggagctagggagtggcatgtcatccctggggagatgagaaagggtcagacttggtgtaagttttggagattgagctcacagatttgtgtgtgtttgtgtgtgtgtgtgtgtgtgtgtgtgtgtgtgtgtgtcaggttgtatgtatattgtggcaaaaagagaggactcacagaggaggccaaagtattttggcttgagcagtaggtaaatgatgtgcaatttgctcaaatagggaacccttgtttgggggtgggaaagtaagatttggtttgggagcgtgttaagtttgaaatgcttattagacattcagatggaaatgctgagagggtggttggctgtatgagtcttgtgttcagggaggttcaggagttcaactggggaatcgttagtccatggatggtgtttaaggccatgggatgaatgatatcactttggtattgagtgtaggtagtatagacagagacaagattcaagttgataggcagaagtttctagtattctgtaatcaggttttcattccctgtatcaatatagccaattttataaatatcccttctgacctctccaaaaatcttataaagatataaagataaataaataatatgttcatgtctcaagggaatttaggaataatgagtttagcacatgagtgtccgtacataataaaaaactcttagcaaactagaaatagaagaaagttattttattagttcacttacatactgctgataaagacatacctgagactgggtaatttataaagtaaaagaggtttaatggactcacaattgcacacggctgaggaggcctcacaatcatggtggagggcaaaaggcacatcttacatggcagcaagcaagagggagaattagagccaagtgaaagggatttccccttgaaaaaccatcagttcgtgtgagactttaatatggttgctagatacatgatgaatataaaaaatcaatttcatttcaacagtcccataataagtagaaaatctaatttttaagaaaaaatacaatttcagtaataacaaaatccgaaaagtacttataaataaatatagcacaaacttgcaggacctttatgtgaaaaaataaagtttagtacatttacagattgtttaactccatgtatctctacagaaggttgcctttgagagtaaataaagcaaatatcttccaagcaaacatgaactatgaatggaaaagatattaatgctcaatctttcatcattatgtccacctccaaatacatatttcatatcctaaaaatggtaaaaatgctatgtaatgggatttttttgtgtgtgaaggagggattgcttcagagaataggttaaaccaaactaagcagaatttttaaacagcttttttgagagatgatttaaataccacacaatgaatccatttataaagtgtactgttcaatggcttttagtggtgtatccacaaagttgcccataaagtccatccacaaagccatgttgcccaggcatccttcatcaaaatcaattttagaacacttttttaagcccaagaatcccccctactcccttacccaccccctcccaataccctatctttccagccttaggcagtcactaatctactttctatctatatagatttttaaattctggacatttcgtataaatggaataacacaatacgtggtcctttgtgactggcttcttccacttagcataatgttttcaaggtccttctacaccatagtatattatcagtattccaggtcttttattgctgagtaatatttcaatgtatagtagaattttataaacatttaacactttgcaaagatgtgagtcagctctaagtaaaatgatgtatccataattataaattagattgttttctaactaaaattcatattgctccactaaaaaactttttatagaaaattcagataaaatgcttacacaaagcatacaactgtgcattaatacaaatacaataagtgcacttcgaaaaaactttttatttatttttttgagacagagtcttgctcagttgcccaggctggagtgcagtggtgtgatcatggtttacttcaccctttacctctcaggctcaagtgattcccctccctcagtatcccaagtagctggaactacaggcatgcactactgcactcagctaattttttgtagagatggtggtctcgccatgttgcccaggctggtctcaaactcctgggctcaaggagtcctcccatgttggccttccaaaatgctgggattataggtataagctactgcacctgacccaaaaacaactctttcagaaaaatgtgtggcttcttgagatacaaaccctagcaaagtatcttttttaaaattattattatactttaagttctagggtacatgtgcacaacgtgcaggtttgatacataggtatacatgtgccatgttggtttgctgcacccatcaactcatcatttacattaggtatttctcctaatgctatccctccccaacccccccaactcccgacaggccctggtgtgtgatattccccacccagtgtccaagtaatctcattgttcagttcccacctgtgagtgagaacatgctgtgtttggttttctgtccttgtgatagtttgctgagaatgatgctttccagcttcatccattttcctgcaaaggacatgaactcatccttttttatggctgcatagtattccatggtgtatatgtgccacattttcttaatccagtctatcattgatggacatttgggttgtttccaagtcttttctattgtgaatagtgccgcaataaatatacgtgtgcatgtgtctttatagtagcatgatttatgatccttgtcaaatggtaattctagttctagatccttgaggaaaccccacactgtcttccacaatggttgaaataatttacactgccatcaacagtgtaaaagcattcctatttctccatatcctctccagcatctgttgtttcctgactttttaatgattgccattctaactggcatgagatggtatctcattgtggttttgatttgcatttctctgatgaccagtgatgatgagcattttttcatgggtctgttggctgcatagatgtcttcctttgagaagtgtctattcatataccttgcccactttttgatagggttgtttttttcttgtaaacttgtttgagttctttgtagattctggatattagccctttgtcagatgggtagattgcaaaaattttctcccattctgtaggttgcctgttcattctgatggttgtttcttttgccatgcagaagctctttagtttaattagatcccatttgtctgttttggcttttgttgccattgtttttggtgctttagacatgaagtccttgcccatgcctatgtcctgaatggtattgcctaggttttcttctagggttttcatggttttaggtctaccatttaagtctttaatccatcttgaattaatttttgtgtaaggtgtaaggaagggatccagtttcagctttatacatttgactagccagttttcccagcaccatttatttaatagggaatcctttccccattgcttgtttttgtcaggtttgtcaaagatcagatggttgtagatgtgtggtgttatttctgaggcctctgttcttttacattggtctttatatctgttttggtaccagtaccatgctgttttggttactgcagccttgtagtatagtttgaagtcaggtagcgtgatgcctccagctttgtgctttttgcttaggattgtcttggcaatgtgggctcttttttggttccatatgaactttaaagtagtttttcccaattctgtgaagaaagtcattggtagcttgatggggatggcattttgaatctataaattactttgggcagcaaggcgattttcaagatattgatttttcctgtccatgagcatggaatattcttccatttgtttgtgtcctgttttattttgttgagcagtggtttgtaattctccttgaagaggtccttcacatcccttgtaagttggattcctaggtattttattctctttgaagcaattgtgaatgggagttcactcatgatttggctctctgtttgtctgttaatggtgtataagaatgcttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcaatatgatattggctgtggatttgtcacaaatagctcttattattttgaaatatgttccatcagtaccttgttttttgagagtttttagcctgaagcgctgttgaattttgtcaaaggccttttctgcatctattgagataatcatgtggtttttgtctttggttctgtttatgtgatggattacgtttattgatttgtgtatattgaaccagctttgcatcccagggatgaagccaacttgatcatggtggataagctttttgatgtgctgctggatttggtttgccagtattttattgaggatttttgcatcgatgttcatcagggatattggtctaaaattctcttttttttgttgtgtctctgccaggttttgatatcaggatgatgttggcctcataaaatgagttagggaggagtccctctttttctattgattggaatagtttcagaaggaatggtaccagctcctctttgtatctctggtagaattcagctgtgaatctgtctggtcctggactttttttggttggtaggctattaattattgcctcaatttcagagcctgttattggtctattcaaagattcagcttcttcctggtttagtcttgggagggtgtattgtccaggaatttatccatttcttctagattttcaagtttatttgcgtagaggtgtttatagtattctctgatgatagcttgtatttttgtgggattggtgctgatatcccctttatcatttttttattgcatctatttgattcttctctccttgtatttgattcttctctcctttcttctttattagtttggctagcggtctaccaattttgttgatcttttcaaaaacaagcttccggattcattgattttttgaaaggttttttgtgtctctatctctttcagttctgctctgatcttagttatttcttgccttctgctagcttttgaatgtgtttgcttgcttctctagttcttttaattgtgatgttagggtgttgattttagatctttcctgctttctcttgtgggcatttagtgctataaatttccctctacacactgctttaaatgtgtcccagagattctggtacactgtgtctttgttctcattggtttcaaagaacttctttatttctgccttcactttcttatttacccagtagtcattcaggagcaagttgttcagtttccatgtagttgtgtggttttgagtgagtttcttaatcctgagttctaatttgattgcactgtggtctgacagacagtttgttgtgatttctgttcttttacatttgctgaggagggctttacttctaattatgtggtcaattttataataagtgtgatgtggtgctaagaagaatgtatattctgttgatttggggtggagagttctgtagatgtctattaggtctgcttgttgcagagctgagttcaggtcctggatatccttgttaaccttccatctcattgatctgtctgatattgacagtggggtgttatagtctcccattattattgtgtgggagtctaagtctctttgtaggtctctaaggacttgctttatgactctgggtgctgctgtattgggtgcatatctatttaggatagttaggtcttcttgttgaattgatccctttaccattatgtaatggccttctttgtctcttttgatctttgttggtttaaagtctgttttatcagagactaggattgcaacccctgccttttttttgtttttcatttgcttggtagatcttcctccatccgtttattttgagcctgtgtgtgtctttgcacgtgagatgggtgtcctgaatacaacacactgatgggtcttgactctttctccaatttgccagtctgtgtcttttaattggggcatttagcccatttacatttaatgttaatattgttatgtgtgtatttgattctgtcattatgatatttgctggttattttgcccattaattgatgcagtttcttcatagcattgatggtctttacagttttgcctgtttttgcggtggctggtaccggttgtttctttccatgtttagtgcctccttcaggagctcttgtaaggcaggcctggtggtgacaaaatctctcagcatttgcttctctgtaaaggattttatttctcattcacttttgaagcttggtttgactggatatgaaattctgggttgaaaattcttttctttaagaatgttgaatattggtccccactctcttctggcttgtagagtttctgctaagagatctgctgttagtctgatgggcttccctttgtgggtaactcaacctttctctctggctgcccttaacactttttccttcatttcaaccttggtgaatctgacaattatgtgtgttggggttgctcttcttgaggagtatctttgtggtgttctctgtatttcctgaatttgagtgttggcctgccttgctatgttggggaagttctcctggataataccctgaagagtgttttacaacttggttccattctccccatcactttctggtacaccaatcaaatgtagtttggtcttttcacatagtcccatatttcttggaagctttgtttgttcctttttgctcttttttctctaactttatcacttcatttcattaatttgatcttcagtcactgataccctttcttccacttgattgaatcggctattgaagcttgtgcatgtgtcacaaagttctcgtgccaaggttttcagctccatcaggtcatttaagttcttctctacagtgtttgttctagttagtcgttcatctaatcttttttcaaagtttttggcttccttgcgatgggttcgaacctcctcctttagctctgagaagtttgttattaccgaccttctgaagcctccttctgtcaactcgtcaaagtcattctccgtccatctttgttccattgctggcaagtacccgcgctcctttggaggagaagaggcgttctgatttttagaattttcagcttttctcctctggtttctacccatcttgttggttttatctacctttggtctttgatattggtgacctacagatggggttttggtgtagatgacctttttgttgatgttgatgctattcctttctgtttgttagttttccttctaacagtcaggtcctttagatgcaggtctgttggagtttgctagagttgcactccggacactgtttgcctgggtatcgccagcggaggctgcagaacagcaaatattgctgcctgatccttcctctggaagctttgtcccagaggggcagccgcctatatgaggtgtctgtttacccctactgggaggtgtctcccagttaggctacgtggcggtcagggacccacttgaggaggcagtctgtccgttgttggagctcaaatgctgtgctgggagaaccactgctctcttcagagctgtcagactgggacgtttaaatctgcagaagttgtctgctgccttttgttcagctatgccctgcccacagaggtggagtctagagacagtaggccttgttgagctgcagtgggctccacccagttcgagcttccctgctgctttgtttacctactcaagcctcagcaatggcggatgcccctcccccagccaggctgctgtctcacagatcatctcagactgctgcgctagcagtgagcaaggctccatgggtgtgggaggtgcacagccaggtacgggagagaatcaccttgtctgccggttgctaagaccttgggaacagcacagtatttgggcgggagtgtcctgtttttccaggtagtctgtcatggcttcccttggctaggaaagggaaatcccctgactccttgagcttccctggtgaggtgatgccctgccctgcttcggctcaccctctgtgggctgcatccactctccaaccagccccagtgagatgaaccaggtacctcagttggaaatgcagaaatcacccatcttctgcattgatcatgctaggagctgcagatcggagctgttcctattcggccatcttggaaagccctcacaaagtatctttttaaatgcagttggaggtcttttgtgcctctttttgatgaatctcaatttggaaaaacaactcttaaatgctttctgtatttttcattaaatggaagggtataggaagggtataggcccaggtgaatgaatgaaaatgctcttatactgttattttacacagaaaccagagatgatatcacaaccagttaagcttatttcacatttgttgattgtagaaaatttcacttctctcccactctcagttctggtgggctgactccatgctttatgccgttgctcttggttctaaatgtccaggctcccacttgcaatttggatttgccattacaggtgtctgctccttatgggtctggcacccttgttagcagaagccttgggagtcagcagaaggctcccaatgaataaccaagctggattaccagaggaaaaaaacatagcaaaagctggacaaaggtggtgacccagagaagaatcaggcataagagccagcccaccaaagaagcacaacaggaacaaagcagttagatgtgttctgtgtgtgcaggcgacagaagcaagcaacagaaaccagctctgcataacttgtgcagaaaataaatgtttagaaaggatgttggggacctaacagcccccttcctaacagaaggaagtggtgaacatcagtctttggaaaagacagaagcgaaggcaactgcaggcatctaagtaccaggattcagtggacagttcttcaaggacccacagctggaatgaacaacctccaaccatgctcgtattctgagccactcaattgaagattcataggccctcctctggaatcagagggagagtggaggagagagagaaataggagaacaaggaaaatgtaagctatgttgctggaagaaaagagaatgatgacagatagataaaaagaacagctatcccctaaaggaagacacagacaccaccctactgacacccagagatgacctgaacgagtacctagctgtaggctaggccaagatgtttttcaaaaattacttttggatttttttctaatacagaaagacaggacagacctaggcccgaagatctacaccagaggtcatggttcaataattttattctaaaagcaaaacgaaggaaacaaacaagcaagaccttttaaacgaatgtaacccagctgggcgtggtggctcacgcctgtaatcccagcactttgggaggtcaaggcaggtgtatcacttgaggtcaggagttcgagaccagcctggccaacatggtgaaaccccatctctactaaaaaaaatacaaaaataagctgggcatggtggcacacacctgtaatcccagttactcaggaggctgaggtgagagaatcacttgacactgggaggcagaggttgcagtgagccaagatgttgccactgcactccagcctgggcattggagtgagaccctgtctcacacaaatagcaacaacaacaataaggtaaatataaccagaagcctatagctcaggataggttagttgtaaaatataaacaaatgaggtaatatgcatggaattattgggaatacctttgaaaatgatggctttggttttttttttttttttttttttttttgagacggagtctcgctctgtcgcccaggctggagtgcagtggcgggatctcggctcactgcaagctctgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggctttggttttaaagtaattgagctacatatccctctgccaacaactagagagaaaagatggaaactcactactaatctgtttataaaactgtcatttgcatatagaggaaaacttaatttgctgtttctttctagcaggagggcttacaattagctcatcccaaagagaaaggaacaaaacacattcttgttttatcccactggaaaatatcatgctctctgttagaagcctgtcaaagcataactcagacttttagtcagagcacagctgaagcttaatcatatgtattgggagattaattatgtatagattgtgtgtctgggcaaaggcaaagcagagtgcaggatacataaaaggaaaatccattgtctggggcacatagagtctgtctgtctctgtcttttttttatttggtctgtgggcaaactgattagccaaccaacactatcaagaaggtatatgattagggaaggcagttttagttatatgagggcttccagagagtgttgtgatttcaggttggagggtatacgatgttatttgtctgctctctttccattggtgcctccaccttggttagacaaggtctgcaccattttctgattgtgtcttaagacctgtccctagaccttgactttccaggtagcactaaggtgcagattccatgtgatcatcaacagctgggacctatcttgatactctcaaagcttaggtcatcactgattttcattcctaaaattctatggggtggaaaagtataaaccagagatcatgggtaatatcattgcctcaagtctgcttagcactggaatggaagatttggcttgcaatcgatgaagaaaactcacctatactttagggacgtagaggtaagcttaaacacaggtctacatttgtggagggtaaaagaactgcccttttcactattaagtaggattttagttgtaggtttttcataggtactctgtatcatcttcagaatgttctcatttattcctagtttcctgaaagtgttttttttgtttttcctttttttttcaatgaatacatgttacatttgtcatatacttttttctagatctaatgagacaatcacatggattccctttgctaatattctgtcaggcttctttatctatgttcgtgaacaaatattgttgtaattttttttcttataatgcctctatcaaattttggttcagagttatgttggcatcataaaactagctggaatggggtgtcttcctcttttattttctgaaagagtttaggttgaagtgctattgtttcttccttaaatgtttgatagaaatcactagtgaaatgatctggattgaatttttcttggttgaaaggtttctaattacaaattcaatttatttaatagatatagaactactcagatatttatatttctttttgtattctttcaataagtcgcatttttcaggaaatttttggtaatatcatctactttttaaaatttattgacataaagtttttcataatgtcctcttaatctttttaatgtgcataggaatctatactgatgccccctttcattcctgatatttgttttgtttcttttctattaattttaagagatttattaactattccaaagtaccaacttttgtttttattgacttttttattgtttatctttcattttcattcttttttttatttttcttctatgtattttgggtttaattttttctttagctagcatcttaaaaacttaggccattcaaacatctttttccttttctaatattaatatttcaagttatacatttccttttaagtacattagatgcatgccacaaattttgatttgttttattttagctgtcatttagcttgaaatattttatttttttaaaaaaacttttgatttcaggggtacatatgccagtttgttacataggtagacttgtgtcatgggagtttgttgtacagattatttcatcacccaggtattatgtctagtacccattagttgtttttcctgatcctctccctcctcttaccctctactatccaataggccccagtgcgtgttgttcccctctatgtgtccatgtgttctcatcatttagctcccacttataaatgagaacatgaggtatttggttgtctgttcctgtgttaatttgctatggataatggccttcagctccatccatgtccctgcaaatgacatgatcttgttcttttgtgtggctacataatatcccatggtgtatctgtaacacattttctttatccagtctaccattgatggatatttaggttgattccatttctttgctattgtgaatagtgctgaaatgaacatatgcatgcttatgtttttataatagaatgatttctattcctttgggcatatattcagtaatgggactgctgggtcaaatggtgtttctgtctttaggtctttgaggaattgccacactgtcttccacgatggttgaactaatttacacttccaccaacaatgtataaggattcctttttctccacaacctcaccagcatcttttattttttgactatttaataatagccattctgaatggtgtgagatggtatctcattatgtttttgatttgcacttctctaataatcagtgatgttgagcctttttcatataattgttggccacatgtatgtcttcttttgaaaaatgtctgttcatgtcctttgcccacttcttaatggggttgtttggtttcttttcttgcaaatttgtttaagttccttatttatgctggatattagacctttgtcagatgcatagtatgcagaaatttctctgattctttaggttgtctgtttactttgttgatagtttcctttgctatgcagaagctctttaggtttaattagatcccacatgtcatttttttgcttttgttgtcttcatcataaaatctttgcctgtgcctatgtcctgaacatattgccaggttgtcttctagagtttttatagctttgggttttacatttgtctttaatccatcttgagttaatttctgtatatagtataagaaagggatcaagttttaatcttctgcatatggctggccagttatcctagcaccatttattgaatagagatttctttccttattgcttgttttgtcaggtttgttgaagaacggatagttgtaggtgtacagtcttattcttgggttctgtattctattccattggtctatgtgtctgtttttgtaccagtaccatgttgttttggttactgtagccctgtagcatagttcgaagtcaggtagtgtgatgcctacagctttgttctttttgcttatgattgccttggcatttttggttccatatgaattttaaaatagttttttttctagttctgtggagaatatcaatgatagtttaataggaataacattgaatcggtaaattgttttggacagtgtggctattttaatgatattgattcttcttatccatgagcatggaatatttttccacatgtttgcatcatctctgatttctttgagcagtgttttgtagttctccttgtagagatttttcacctttaacacagttagctgtattcctaggaattttattatttttgtggcaattgtgaatgggagtgcatttctgatttggctctcagcttgactgttgttggtgtataaaactgctagtgatttttgcacattgattttgtatcttgagattttgctgaagttgtttatcagcatcagcttcagaagctttttggctgagactatgtggttttctagctataggatcatgttgtctgcaaacagggatagttcaacttcctgtcttcctatatggatgctctttatttctttctcttgcctgattaccctgcagggacttccactactacattaaacaggaacggtgaaagagggcatccttgtcttgtgccggttttcaaggggaatgcttccagcttttgcccattcagtatgatattggctgtgggtttgtcatagatggctcttatgattttgagttgtgttccttcaatacctattttactgagagtttttaacgtggatcaatgttgaattttatcaaaagcctttctgtatctattgagataataatgcggtttttgtctttaattctgtttctgtgatgaatcacatttattaatttgcatatgttgaaccaaccttgcatcctagggataaatcctacttgattatgatggataagctttttgatgtgctgctggatttggattgccagtatcgtgttgaggatttttgcattgattttcatcaagaatattggcttaaagttttctttttttgttgttgtatctctgtcaaattttggtatcaggatgatgctggcctcatagaaagagttagggagaagtctctcctgctcattttttgggaatagttttagtagaagtggtaccagctattctttgtacatctggtagaatttggctatgaatccttctggtcctgggcttttttggttggtaggctgtttattactgcctcaatttcagagctcattattagtctgttcagggattccatttcttcccggatcagtcttaggagggtatatgtgtccaggaatttatccatttcttctacattttctagtataggtgcatagaggtgttcataatattctcttggtggtttgtatttctgtgaggtcagtgatgatatcctccttggtgtttctgattgtgtttattaaatcttttctctcttctttattagtctagctagcagtctatctattaagtttttcaaaaaaccaactcctggatttgttgatcttttgaatgctttttgtgtacgtgtgtgtgtgtctcaatctctttcagttcagctctgatttttgttatttcttgtcttctgctagatttgggattcgtttgctcttacttctctagttcttttagttgtgatattaggttgttaacttgggatctctctaaatttttgatgtgggcatttaatgctataaatttcctcttaacaatgacttagctgtgtcccagagattctggcatgttgtatctttgttcccgttagtttcagagatcttgactactgccttaatttcattatttacccaaaagtcattcaggaggaggtgattcaatttccatgtaattgtatggttttgagtaaatttcttggttttgatttcaaatttgattgctctgtagtctgagagactgttacgatttcagttgtattgcatttgctgaggagtgttttactttttatgtgactgattttagagtatgtgccacgtggcaatgagaggaatatatattctgttgtttttggttgaagagttctgtagatgtctgtcatttccatttaatcgagtgctgagtttggatcctgagtatttttgttaattttctgtcttgatgatcagtctaatattgtcagtggggtgttaatagtctcctactattattgtgtggggacctaagtctctttgtagggctctaagaacttgcttcataaatctgagtgctcttgtgttgggtgaatatatatttaaaatagttacattatcttgttgaattgaaccctttaccattatgtaatgcccttctttgtcttttttgacctttgttggtttaaagtctgttttgtcaggaactaggattgcaacccctgcttttttctgtttttcattcacttggtagatttttctccatacctttattttgagtctatgtttgtcatttcatgtgaggtgagtctcttgaagacagaataccaatgggtctttcattttgataatttcttttgacctgtgtttgagttcagtggtgtttttcttctgtactgtccagtctgctgttaatttcattcaatgaatttttggttccagatactttagctttctgttctaggatttcttttttgtttttttgttagatttcatatctttcctaagttttcttatctttttattcatcatatccatatatgcctatagattccttgacatacttaatataggtattctaaagtccttatttgctaatttcaatatctgagtcatctgtaagtctgtttcagtttactatttttttctttgtggctacaggtcacattttccttctttatatgtttagtgatttttaattatatgccgtacattaaaaataatatattgaggagacctgggatttatcttcctctgaagactgttgaactttcaggcagttaagttactggtggcctcccttaactttgtggagggttgattttgggctttgttagactgtcctaaactgatgttgctcttaggcttagggtatactttcttctaatgtgtggaccttttgggggtttaatgggaagtccaaggtgttcaacaagtccctttatataggtaattggcaagaacatatgtaattatattatgggggagtcttgccacataggctactttctattccatttaggccctaggcttggcttgtttatttgttttaatcacatatgtttttaagaaacatttataagaatatgaataaaataaatattacctgaatagaggagatcccgcatcttaaaaatcaaatatagatagtccctgactgatgatggtttgacttataattttttttactttatgatggttcaaaagcaatactctttcagtagatatcatactacaagtacacatataaccactctgtttttcactttcagtataatactcaataaattacatgagatactcaacattttgttataaaatattctttgtgttagatgattttgcccaaatgtaggctaatgtaagtattctgagcatatttgaagtaagctagcctaagctatgatgcttgagaggttaggtgtattaagtgcatttttgacttacaatattttcacttatgatgggtttattgggatggaactctgatgtaagtaaaggagcgtctgtattttctgacccaaatagaaaacttatcatgttcaaatttggtgggtgaatgcaagcccactgctctttcaattgctttatgttttatttgtaatattttcaaacatcttaagcccattatctattaaaagacactaagatacttaaattttcttctgaaaatatgtgtatatctttctggctgttaattaccaattttggtgattattgataagctatatattggtaggctaaatgccaatctaatataataattggaaaagttctgagtaggcaaaagttgcctccatacttgtttggccatggttggcatacgtatttagttttttaatcatctctttttctttttactacatattaacaaaatgtctcctcattatgttagcagaatcctgcctattatttaggcacagagttattcagctgtaacattgcagtcaactaggtgtatttctactttagcatccctatcatcattgttttaattataacatttgttcttacaaagatgttcatacatttttgacaggaacattttcccatcagacttttcttagtccatactgtctccaattatgcctggacacaagtgggcattttgcgtacctcttctccagttgtgctagtcaacacttacctatgccttgtccccctttgatgactgtttacctttaccacatttatagaaatttttcaaatgatgatggaaaactgccacattaaatggtatcctaagagctcttaaagaatgctaaatttcttaataaaatatcgaaagataccaaaaacaaaaattttcaacatcccaaattgagacaaatgacctattgttaccttctagaaggaattttcactaattatagtcaatggagttgggtagagaaaagtagtcagggtcttaaccatgctctgcttcaggaaaagagaacagcttcacattccttaaagaggtagagcaagagttcctcacttcctcacgctctgctccttcatctgtattattcaaaaaattgggcagctttatctctattcatttcaaggcatgtattctatgatcttgtattatactagaagaaaatagggaggaattattgtttgtccactgtaatcttggagtgtagctaatgagaaaagtagtccaggacgaggaaaagagagtagcgtagatggaggcaccttaatgaagatagggaacatgggatggaagagcaaatttggatgaaatatgattacttcagttttgtatatactgtgttttactgcaatcattgagacttgaggcacttcacattttatcatcgttgagacttttcatatagaatcaggtgaaattattggtaggaacttggccagttgaatagactttaaggtggaagtgatatggatttggaaaacatgtcatagttgaaaccatggatatagatgagaaaagagaaaagggcttgcataaatccccaagatgcaccaactttaaatttaggcaaaggaaaaggagcaggctgagttaaggagggacagaaagagagatggaaacaagtcaaagagagagtgatctctcagaatccaagggagaaaagtgtttcaagaaagaaggaatagatcacagtgtgaaatgcttcagattaagtaggtatgtaagttgtgtgtatgcattaagcaagtattaaataagagtaagtaagatgaatgctgggaagtgcttactgtaattgagtgttatttagtcattgattatctttggcaaaaacatttcagaggaatggtggaggtaggagagattcccatgagttgagtgcatgagagggccgaaataagggtcacaaaagtctttctagaaatttcacttttaaagtaaaataaggggcagtagctagaaggttatgcaggatcaagggaggtttttattgtttgtgagaaagacttgaatacatttatatttttgagggaaggaagcaaagagattgacaggagagagaataaacagcatgttcattctctgaacctagagaggaacaggtacatttattgacaaagagacaacttactctgtgattcacaggacccaacttagagatttttggatccttgagttctcaagtgaaattaggttggtgctagggctcatagagggctttaacgtaaagtttgacttggctatagaatttttgccataccaggttgggcgcggtggctcatgcctgtaatcccagcactttgggaggccgaggctggtggatcacctgagctcaggagttgaagaccagcctggccaacatggtgaaaccccgtctctactaaaaatacaaaactcagctaggcgcagtggcgggcacctgtaatccaagctactctggaagctgaggcaggagaatcacttgaacccaggaggcagaggttgcagtgagcagagatcgtgccactgcactccagcctgggtaacagagtgggactctgtctcaaaaaaaaaaaaaaaaagaatttttgccataccaagaatggggttgacttggtcctgcattttaagacagaggtttcttctgcctcaagcccctaacttcagcctgaaatcatcaacatccatcacagtagcggaacaacctagaaggaattgtttcattctgaaaagactttgagatgattaaaatatgcaatacaaatgggtgaaaagaaataggtgataaaatcaagacaaatgggaaattaagtttgggaatattaattaaagctgggcaaaattagtacccgataaactcatagtacactgttctgttcagctgttacagggagcctgcaaattgcctctaagcttgttagtggcctgagcaaggaggggggaaaacaattggttacaagattcagaatgtctaaatgacgaaaacaaactagtcattaaggaggccacacagcttttcttagtagtgaggcttgagagaagggttctttcatggatgttctgcatttccacaataaatacacaagcaggttttatagggattttcttacaatacccctcactgaaagtggacggcaacatgactgtccacatcactttttgtagaatgaagtgtcagcaagggccatgtaataggtactaaatacttaaaagattttgatcattttaatgggtcttattacttacactgaattgttcctcaaacaacatctgtccagtgttccactcttaattttcattttctttaaaactcctgagatgaagatgattcccatttcactttagaatggatttaaaaattgtctcaatttcaattgcctttctcattgtttaccatgctttatattcaaggtgagcgaagcaaagcacttgttactaggagataacagcgttgggtttcatttataatcgttaagattttcagatagatgctgttttggggggtgcatccttatctaggagaggtgatcaatgagcctttgctagtgcccagcagagacaaggtacagacagaggaaattaaaattctgggaagaggaaatcattgttagtcccaatgttatagtgttgttttcttttctttttttctggccggaggtaagccaaaatttaattacactcctgatggtttgggcttgataagtgtaatggatgataagtcataggtggctgaaaatcaatatgttttttcagcagataataacatgtttgctttggaatattttatctaagtgtgagatacaacgtgcaaaggctttcatattcctttgaggtgagagctctggaaaatgcaatagggcaaaggcaaactcacgtttagggcttagatatgccctggtagacccttgtctttgaataattattttagaaatcttcatgcaccaaaagctttgcctctggttactgggaacaaggtctttatgtgtctgaaactacattagctttctgcttatgctgcttctcatgagttttccagattatgtattgccaggctgtggctgtgcttcctgccgagaacaccaacttaaatgaaagtgtttttattttggagctgtaccagattagagggaaggtattctcagaaatagctgttgcagaagtgagaagagcaaagatttacaaagagacaagtggtatgagaacaagagcagtcaatgtgtagagcaagaagccatcagaagaacttggatctggttccttccctagccagatgactttgttctcttctgttccatggatatagaccttgtctttcaccaggtgggagtaaattgccacttcccttttaagaagagaacccatgtataccttagatcccaatcactgagttttgccatcgaaaactctgacttataatatgatgtttagaaagtaattgaacttctgggcttcagatgcctcttgagtatgatctagactaataatattgggtttttcttaccccaatgggagatgcagagctactcaaagcatggaattctaaagctcaaaagtcatctggcttagtctagccccaggtatgtgagctcaggggtatgagctctccatcacaattggacctgcgctaaaaaacaaaaacaaaaaaaccaaaactctcctcttctcccctagggtaaagaaacttctctggttgattattagactatcttattggtcttatgcaagtatatgctctttgttataagaaatatggttactggagctggaagtaagataatatagatagtatcctttagtttgacaagatgcttcatttattagctgtgtgacttggtaaattaccttgatcattctgaattgttcatctgtaaaatggaataataatcctacctctctagtttcatgcaaaaggagagagtttttcaactcatatgtgctaatgttactttatatttggttcacatttattctgggaactaaccacttttgatcaatgactcacatttgctttgtggtgcaccaagatatccaggtgcctctggctacatctggggctgtccagttaatttcttcccacctaggatatatatggtttggttttgattcaaatgatgcagattatgtttaaactcctttctctgaacgaagcccgggcacacaggcaggcaggcccagagatacgtacagatgggtccattttatctcatgggtggtcagagcagaacagtcacacgaggtgtatagatgagtgatgtctcacctgctcccaacacatggctgttccacagcaggtaacccaaagctcagctctgtctttggacattaactcaaagaaaggtctcaaatgtgtgttaagaattgagaatactaccctcagggcataagaggtcataaactttttctgtgccatggatctctttggcagtttggtggagcctatggactccttgaatcctataaaatgtctaggattacaatttttttaaagaaggaattatattgaaaatcattaaaatattttaaaaacaaatctgtgctattgtaaggcatgtattttttattcattaactaaatactaagccaaacagcaaatagaataactaatttaaaagctgtggtgtgcataatagttattttaacatatctacaaaaagcataatataatatgaaagtgtctgtggtttccgttggtgacaaggtcacaggtactgctaatcctcctgaggtttgttatctacaattgcaactgagagaaatgctaaaattccattcgagattaatgaaagtaaatatataattttttactatccaagttcatagattcccctggattccatcccaggtaaagatcccagagttagacaataaggaaaacagaagaaaaagtaagtataaggaaaatggaaagtcttatttttcaatgtaaagttatctgacagttaattatatttcaaacaaataacattaaatgtgttccagtttagtgattagcacagctttttacatagttttctctcaataaatatcttttgaagaaattaacaaaaacattgttttgcattgtaattctccatctacttgtctttttcttccactggtctatgagctcattgaggacacattaactgcccacacatcatttgtacagctttttaacatcctgttagataggaaagagagagctctcatgaatttctggtagaattctgttcaatagctgtaattggttatttattataagtcagagatataatgtcatttaatactcacaataagcttagaggtatacattattccaactcaacgatgcaattcaaatgttgttgagggtttatgtgtggtaagccagggcaggcattgcactaagcacaatgtcacagtggggttgtagagatgaaaaggattcctgcctgcagataacatacaatccagtagggtggaaagacatggatatgcctaattatgagacaaggtaaacaagggcaggctgggggatcagcatgacaaaagacactagggcaggatggagttttcatttttacaatgggtttttcagagaaagctgaatggataggctgaaatttgaactgcagagcgaagtattttagacttattatatgggtagttcaaaaatatcactgtttccttcaaaccacataccaattgtatatctcattccaaatcactgtacactagatgataatgattttgtaggagcctctgagaagaccattatgaattttgatgttttcagattaagtttaatcagcacccctctccccatccctaatgtaagtgttgctcaaggcattcaggtgactgggtttctcacaagaacagaagcatttaaatgccttctgttaccaacccaataatgctaacctgaagccctgctttgctgttggattcagtggttaagcatcatagtagtggttcctggtaatttttccaaatcaaaagtttaagagaattaataacatgtagtaatttgatccaactttattctcttggaccagtcaagaccaattaaggagccaccatccatgccatgcctctgtttatcctaatgagaagtgcatggattgataatgaaggctggcagcttaatgtagctcaaaacataatttgtaaactctaatgaccagaatgttagccataagaatggtataaatggaactgcttctcagaatatattctgttttggtgtttctggatcactttgcttcattcactcaaggaaaaatattgccttgtacataatgcactaggtaatcatacagttgcatcttctactgaaaatgtttctctcagaatcatctgtttatgtacatatttgggttttgcatatgtaaagtcatgggatatttgagtagaaagggcttacaggctctctcatcaaattgtcttattttacagttaagattctgaggcccagagagaaaggacttaaccaaggccatttgacgacttactactagacctgggatgggactcaggcccacacatttgttccacactgagtagtttttagggcacttgaccttttatttttttggagtaccttatgttgcacaataacatttttctctgtcaggtttccagaatcttctggcctagtgccattttgtattttgcaccaagtggagagataacgtcgttggcgaagcatcctttcctctcctttgacttcttgcctttatttctgaatatccttcttgcagtgggttgaatagtggccctccaaaaaacatacttatgtcctaatccctgaaacctgtgaacatgacattatttggaaaaagagtcttcgcagaggtaattattgtaatccccaatgttggaggtaggacctggtaggaggtgattggaccacgagggtggatttctcatgaatagtttagcaccatgtccttggtgctgttcttatgttagtgagtgagttctttcgagatctggttgtttaaaagtgtggcacctcccctccccgcttgctcctgctttcaccatgtgaagtgcctgctctttctttgccttccaccatgattgtaagtttcctgaggcctccccagaagccgagcagatgccactatgctttctgtacagcctgcagaatggtgagccaattaaacctcttttctttataaattacccaatttcaggtatttctgtataacatagcaagaatggattaatacagatcttgagatgagatcattcttgatttaatccaatgtcagatatccttataagagaagtgcagagggagatttgagacacatgagagaaggtcatgtggaaatggaggcagagattggagttctcctgctacaagccaagggacagaaaggattgctaacctccaccagaagcagggagagaaggcaggaatagattcttcctcataacctccaaaaggaccaaacctgctgacacccagatttcagacttcggctttcagcactgtagagaatacatctttgctgttttaagtcatccagtgtgtggtgattagttacagcagccctaggaatcaaatatgcttcataagccattttccttgggccacactgaggactgggcactgtagaggccacgtgtgtgagcattgaggggagctgactcatgttcgtgttcttgctcccacaatgactagagctatgatgctggtaggttagattactgctctgtgactcaggtttttcaactataaaatggggatcattattggttatgataatgtgcattaattatacatgataatgtataatatacattatatagtgtatattggttatattataactgataatgatccccattttacagttgaaaaaaatgagataatgagataatgtatatctcataataagacagtgtatattaatgcttagcatgggtcctggaacacaccaaatgtttaacaatgtgagctgatattattataatgtcgccagcctcttttgcttgcttctttgcttgtagaaaggggattcataagcatttcctagcctgatgaatggcatatgtgctgttgcttgtggtgtggcaaactctgtgtaggaaggtagtcctttctgatacatgggctctgccctcctttctatcagtgggttctcatggccccaacacacccttggccctgatgaaccctccttgagaaactctcttcctgcagcatctagggcagtggtgctcatctctggctatgcgttggaaccacctgtggagtttctaatgcgctaatgcccgggccccactctagacccctctgaatcagagtgttttcaatagaacaggctcagtgaccacagggagaagggctcagctatggttcaggtaacacacctcattggagtttctaatctgagaaactgcagggggcaggcaaggaaataggagctgtcacctagagcagaatttttctatccaaggtgaattaccaacttcaagaaaatttctaatccatcacagccaatatgttagtaaaatacaataaaaagttgactacacaaattctaccaagtacccgacaagtactcctcataaatgaattacttaaaaaacaaaatttaaaacacacacaaaataaaacctctttttgattattacattaaacagatataaatcattttgtcaaattgctgaaaagaggttaaacatatacttactatatgaactagcaattccattctaggtatttacctaagagaagtgaaaacatataagcatacaaagagttgcacatgaatgtccatggcagcttcattcttaagaatcctaaactggaaatgatcgaaatgtccatcagcaggtgagtagataagaaaactgtggcacatccgtacaataaaatgttactgaaccataaaaataaataaattactgatacacacaaaacatgaatgaatcttaaaggattatactaagtagagaaaccagatctcaaagattacagtctatatgatccatttatgtgcaattctagaagatacaaaattatagtgataaaaagcagattagtgattacctgagtctaaggggtggtcataggaatggagtgcaaagggacagaagggagtattttgtggtgatagaaatgttctgtatcttgaccatagtggaaatcccatgactgtgtatgtttatacacataccgtgtatgtcattgaactggacacttaaaatatatgaatttcattttatgcaaattataccttgaaaaagccgattttttacttgctgtaaaactttctaaatatacacagttatatgtcagagatattgtgagttcagttccagaccaccacgataaagtgactattgcaataaagcaagtcacacaagttttttttggtttcccagtgcatgtaaaatttatgtttacactatactatactaaagtagttatagtatactatactgtaactacactatactctaaagactatagtcttttaagtgtgcaatagaattctgtcatatatatatttacacacatatatataccttaatttaaaaaatactttattgctaaaaaatgtggacaattacttgaaccctcagtgaattatattttttttttggtggtagggtcttgccttgatgctgatggctactgactgatcaggatggtggttgccaaaggttggggtggctgtagcaatttcttaaaataagacaacaatgatgtttgctgcattgatggacttttcctttcatgaaagatttctctgtagcatgcaatgctgttcgatagtattttacacatagtaatttttttttcaaaattggtgtccatcttctcaaaccctgccttgtaaactaagtttatgtaatattctaaatcctttctgtgatttcaacaatgctcacagcatcttcaccaggagtagattccaaggaaccattttctttgcttatttgtaagaagcaactctctgtccattcaagtttgataatgagattgcagcaatttagttacatcttcagacttcacttctaatttgagttctcttgctatttcaaccacatctgcagttacttcctccactaaagtcttgaacttctcaaagtcatttacgagggttggaatcaacctcttccaaactcccattaacgttgatatcatgaatgttcttaatggcatctagaatgggtaatcctttccagaaggttttcaatttactttgaccagattaatcaaaggaatcattatctgtgacagttatagccttataaaacgtatttcttaaacaataagacttgaaagttgaaattactccttgatccatgggctgcagaatgcacattgtgttagcaggcatgaaaacaacatcaatctccttgtacatctccatcaaagtcttgggtgaccaggtgcattgtcaaggaacagtaatattttgacaggtgtcttcattctgagcagtagatcttaaaaatgggcttaaaatattcagtaaaccatgctgtaaacagcagatgtgctgccatccaggctttgttgttccatttatttatttatttatttattttatttttttacttttattttttagagcattaacctttgcaatttattttttttattatactttaagttttagggtacatgtacacaacatgcaggtttgttacatatgtatacatgtgccatgttggtgtgctgcacccactaactcctcatttaacattaggtatatctcctagtgctatccctcccccctccctccaccccacaacaggccccggtgtgtgatgttccccttcctgtgtccatgtgttctcattgttcaattcccacctatgagtgagaatatgcagtgtttggttttttgtccttgtgatagtttgctgagaatgatagtttccagcttcatccatgtccctacaaaggacatgaactcatcattttttatggctgcatagtattccatggtgtatatgtgccacattttcttaatccagtatatcattgttggtcatttaggctggttccaagtctttgctattgtgaatagtgccgatagaacacaggcagagtagattcgcataattcttaagagctctaggatttgggggatagtcaatgagcattagcctcaatttaaagtcaccagctatattagcccccaaaaagagagtcagcctgtcctttgaaatgttgaagtcatgcattgacttctcctctctagctgtgaaagtgctagataacctcttcttctaatagaaggctgttttgtccttatagtgaaaatctgttgtttagtgaagccaccttcattccttatcttagttagatcttctggattatttgctgaagcttctacaagagcacttgctactttgtcttgcacttttatgttatgcagagagcttctttcctcaaacctcatgaacgaacctctgctggcttccaacctttttcctgcagcttcctcacctttctcggccttcatagaattgaagacagttagagccttgatctggattaggctttggctaaagggaatgttgtggctggtttgaccactaaatctttcttgatatcagcaataagactgcttcactttcttattcatgcattcactggagtagcacttttaatttccttcaagagcgtttcctttgcattcacaacttggctaactgtttggcacaagaggcctagttttcagcctgtcttggctttcaacatgcctttctcactaagcttagttatttctagcttttgattcaaaatgagggatgttgtgactcttcctttcacttgaacacctagagaccattgtagggttattagttggcctgttttcaaaactgctgtgtctcaggaaatagagaggcttaaggagagggagagagacaaaggaatggttgatcagtggagcaatcagacaacacacagcattcattaagttcaccatcttacatgtgagtggtttgtagcaccccgaaacaattacgatggtaacatcaaagatcacggatcacagatcaccataacagatatgataatgatgaaaaagttgaaatattgcaagaatgaccaaaatgcgacatagagacacgaagtgtgcacaagctcttggaagaatggtgctgatagatttattcatcacagggttgctgcaaactttcaatttgtaaaaaatgtaatatttgggaagcacaatacaataaggtatgcctgtgttcttgatttctgtatgtatcttgttgcaaatgaacaataaatcatttgtaaacccatactggtctgtgaaccaaactttgagaagcattgaactagatgatggagcgcccatagggtggcattcagagccttgctctatcttgagtgtcttaggaggttattgtcaaggactttagtgcaagggccagcactgcagcctgatccctcagaatagccctgcaaagggtttgaaattgctgctcaggcccatatttggaaacaccaggttggatgtctgcttggctgcaaatacaatccaagaacagacatttaagccccacttgagttacgatgaggccatcagacctccagttttaagaagatatttaattttgacctccctgaaaaggggcagagagattaagcttgcagtatgagtagggatatactttatggaaagtagatgctaacaaataattataggttgaatgaaaggcaaataaatgcttgcttctaaaaagtacataatggtccaattcatcagcctgccaagaaattaggccctgtagagaagataatagaaggttgaaactctcaaaggagaggcaaattccgttgtaatctttttgatgccaaatgtatttttctgcaataatcgattatgtgagtttgagactccagttgttatcgtcatctgggaaagatcctgcagttcttccatacttcgccaccatcagtcagtaggaggattactgttttttcttcagggtggaggtaggctctgaaggatcacattcccataagagggctagtggtaataagaagaactaagcgagttcagtggttgactctgggtcttttaataacttctgatcttcaattttttcatctgtaaaatggaacaataccttcttttttcttttctttttttttttttttttttttagatggagtctggctctgtcacccaggctggagtgcaatggtgccatctcagctcactgcaacctccgcctgctgggttcaagcgattctcctgcctcagcctcctgagtagatgggattacaggcgcccaccatgcccagctaatttttgtatttctggtagagactgggtttcaccaagttgatcaggctggtctcaaactcctgacctcaggtgatccacccgcctcggccacccaaagtgctgggattacaggcgtgagccactgctcctggccaaaaacaataccttctttaaagccttgtagagatcccaacgtgagatgggtgtgatatatatttttaggagaacacaataaatagcactccattacttgcctgagttctgaacacattgagaaataggacaaaagaatcaatagatggaaaatgaaagtatcatcttcatggttaataaaggctaagatgagctcagtgtgagactcacatgaggctgtaaatcccagcctggggaggacctacctttccagtctcaggccacattggaccctgctgtggggacagagcctgtctctggaggagctgggtaaacttcacgttctctatgatctggccaacttccgagaggaagaggcaggattatgcatgttaaatttatgtcaccaagttcaccacccaactgaatgactcccaggggaggagtaagctagaagtggaatgaggccaggaatgtcatggagatagagagtcttccatacagaaagagacatcaagaatggggaagagttttttttttttttcctcttaaacaatcaggactaacccctaaacctgtgcttatccatggagtggttttccccctgccggaggggatcagtgggtcagcagggctgtcccattcccatcctcaggaggctgttccccataccagccactgctcaccagcacagcatcttgccttggtttatatacaagataatgcttgtagtttagttcacaatctagaaatatgtacttttaaaatttctaatagttggtatagatcttgaaagaaatcagctgtaggtaaatatatcttgataattatgaagttagaggaataaatctttttctttttaggatattggctaaaaagggaggttgagaattctctctttttctgtctctctccgtctctttcttgccttcctccaaaggcccatctgttctctgctccaaatttatgtctctcaatcccaaaaaatatagttggctttaaaactctttataattttgaaatggtcttctattttcctatagttgttatagcttaatactatgcaatcaggaagattgcctaatgctcataatttgtaatagatatgcaattgtaattgatcttggatacacatttatgatttttccctcttcaaactgaattcaaagataacattaacctagggtacatggagacctgggattaaatgttttgaagaactaagtatagctgaattagtatagcttacaagtatgtaaattataaagactctctccctttatgtgcacccagtacccttgggaactggttattaagttcggatcacatcctatacctttaaagatgaaacaagatctcaattttacatgttttttgttctgtgacagcaattctgcttgtctgtgatatgtctcctaacttcagcatatgcacactggccacttctcagcatgaggaatggatgtatatgtttcagaacaaaagctgtaaaaatggatttttagtgccctgtaaagaagcctggaaaatcttgaaagaaacagaaggggggaagttgaaggggcagtggaagaatttgctattggcactaaatcagaggaggctaaaacataatcgcagtataagatttgcaaatgttctctttcaaaagtgcttcgatctctgagaggtaccaatgttgcattactttgaattttacacacacacacacacacacacacacacacatgcacacacagcttcatatatcctgcagtgaactgtaatctgtcagcacaatagctgggatggagtgagaatcagtatctgatttaacagtaaagtagaaaatttccttcctgtctttttctttcctctttgaatattctacctatgtttatttacaacatagcctcttggatctttgagagatagaggggaccttacttagaaagacagtctaatttcccagcaaatttaagaatgctctttctagcatttcaaattgtgatcttcctacctgtatttgaacaggtaggaaagggatgctcccaaatgctaaggacaatggtgttctttgtagatgctgctaacaattagaaaactcttatatcaaatttgacctttctctccccataatttctagtctatggtcttcattcagtcttttggaagttaggaaccaaaaagactaaatttagtttcccccaacccctccttctcacaagactcttcgatgttggaagtaacctctcatattatggtaagcctgcccccacaccacccatgcttatattcaaatactgcccatagcgggaagtggcatttctaggggagaattaacatcttaatatcaattttccaatccagaaagacgatatatatatatatatatatatatatatatatatacacacacacacacatatatatatatatatatatacacacacacatatatatatatacacatatatatatatacacatatatatatatacatatatatctccatctcagtattcattagtttgcttcagtaatgcttttaatcattttaatgtgcaggtttgatataatttagttaaatttatctctaagtatttaaatttttttaaatttttaaaaaatttttaaattgagatataattcacacatgataaaatttatccctgtaaagtatgtaagtcaatggtttttactatattcataaagttgtgcaaaaatcaccatttcatagttttaaaattttattgtaaatttcaatttccaattatttacatatagtatcatagttggtactacctagatatacaattgagttttgcattttgactttgtatcttgagaccttgctaaactcattaattagttctaataaggtttgggttttttttacattccataggattttctatacaatcatgtcatcattgaaaaatatagtcttaattattcttttcttatatctatcttttacttctttactttgtattattattaaacttccattaaaatggtgaatggcagtggtgagagcaagcatatttgcctcattcctgatcttaggagaaagcatttagtttttcaccattaggtatcatgtagctataggttttttatacatgccctttatgaaattgtagtttccttcaactcttagtttgctgagagttattttaataaatggatatttaattttgtcaaatggtttttctgcacctgttggtattactatatggttttccttttaaaatatgttaatatggtgaattacattagtaaattaatttgaaaatgttaaatgaaccttgcctttggggatgaacctcccttggtcatgatgtattatactttttctatattggtttatttgatttttaaaaaaatttaaaagttttgcatctatgtgcacaaggaatattgatctgtgatttctttcccttccccccacctccatctctcttttctctccttcctttccttcctttctttttcttctttcttttgctaaccatttaatggtggccttataaaataaacttgaaagtgttccctttctttctgttttctggaagatttgtgtagaattggcattgcactcctgtaaatgcttagtagaaattacctagagaaacatttggggcttgatatttctttgtgagaatgtttccaatgctgaactcaatttatttaatagatataggcctataggttatttatttatttatttcttgagtgagttttggtggtttatatctttaaaaaattgccaatttaatctttgtcaaatttgttgtcacaaagttttcttgcaattctctcattattctgtctgtaggatctctgagcagttttctttctttcactgctaatattggtaatttgtctgctcttttctgatcagtctacctagtgttttatcaattttgctgactttttcaaagaactgtaattgatttgctttattttttcttggttttttatttttccaatttctgatcttatctttattacttcctttcttccacttacattagatttaacttactttttaattctggtcccgtaaggtggaagattagataattgattttaaacttatcttctctaatattgatattctacactataaattctctctagtcgttagtttagctgcctctcataattgtaacacactgtgttatcattttcattcagttttaaatattttccaaattcctttgtgattattttttgattcatgcattatttagaaatatgttgtttaatttttaaatatttgggactttttcagatattcttctaacattgatttctagttcaattccattgtggtaaaatttcagtccttaaacttattgatacttgttttatggtctagactatagtgtcttcgtaaatgtttcatgtatacttgaaatgaatatacattctacattctgccagttctgagtagtgtgttctttaccacaacaggtttcctttattcattccacatcacttataccaccatatgatatgatattatagatttatttctttacttggcttgttttctgctcccccaatctcccccttccccaccgtacaattggaatgtatactctgtgagggcaggagcttgactgttttgtttactccagtattctcagttcctgaatgattaaataaatgagtggatgaattcatgaacttttctcaaaacatcaagaaagtgtatatactagaagttatgtacaggctagaccatagggctcagatgagtactttaaaactttccctctttggttagaataaaaaatgtgaaaacttacatcatgtacatatttacctaaaaaatcagccattaagaaaaataatttgtatgtgtcacacacaattacttcttaaattcagaattcaagaaaatactaacccacttcatttgtcaaaatttatttatagaattaagaggggaaatataaacaacaaccactataaaatgtaatgtaaaatgatctcatttacattagcaacattaaagaaaatctagtgatacacttaacaaaaatgtttaagatctacatgaagaaatcttcaaaacactattaagagatagaaaagtttaaataaatgcttatttcttggaaaggaatactcaatattatcagctgtctattcatattatattaatctacaaagttaaaataatgccaaaataaatactaaaggtttctctggtgtatcaggaaaaagaaatctgccagagtagaaaggaagattctgaaaaagaagaccaagagtcagtggtaactggccctccatgtgttcaagtttataactgctgtaattcaaactctgtagtacagaatcagacttagacaatgaaaaagtcaatgaaaaagaaagggagtccagaaatacacccaaatacttataggaacttatgctatcccaaagacaccatttcattttagtgaagaaatgatgacttaattaatgcatggtattaggacaagtgagatgtcacctggaaaaaaaagtattttaaaaagttggattcctactttactccttataccacaataaattccagccagatcaaatatttaaatgtaaaaaataaagccataaatttcaagacaaaaataactgaataattttttataatcttggagactttggaaacatgacacaaaattgaaatgctattaaaaagaataacacttgactattaaaatgttttaaattgtcttataaaatgccataagcaaagtcaaaagcgacttaggctatagtgaatagtagctgcaaaaaacatgggaatgaagatgtcccttctataactgatttcgtttcttttggatgtattcccagcggtgggattgctgggtcatgtggcagttctatttttagttttttgagaaacctccatactgttttctatggtggctgtactactttacattcccaccaccatataagcatgctcctttctctgcatcctcatcagcattgtcattttttgtctttttgataatagtcattttaactgtggtgagagggtatcttactacggttttgatttgcgtttccctgatgattagtgttgttgaacatttttcatacacctgttggccatttgtatgtcttcttttgagtaatgtctattcaggttttcccacatgtccgtcaatgaatgaatgagtaaagaaaatgtgttatatggacgcaatggaatgttattccatataaaaaagaatgaaatactgtaattttcaacaacatgcatagaactggaggtcattatttaaagtgaaataagccaggcacagaaagacaaatattgcaagttctcactcatatgtgggagctaaaaccgtagatctcatggaggtagagagtagaacagtggttaccagaggttgacaagggtgggggtgatgaagagaggttggttaaggggtacaaacatacagttagaaggaataagttctagtgtttgataaaacactagggagactatagttcaccataatttattgtatatttccaaataactggaagagaagaattggaatgtttccaatacaaagatcggataaatatttgaagtagtagactcccagttatcctgatttgatcattacacattgcataaatgtatcaaaatatcaaatgtacccccaaaatatgtacaactatcacatatacatagaaaagtcactttgaaaaaaactgtgaatatttttgacaaagaaaggctaacatcattgatgtcatcaagagcactcatgtttcagcaagaaaaaaaagcccagtagccaaattttaaaagtgggcaaaggacacaatcagttcattgaaatggaaataaaaatagctttaaaacatattgaaaaatattcagaacttctcatagtaagagaaatgtgaattaaagttgcaacaagatgccatcttctgtctatcagattgacaaagattaaaaaatttagtagcatatgttttcagcaagggtgcgaggagacagaaactcatatgttttgggtcagaatgtaaattggagagcaatttggcaatatctatcagaattttaaagtttatagcttttgacctggttatttcgcttctagtcattgatcactcagtggtgttggtacacatatacaaagacatgtatctacaaggatatcagcattgcctgtccttacaaaattggaaaggacctaatatccaatgtggtgttccacctgcatccccttccctgggccagtgcatctgtctcccgccactgtgagtgttggctgctgacggctcacagctcacccttccccagagaattaccctcaactgaccaggaacttcctcacctggaagtagctgggaggttatccagacgaccatttctttgtatattggcaatatacaaagccaatatctattgtatattgtggtacaaaaactcaaaatgttttcctgctgccatgcatgctccagtgctccccatgggatcaggtttgacttgactaaaacctcatctttccttagcttcttccccagcctaacttttctctctggtttctatataagattctcttgaaagcacttctcgataaatcgctggcatgagagtctcccccttaggttgtgcttctagagaatctcacctaagacattcatcaacagggtactggttaaataaatgacagtattccatataatggagtaccacctagacattaagaagagagaagcaactattctctatatactgacatggaagtctcaaaatagagtgaaaaaagcaagttatagattaatatgaataatatattaccatttatgttaaaatggcaatttacaaatatagttgaatattcatagaatatctctttgtatagaatatctctgcataacagtgtttgcttgttgcagaggggaggccaattggggtctatgaaattagaaggaagaagatagagtgaattttgcactatatactttttctaccttttaaatattctactatgtaaataaattatctgttatattatttcaacagtggtaaaaaagcattagtattttcaaatagcttcagtgttttgaaacaaagcattagtagtatcaaatatcttcagtttaggataatatcatttatcagaaatatttcttctgcccttaggaataaattacatttaaaaaaattagcatgtcagtactctaaatgaaaaagtatgtttttgaagtccctagagggtgcaaaaaaactatctcattatctatatcttaagaattatctctgcaattctgttaattttcttagtaaacacttcccttatagataatggcattgcaacttccagctggccctttttaaatgatcacaaattgccatgtatctccatttaaatgaattgtgctttttgttaacctgagtttaattaccattcattttaccgcattaattatgatagatttcctgcctccttcatacctgtggccacatagacattgcaccattattagtgcttttggcatctggttacaaattatacacacacatctgctgtgaattgtggattacattaagaatcaaacatactggatttagggcttcaacacagaaagtgatgtcaatgcacagtcctgaaacatgagaccacacattgtctctgcctcatagaacagaggtcatgactatacaaaaaacctttttgcagctgagacatggttgaatatatttcatacatctctcactgtccatttcatgagaccagggtatataacagcccccagtggccttacccttcacctgcatgtgtgctacattttttttttttttttttttttgagacggagtttcgcttttgtcacccagcctggagtgcaatggcgtgatctcagcttgcagcaacctccgcctctcgggttcaagcgattcttgtgcctcagcctcctgagtagctgggattataggcgcatgccaccacgcctggctaatattttgtatttttagtagagacagagtttcggcatattggccaggctggtcttgaacccctgacctcaagtgatctgccagcctcggtctctcaaagtattgggattataggcgtgagccaccacacccagccgggttgctaatctttgaggcaggcaacacacatccaaaatgctttaccctaccatctcccctccctgcctctcactcccgccacattggtatatccattcagagacggcacaggaaatgcagagtgggaaggctggtacgaatgctattgtggcagtggtggtcatttatttgttcacgtgttctttcattcaataagcatttaatgattcctgtgatgtgccgggcactgtgctaaaggaaaggacaagccatagtgaatatagtatctagccttgaggggtagagacttacttttgagagtcagagagtaagtaaatgtcttttcaatgtacaaaaaggagagggggaaaaactgtgaaatttaatgctatatgcatgtataattatataagtaatttgactacataacatttcaaaattctgtgcacaagaaatagaagaaataaagttgaaaggctaaagatgacaacttgattgcagcacataggacatttttatgggcaagtcgtgcttaaaaataacagaacgacaaatgggcaaaaagaaaaatgggcaaagacacaaacagatgattcacaaagaatgatcacattaaatcaaacacaagataccattttcacccactgaactggcaaaatgttgtaactgtattaccttatgaagcaagaatgtagttgaaaagattcaacacagctgttagtagaattggtacctcttttctgatgcctgtctggtggacaatcaggcagtataaatcaaaagcttgaaactagttcttgccattggagtcataattccacttttcagaattttatattgagggaataatcagagatgtaaataaagatttttgtacaaggatgtttattgtagcattatttataattaggaaaaattgcaagcaatctattccaaaattagatgattaaatttgctgacaaaattataggccagaacattattccaccattaaaatccatattttcagagtaaaaatatgagaaagcacttaaagtatattattaagtgaagaaagcatgacaacacagtaagaacccaaatggacagacagagaagaggaagccaaaatattaagattgattattcagaggtgattgaataagaagtgatttttatttccattttttttcccctgtattttccaatatcaactgtcagcagccattacctttatttattttttttttttttgagatggagtctcactctgtcgcccaggctggagtgcagtgggcatgatctcggctcactgcaacctccgcctcccgggttcaagcaattcttctgcctcagcctactgagtagctgggactacaggcatgtgccgccacacccggctaatttttgtatttttagtagagacagagtttcaccatgttggccaggatgatcttgatctcctgacctcgtaatctgcccacctcagcctcccagattgctgagattacaggcttgagccactgtgcctggcctactcttataatacattaaaatattgtaccaaatgggaaggaagagatataaataccaccaaattcattctgcacttgatgtggtttggctgtgtccccacccaaatctcatcttgaattgtagctcccataatccccacgtgtcatgggagggacgtggtggaaggtaattgaatcatgggggtgggtttttcctgtgctgctctcctgatactgaacaagtttcacaagatctgatggttttataaagggtagttcccctccacatactctcttgcctgctatcatgtaagacgtgactttgctcctccttcgccttccgccatgattttgaggcctccccagtcatgtggaactgtgagtccgttaaacatctttcctttataaattacccagtcttgagtatgtctttgttagctgcatgagaacagactaatacagcactcaatccaatattttaaatgattttttgctcaaactctttaatgatttcttatgtccttctgaatacaactgccccatgacatctcaaaattcctctcggatagattgcttgttcacaattacactttgttgtctcactggaaagcttgggctctttctaaaaacttactctaaaaagctcttggcatcctccccaaatatttatttgaaaatttttgctgggctgtgtctgtctcacctggagctctttggatgcttcatatccttttaatccaggaaagcagatgtattatttctctgttttctttttcaccactctcttatgttttcaaagtgttcattttaacaccaaataaaattagcctttcactggaaggtcaaacatgagtgtagctggcaaaaatgtactatgtcaataatatgactggaatcgtaacaataacaaagtatgggatattgcatatgataggcatggaaataaaagctgaaatgcaacattttgtagttggaaaagggaatattttaaagaatattttgtattaagtattaaattttaagagataatgtaaggttggggtatatatattatggatacagacaacaaaacaatctacaagataccacggttagaaaataaatccttgggcatgccaaggtaatttatagattcaatgccatccccatcaaactaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctatagtaaccaaaacagcatggtactgataccaaaacagagatatagaccaatggaacagaacagagccctcagaaataataccacacatctgcaaccatttgatctttgacaaacctgacaaaaacaagaaatggggaaaggattacctatttaataaatgatgctgggaaaactggctagccatatgtagaaagctgaaactggatcccttccttacaccttatacaaaaattaattcaagatggattgaagacttaaatggtagacctaaaaccataaaaatcctagaagaaaacctaggcaataccattcagcacataggcatgggcaaggacttcatgtctaaaacaccaaaagcaatggcaacaaaagccaaaattgacaaatgggatctaattaaactaaagagcttctgcacggcaaaagaaactaccatcagagtgaacagtcaacctacagaatgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacacgaaaaaatgctcatcatcactggccatcagagaaatgcaaatcaaaaccacaatgagctaccatctcacaccagttagaatggcaatcattaaaaagtcaggaaacaacaggtgctggagaggatgtggagaaataggaacatttttacagtgttggtgggactgtaaactagttcaaccattgtgaaagtcagtgtggcgattcctcagggatctagaactagaaataccatttgacccagccatcccattactgggtatatacccaaaggattataaatcatgctgctataaagacatatgcacacgtatgttttattgtggcactattcacaatagcaaagacttggaaccaacccaaatgtccaacaatgatatactggattaagaaaatgtggcacatatacaccatggaatactatgctgccataaaaaaggatgagttcgtgtcctttgtagggacatggatgaagctggaagccatcattctcagcaaactattgcaaggacaaaaaaccaaacaccacatgttctcactcataggtgggaattgaacaatgagaacacatggacacaggaaggggaacatcacacaccggggcctgttgtgggggtgggggtaggggggagggatagcattaggagatatacctaatgttaaatgaggagttaatgggtgcagcacaccaacatagcacatgtatacatatgtaactaacatgtacctgcatgttgtgcacatgtgccctaaaacttaaggtataataataaaaaaaaaaaaagaaaataaatccttgggcatgatgatgtaacttttgttttttactttttcttttctttcttttttttttttgagacagagtctcacttggtcgcctaggctggagtgcagtgctgtgatcttggttcacggcaacctccgcttcccaggttcaagcgattttcctgccttagcctcccatgtagctgggagtacaggcacatgccaacaggcccagataatttttgtatttttagtagagatggggtttcaccaagttggccaggttgatcttgaactcctgacctcaagtgatctgcccgcctcggcctctcaaagtgctggaattataggcgtgagccactgtgcctggcctattttttaccatttctaaaagacatttcccatttggttgaattcagaaattcaaatatacatatatataacttggagttgtcttttgcaatattgctgatattcaggtcagtattcccagtaaaatgtattcagcatgatataacttaacataaaaatattttccaggctttatctgaagtgtgtagtttcagtttggtatgtatttctgttgtgactaaagagaaggatttttcttactatctaagttttctatatataagatcctagagtggttctcattcattcaaaatatatttattgcatacccagtatgtttctggcaatatgtttttatgataattctattatgtcctgaaaatgtcttacagtggtattttataatggcaaaatttttggcaagtttcacaagtatgtacttttttcaaaatagcttctttattcaatgccaaaaaaatagaaattggacaaatcatcttgtcaactttaatgactaatttggaatcaccgagaataactgcttatttatgaaaatcagaaataaacccattctctaaaagacagggggatggtgttagtgtgaaagatcctgcagtgtgattgtgtttcatgaacatatataaactttagatatatcagtttaatatttgttaatgatgggcaggtactgaggtaaaaaaattaacctacttgagaatatgttaactaatctacagaggacattagtttatgcagtccttggatataagaaaatttgtattattttatttcctgaaactatgttagactgaaggtcatacaaaaattaagaggtctttcatagtccagacccctggagaaggatccacttgccttcagtccacactggtcacttttgaaaggctccttggccaggttcttgtatcttggacctcactctgtgagccttgcagttttaggacagtggtgaggggacatctctgagagaatagatagatgagttcctggcactgggagcttgagatggagtatagagcagaaaaagcaggtactcaggggctgaaagaaagaacagaagatgcccttcttcaggccggatatttaccagctgggcaggtgggttggtgctcagagaagttctcaactatgaccatgaagtcagcagattcatacttcttccaaatttcccccctttttagcctgtaaagccacagctaagccagtgctggttctgaattacttccctatgcacgatgtgtaaatgattgaaatcagatgagccatagactgtaaattcacttgtataaatgtgtgaattattgacatggatccaattaaatggggaatggtagcaagaagtagtccttggtccttcattgtagggagaaaaagttttagagggaggatactgcagaatggagtttctgatggaaaatgtttccaccctcacagattttaaataactcttctttagggaggtcagtgaggctacagggagccagagggtggcccctgctgactgtttcaaggctgtccttcccctcttctcaggcctttcacctgttggtgtcatttcacatgcgtgataatcttcaaacccagctctgccaccatctaccttccccattgctgcccttctgccccaaaggatttgagaacaacataaaacaataaatactcagctccccatgagctgccattcacttcaacttggctctcaccagtgcttgacacatcttctctccatttctccctggcaggtctccaaaagggctgctttaaaccattcctctctccttagcccccagtcccacatgctgagagtcaagagaacatgtgtgagaacgtaggtgtgggcatcagatggaactcagcactcaccagctgcaggaccttggttgcatttcctaactacatctggaaaagaaagatgatcataactagaacttaacctttgaaggttttatgagcatgaaaagatgtctggaaagaacttagcccaccaggacagggctccgtgaatgtcatctgtgactgtgggtacccttccttcaaatgagtgaacaataccctcctcattgacttggaaaacaagtgcccctagcatgctccttcaactacttgatattaatttccacatataactcactctttccacttaatcgccttttccaaaatgtacctccacccctgtgttactggatgccattgtttgtgcctcaggctccttgttgttgtcattatcccaccttctctgggactttccttggcctttaggaaaactttatactttgaaacaagtgggctgaaattctgtcttctcttggatgacctggcaccatcgctactatgtgtcacttgtgtcccccacttcttcctgtgtcatctcctgtggttcagttcttagtgtttcagtctttgcttttgacccattcactccaagggcttccagaggatgttgaatgggacaaaatattgctatgtgacccacatttgagaagatccaatgacagttggatccaggcacctccctatgacttaccactgggaggcagaactacccagttaaggaaggtggtatttgtccttttccaaagatagcatagtggttaagtgcacagatatttggagtcagactacttgggtttgaatccagcctctgccacttactaactgtatgcttttagttgagtcacttaacctagttgaattatttaacttctctgtgcctctggtttctcatttgttaaatagagataataaaagtttcttactccataggtcaattgaattaactgaatccactattaagaacagcaattatgtcactataattccccaatccttctgccctgccccaagtcccactaagggaggagagaagaaaagaaggaatgaaccatgcttgcctctaacttcaagtctccccagcaagggatcaaaatcgtgtagaagggaaggggaggggaagaggtgagatttcaatcacatttgagatagaaacatttaactggtttgaaattttaataccttttcaaaaaacatgcctggaaagctatgagatatgttcaagatgtaattatgaactaaaaaggctgtattgcagttttttagaaaaataaaaatgatttcatttaaattcaccaacttgattcctcagtaatactcataataatgatgatgatggtagctagctgaattcaggattatttttttgatattcactaccatggcaaactgtcaaacttaaaaaatcatttataactcatatccactacaatggatattatgaaagatacaaataataacaagtattggtaaggatgtagagaaacccaaatactcatacattactggtggggatataaagtggtgcagccactttggaaaaaagtttgactctttcacaaaatgctaaacatagagttacaatatgagctgggaattctactacctagatatatttccaggagaaatgcaaacatacgttcacacaaaaacttgtccacaaatgttcatagcagcattatccataattgccaaaaaagtagaaacaacacaaatgtctgtcaatggaaaaatagataaagaaaatttggtatgtccataaataaaatattgttttgccatgaaaagaatgacatatttatacatgctacaacctggatgcaccttaacaaacacgctaaatgaaagaagcaagtcacaaaacctatatactgtgtgatcccatttattttaaatgtccagaataagtaaatctagagaggcagaagttagattagtggtttcctagagctgagtgtgggctggggtgggaagtgactactaagggtattttgggtgataaaaatattctaaatttagattatggtggtggttgcacaattattttaatatgctaaaaaccattgactagtacactaagtgagtgagctttatagagtatgtaaaatttatatctcagtaagttattaagaatcagcttattattctccaagttttgaaaacagagtcacagtttccctgaccttgggctttaatctttacaataaataaccttagcctcctctctctgcatggcctctctttccacttggtgatggcagtggacatgtgtcatttttctggctgccagcatttgaatccatttccaagtttagagaactgcccccctaccaccaccatttatgagtcttggtggagtgcatcagccgcctcccattataaaatggaaaacgctggtacctgcttgctaaagtttagaggcccccaccctgccccagctttgaagtcaggcacttcaaatacaaagatacacttcagatacaaagaagtgaggacagtgggaaatccattctgatggcaggtgagcagtgacaacagccaacttggtttccagggacagcgtccgtgtccagtgccaggtagtgcaaggcatggccacactgtgctcagcaggagtgatctcaccacattgacttttggcttgattttgcctgtgactaaatgctacttagtcttctggtcctgcctgtttccaagcctgtttctttaactttcccactaattgtgtgagtttattaatagccttccgatcagttcctttccttccatgctcagtttctctgcttgctcctaagaatcctgtttgatacagtcagcaaggaaggataattttcaccccagtctccaggatctttctttagattctgtaagcatttacttatttagtgactactttgtgccatccaataaatgatctcataatcgcatagtggcaccgataccaatagctcccatttcacagatgaggaaacaggctcattgaaatgaatagcttgtagattcaaacccaggccaagcccagtgcctttcccataagatcttcatggccccttctccattttcactgacaccacatctcgctcattatttacagaacaaaaggtcccactcctctccctccctccactatctttcttctttaaatcgctgtgggcatcattgtcatatttcatcataagagtattgttgattcctttgtacaacagctgatgatgactccctactgtttaggtgatcagacctcaggaaggtatttcctgatcacatccaatgcctcctttgtctctggccacatcttttactaattctaaacaagcccatcacatgctacaagagtaagtcctgttttctcttagtctggctcaacttactatagacagcaggacctcaatcaatacccttaatctggaggctgactaaagacaaaatattgaattcactcttcatattttcatcataaaccccaaattctatgacaatgatgattttggaaacaataaattaagcatcaagcatcatatggcaaaatctattggaatgtaatatttttggcaggaaatcatttcagagtggaaaatgtttgctaaatataaacactgcaaagccatgtgcaccgccaagactttattattagattctcagggatttttatttagaagctgaggaacttgcgaggctgtacaattcctggaatggaatttaggtttgctttctgaaatcaatccaggcaagcctttttgcacatgagcattcttagaaagtctttgaatgtctattcttactcacttctatgggtggcacaaaatccaaaaataaaattaccatgaggttctgcttgcttcctgctttagcgacactggaaatcctccagggatagctcatgtactttgtaagttctcctttgcctctctcattgccagcattgggtagttgaaacctagactcaggacaagatctgggatggtgtgaacgtcaggaaggctgtgcaggagaattcagaggactgggccacaactgctaagggtagacctggaatgcaagggcaattcacagagggttggtcagcagggatggggccagctatagtggtacttgagcctgtcaaggggctgagcagagaggcctggcctgactcctaccttgcactactcttctctcaaatgggaatactgggggaatccaaacagatcctggccattagcaggagagattgaagagaccacagcccacatcctggggcactgtagcatgttccttttattgctggatctggctgtaactttgggacctgactgtgacaccctgtgtagttatcttgtcaaatccccttgtaaggcccagcctagtgcttggatgcctgacacttgcatcttctttctgtatgcttcttcctgcctcccatgtgactttgtcaagatggctgtcactccatctttgttgctatgagctttgagcccctttggacaactcccctggatgctgcttgctcacctgggccactgcctgttgttcaggccatggctttccatcaacactatcttttaccgtctcttgccaagtcaagcctgtgccctcagggccagtcttccttcatacaactctgtgaacagacctaatttcagaccctgaccatgtgttgacttcaccaggctctactcctcagaggggtagcaggagctgaggaggctgtcaggggcccaggcatgggttaaaggctttggtagcatgaatagaaagaatgggtcagaagcccagactgatggacacaggcatcagggaatgcaccaaggagaccagggcttcattggctcacaggtccctgtgctaaagaggaaagcacatccacagttaaaaaaagctgctcttccttcaggtgtatacaacctgtagcgatttgaatgttggccccaaaaggatatgtgcaagtcctaacccctactacctgtgaatatgatcttatttggaaaaaggatctttgcagatgtaattaaggatcttgagattgagatcatcgtggattacccagatgggccctaaatccaatgacaggtgtccttataagaagaaaagaaacagtgagaagaaggccatttgatgatggaagcagagattggagtggcgtaactacaagccaaggaatgccaagtattgctggcagctggcagaagctaggagaaaggcagggaacaaatgcttcctcagagcctatagaaggacccaatcgtgccaacaccttaggacttctggcctccagaactgtgagaggataaatttctgttgtttttggtcagtttgtggtaatttgttaaagcagactttggaaagtaatgcacagccccagaaggagacatggctttttgggtagagcacaggctaactttcagcccttcctgcccagcagtctggtttctttgtgcaaggcacaaactacaccacaatttatcaaggctctgatggagactgagaaaccagagcccaaatccacagaaagaattaaaggagtcagcatttggtaacaggaaaagaatgaactctataggcagatggaagcctgggattctgacactgtcgcaagttagtatgatgttgagcatcagtttttttcacctgcaagacggggtgggaagggaagtagcacttgttgatcaccttttgggaatgatgattcccttgaattcactggatggctctcaggattggatgacagagtacagtgcttggtttcccgtctgtcctcaacagatatttatttcctgtcccctcctctcctcaccttgggtaactggtattagtgttgcaggagcaataaggatacttgaactctgctacaactttgcttaagctcagaaatgtttggagcctcttgaaattgcagccaatggtgtctgccattggctccatgggccttgcagggagaatgaagttgatataccttctggaaaagaaagagcagggaaaaagcaggagctacagtttataaattctgtttctccaacgtggccacaatttgaaatctacactgcatgtttattctgtttgtagcactacatgcatgcaaaactggttgaagacagtttccatgatgaacacaagcattataattgccatgttgatctccataggaattcaagtggaaaaaaggttctttattccaggatgcccatatttggacattgttgcccttgccagacaagagggaatgaccttgttcttaatttaaaaaaaaaatggaaaggtggtggtagtagcctggtagtagccttggttaaaagattatgggttcacacttttctaccaagtggaatctgtctggctattctgaagcatagagacattctatgtcttctgaacataaacaggagagtttgttgaaatacaatattaatatgcactactgagaagattttgatggttcataaaaccctcatgaatcatggatgagagagttactggagtctcacagatcaattaattagatgtacaaagtgtatacatttttcatttgattatattttggtgttgtgttatagatatttggtagataaagtgaatccaagtatttatttaaaaaactacttcaagacgacattggagggtggttagtgagtctgagttgaaggattatgagggccccaaggctggtcctgagtgtgctggttaaaggggtgcacaggcacctgacataacagagctgggagtccagcaactaacaggagagagaaaaggtggcatccttctccctgtgaaagtcgccttaagaaagcttaggctccacttatggcacagagagctaaacatacatcagcttttccctccagggaaatccttcggggtactctgaacacatttctgttggattaacagggcccttagtgagatggtgttaggctgtccagcgactgggatcttccatttctttcagagcaggagacagcaaaatcatggcttttgttatctatctatatatacttattaatgaagacattccaaatgaatgatgacttcctgagctatccttgtggcatgtgcctgtccttgtgtgagtgcttgtgtgtgtgtgtgtgtgtgtgtgtgtgagcaactcacctaaaaagtaggctctagagtaggctctaaagagcttggctgtgccttttgaactgacagatacatatactttatagaactgtgaactttttcacccaataaaacaggggtaatacaagagtcttctaaatctttatgtttcatgtcagtattaccaggaattctgaggccgaagttcattgcttacagggtagttaaataaagatgttaaaggattagctaaaacattatccatgtattatcctagagtcagtggtaatatctactgacaaaagagaagattaacctcagagctttttgctaaacagcaagctgatgctcaagtcacgtttcaacatatttcttttgcaaggaggctcttttatctctatccaaggtgatactaatagacttatggaatacgttttcccggtctccagaagtgtgtcagctttccaatgacgtgttttttccaataattcaactcatcagattcatctggaaacagttgttttgatgccttctgtctttcatgtggtgccctaataaaggctgcagaaggaatatggtttgcagaaagattaaggtgacccaaagatgtattaatgccctgctgatgttcaaacaagccaatggctttttctttggaagtttaggtgttagtagaaggaggcacagaggcttggagttacagaatgtttggcccagaagagcttagagatcccatacccatctcacatttgggagccctctgtggctccccatttaggtggtctccagccatagtttctgcacattcagggcagagaaagctcactacttccccaaggcagtctatttccactgttagaccatgataacacaagaaaagtacttctgagctgagctgaagtgaaatatgcttatgcaacatttggtcctagtcctgctttctaaagcacaaagaataaatctctttcaccctgatgggccacacagtccagatgaatggatggagatattgggtttgactctgctccatcacttaagtagcagagcatgttagaatctctcagaatcttggctttctggtctcttagacgaagatcaggatccccatcacctgggccattgtggagtttgggccaaataatatattttaaccatctatcatggtacttggcacatggcaggcatttattgaatgctcccttcttccttcttcttgggagctcttcaaacacttggaggcagcaagtctattttcctttggttttctcttttcccagccttcatgctgcagatcaaaggaatggaactgaaagtgggggctgggaaatatctaagtcagtgtctcctaaagtgtgggcatcaacaggtggtaagaaaggttatttttagatagcacatgcatgatcattttataatttaaatataaatctatctatctatttaaatgatatatttcatagctgtcctgtattatgtcagggaatactatttttctatatatgctagtgatataaagtctcctttaaaataaggttatttaagaataaaggcaaatcaagtacaacaaaagctgttattattaccttgttgaaaatcaaatgagtttccaagcaaatcaaagtctatttcaaaaatctcattagcaagcagatctgaagaaacgacatggtgtatgactccaactatgtgatattctggaaaaggcaaaactagaaagacagtaaaaagatcaatggttgccaggaacctggaaggaggaagggatgaataggcagagcacaggggatttttagggcagtgaaactactctgtatgatactgtaatggtggatatttttacatattacatttttcaaagcccatagaatgtacaacacaaagaataggtctagtaaactataagatattaatattagctcatcaactgtagcacatgtatcatactaatgcaagatattaataataggagaaacttgagggtatatggacactctttgtactttctgttcagtttttttgtaagcctaatactgcagaaagagtctattaattaaaaaaaattaattagctagacaactttccagcctgattgtttattcactgccatttctccatctgtctcagggacatttcatgtcaaaaaccaaattagtcacctttctctacagaagagtactgctatctagttacttccaattgttaacctctgagatcctcccaaccttagagaatattgtgctcctattcctccttaatttaccaccttaggttcattacgaaatctctctgtccctctactccctccctttactgtctctggaatcccaaaccttcacaatttccacaactattgccatggactgggagctctcatcactccaagcctgggctactctgattgcctcttggatggtcttcttatctttaatttctcctccattccaagatcatccatgaacagctgttaaaatcaggtttgaataccaatttcaccccattccttctttgcttgagaatttgcaaacctctgtttccaaccatccaagtgggtggaatggtcaaagacctggatattacctgtgcccaccaagtcaagacaaggacttggatgagcagctactagctgatccaacaaagataattaacaccgataattatgaccatgtattgaacaccagtagaggatgctgtggttcgtgcccaggatgaggttctcattccctcacccagtggctggcactctcaggtgagcccctctctaggaattgccctcacctgaaggcagccacctcccagggccagcacagacttgatgactggtggatgaggaggaataacggccccatctcctagccatgaagcaagatacttcagaagggtcagctgagcatgagagttcccatgggatgggctgcccctgttgtgactgcatcaaagtttagcttctccccaacttcctcacagcacttgcatcctactgtgccagccaataatctccctgtgcacaaatcccatctgggcatctgctttgtggagaataagccctgcaacagcatccaaagtcagttggactctgagtttgtgctatgtccactgatctacactatcttttgaaaacaggcataataatagctgtctgctgtcaaatactttctcggttccaggtgctctcctaggatattttatttatacaaattctaatcttcacatcaaccctgtgagataggcccgctttccagatgagaatacctaagaattagagaatttggaaatgtacaaaagtggtccagtcaaaaaggttttggggacttagggaaggccagtccgtggcacctgggaggcatgaaatacaagtgacttgacattgaattattcacttcagactcatttacttctccctgcccagggacagatcctaagaggggttaggagggctgggcagtcgttcaacgttccctgcttatctccgttcttcttcccagggatgcatccttattagctcttcttctgactacatgtgagcattccattccaatccagccgctcagcctgctgtccactccctgcagtgcaacccagcccagcccctgccttatgtgcgtgtcgtgttttgtcttctgaaatgctcattcctctgcccatgcccatcatgttcctttcagtttggttaaaaaaggatctccttctgaaaggactttctggtgctatttccagagagacaattcacctccccaagtacttaaacactcattgtagccccagttgttctagcctatttcatatccattagaggtcatgcttagaattcagaccatttcttcttcttctttcttttcttcttccttcttccttctttcttcttctttgttaagcaaatatactcttctctatgtgttaccacttctgtggtgcccgtgtgattttgaagtgtttttcgtatgccattagacctggtcttttctgccagattgactggaactggtagaacatttagcatctgcagctgggaaatcatagaagaaatgcctgaatgttttcctatgtgagtgattcttatctcagccaaagaagaagtaagattttaaatgagccaaaactgttccagaaggcaattctaggagtgagcattgtgtaaaaatctggaaaaataaaaagtttaattgtgacaactggggttttatgtggtaactctctcctctttatgtcgtgttatacccaagaaaatcttaatatctcttcctatatttataatattattgagggtcaaaattacatgatgaaggcgtaactgtgcatggttcctgtggccactgaatccagataaatagatagataaactctatgtccagaaccaaggagtctattttggttgtctattgtctggatccactcattaggctggagaagggttaccagataaaatacaggattcccagttacaagtgaatttccaataaacagcagtataaatgtcaagtatcacatgggctatacttatactgctgtttatctgaatttcaaacgtaaatgggcattctgtatttcacttgctaaatctggcatctgtaagctggcaggtacctggaaagactcctccttccaaggaggaaaccaggtcatgggtgaaggctttagtcagggatagggggaaggaatatttcttagtggcagccaagtaggtcaaagtaatgcatgttgtcccatcaaatgcctttctccctttgaaaaacagaagcaattacaggaaggtgagcctaaccaatgatctgtgaaagtcggaggttgagacagaggtcccacatgtgtacatctagaaaaccagttgggtgatgtggttaggtttggcttttggttatgtggatatcctagcaatattatgagtaagtgaagaaaaatgaggttttggggaatcagaagggcagggctggcttgccagaaggactaactcctgatgggatgtctggttttcttaacatctagtattgaaagttacagggcaaatttggccttggtatgggcaagctatgcaattcaatgagatccaatgtggcaggctggttgtgggagaaaggcttggctcccacagacagcgctggcaagttagggttaagtgtcataactcttgacccagtaggggcctggagaacataaaaggtcatgatgaaagaagatgaaggctggagaagggagttaatgaggacaccagcttaaagctcttggactcctaggcttctcccaacactctaaggatccttctagggaagcctgtttaattctgggtctagcctaggggtggagttgaggcagttcatggcctatctgctttggtcaggctggctcagagtttaggaggtgggaggcccatgagatagaccaaacagtcaagatctgagtagctcacaggaagctagaggaacagctcccaaatcatcttcatttgtgccaggaaggtgtgtggggtagagagtaggcaatgtaccagacaccacatgaaggagtagcagaaacagttggagaggcaagactgattgaaacaggaaagtacaggccaaagaggcagatgagtcatcatataaagatagcactagacgccatagaaggtcttcttcttttgaaaagcagaaacaattatgaaaaggtgcggataggcttttgaaggttgtgtctgatctctggctaggctcacaagcccagcaggagcctgtcctacaaagcctttccctgaggagagcttgcaggttgggcagcctaagccctcgacagaaaagcacatgtttccatgaagtctgaagtctcaaatgattgcatttcatggagtttgccttgtgcaaagtcatagaaacaaatgcaggtgcactgtgggcaccagagctaataaagaagagaatcttgtagacatgaaagagagaaagtaagagagataaaaggagatatgtggaaagagagagagagaaagggaggccataaactttggtggtttttgcctttagtttcacttatgtaggcctttttgactaaaaattctgaagattagtgtttgctataccttcagttaccttatttttcgtttctttctttcttttttttaaattttgctgagacagggtctcattctgtcgcccaggctggagggcagtggcacgatcttggctcactgcagcctcaacttctcaggctcaagtgatcctcccacctctgcttcccgagtagctgagactgcaggtgcatgccaccatgcctgcctaatttttttgtatttgtagagatggggttttgccatgttttccaggctggtctccaactcctgagctcaagagatccacctgcctcggtctcccaaagtgctgggattaccatgcccggccccagttaccttctttttcaatatttaagttaggtattacacaaaaatgtttgcaatgtaattatcaacttctataaggcattccttacttgtttactttgcactaagttgatttatattacagtgttgagaagctcactgtctggatgtggactgtgctgggccctgaacacttgcttgtctaacttctttttttttaacatttaaaaaataagctttattttggagtaatactagatttgcagaagagttgcaaaggtagtacagagaagtctcatatgccccttgcctagtttccccattgttaacatcttaacaataccaagtatatttgtcacaactgagaaactggcttgtctaacttctaaatgtgcttctaaatgcccaggctttcaggagtggagaaatgccctactcaggttgatgttttttcttgctccgggagcctgaactttccacccttggctttggtatccatgtgtggtcccttttccaatggtgttttcctttcttatttgatttttgtatttatcatatctcgatttacattcccaaatgtaaaataaactatttcaaaatgattttttcgtacttctagagttgaaacagaggaaaaaaatgcattgttctggcaaggaaaaatatactaacaggagtaaaataaaaacagtcacttcatattcaaggccaaactctggaatttaatcatctcttataaaaaaataaacaatttttgaaaattacttaattcatcactgattgagcctggaaattagatatcgaggaacaaaaacaataaaactctgttagttagcatgaaaaggccaaagcatgtttagtctaagtgtttaggttaatagacaatcactgtgtgttcactctaaaataagagatcagttgtgaaagagggctctagtgagtgggttaggaaggtacaatacatgagagcactgggctgagagtctacttccagtttctcaggctaattctgctacaaatgctttgtatcctccaaggcaagcaactttatctcaagccctgatgtcttcacttgtaaataagagatagttagagataaagaagtggctcaagatttccccaaattctagattctgattccataacaaaatccaattccctaaacactcaggagtttaattgagtattattggatgattcacttggcagttaggatcttgctgtggaagagggtcaccagtatgaatattcactattgtgatgatgaaatgtataggtgagaattcatggatagttggaggatcaaacacaagatcaatgctttcaaatctgctttatgatgtggcatacatagaaatcaggggtaaacagatgaggatgcctagacctggggcatacttagattctctaaactattcccagttcctccatgggctcatacttagattccctaagctcttcctagatcctccaagggctgagaggattgatttcttaggtaacaacttataacccagtaatggcatagcctagcccaacagtcaggaagctcttgactatggaccagaatttgctctagaatggagagtgacatgtaacacaataaacatgatagctactaaagataacatgcctttatatttttattccttttttttttttgagatggagtctcactctgtcacccaggctagagtgcagtggcgtgatctccgctcaccacaacctctgcctcctgggttcaagtgattctcctgcctcagcctcctgagtagctgagcttacgggcacatgctactgcgcccagctaatttttgtatttttagtagagatggggtttcaccatgttggccaggctggtcttcaactccagacctcaggtcatctgcctgccttggcttcccaaagtgctgggattacaggcatgagctgctgtgcctggcctatattttcattctttagttcttgtaaaaaaaaaattcagaataaatgagagggaacagatgatgtgaagggggtggatagtaaatacagttggtgacacactgattctgagatacctctgaagcatctgaatgtagatattgagactattggtagatcctcagagctggaagtcatgagggaattgtgggctgcagagagttttggaagtcattagcctatatagatgagagttgaagccatggatgaggtttctctgaaagagagaaaatgagaagaagccaaggataaagctcaggggaacactaatatttaaggagctggcaaagagaaggagctagcaaaatctatagggttcatttacagctacttacacagtgatttaaagtcatttcatatgtgaaaaacataagaccaatggatatccacatatagatttgatttgtgttgtgtaaggatatacacaaatgcaggcaaaggaacccacatgctgtggatttgttcactcattcactcattcacagtggatgcattgattctttcaatgaatgtttactgagcacttactgtgttcctggcattattctaaccactagggatagagcagtaagccaaacaggttacgtcccttccctagcggagttttactatggcacataccaccacacacaccactaaatactttagagcttgctctccaagagggagagcagaatgtagacaggctctgtatttttacctctcaagaatcctgtgtcttcctaaaggattgcttgtcatcacaccaactcatagctttggccctggtgctgtatttgacttttattcacttaaaaggttaactggatggctgaattacaggattctagccaaagtgtgctccctagaggattcccagctaatcagtcagctgagctgagctgacgactgtcttccattcctaaggagctgggcatttgcaggctgagctcacactgtgaaggctcagcaagaccttgatctcccttcccaagtcatggctgagtgacagggagcagcaaaggtcatggttcaaatctgaggtggcagattctgaggacaaagcctgcagagatcgctttctattgggaactttctcattttaattccttgtcagaatattccaactccaggccttccaactccaaggaaactgaggcaaaaatctaccttctatcttgttatttcccccagattaatatttttcttaaaattttctcagataattagtagatcagagattttctttattttggggctggtatgttttgggttttcattggctaattagccaacttcatctctagaactttctgtttctatcaatatctatccaaggatgtctctaatctccctggttctttaacgtaattcccatgcatgaagccccccacacccgcttctttctccattgtctggttgagatctagtggaaagcctacatggcagtggagattggaaagtagtctttgggtgaaaatatgctccattatggctaaagtgttggctatgccagtccttttaattaatgaacttaaagtaaccttagactccttcctcttccatcatctgtcatacctaaataattatatatgaattagatttcttaaaatgctatatgtacatgcatgctttagcaagtaacttttaatgcatccctattacagactggaacccaaatttattagcctattctttgacctagtgatgagtgctttcaggatttatcttaccaatagagtcatacatgcaaaataacctatttgaaaaattatttattgtagcattatatgtaatagcaaaatacaggaagtgatttaactgtccatttattggggactgttaataaattatgattcatctctacagtggagtactatgcagctgttaaaaaggaaattatttatatactgatgataatgacctctaaactatactgtaaaatgaaaacagctaaaatttgtgaaaaaagaatacacacgcatacacacatgcatatccaatttcttgtaatatgcacttaatatccctggaagcatacataagaaacatcagtttcctcaggagtggagagttgggtaactgaggaataggagtgggaggggaacttttcactataatatgctatggggacttttgatttttgagccatgtaaattgttacagataaatatacaaataggagctaggcgagatgcctcacacctgtaatctcaacactttggtaggctgagataggcgggttgcctgaatccaggagctcaatactagcctgggcaacatggaaaatccccatctctacaaaaaatatgaaaattagccaggcgtggtggcatgcacccgtagacccagcttttcgtgaggctgaggtggggggatcacttgaacccaggaggttgaagccgtagtgagccttggttgcatcactgcactccagcctggtagacagagtgagaccctgtctcataaataaataaacaaacaaaaacactttaaattttaaaattcttcacctggcatttgaaagcccctcacaatctgcccttgattatattatcaggcatatttctagaatatcacattttcccttgcacaagccgtctgctctgcccaccaagcacctcctgcctcatgtgtgattccatttaggtcctttcaaagccaagttgccaggttctagttccaattctacccaactcgcgttttctggaaactccgcaaaaagcactgtgcctgcagctgcaggctatactctcaacttagccttttctcactttgtattccctgggcatgtaaaatttgttagggcaacatccttgatcttagacccttttgtggagggaaggaaaataaatggggtagaaagagctgacaaaagcttcaaacttcttcagtatctgcttaaaggcccatctccgctaggaaaccaggcctatccattcagccatggagatctcctcccctggctcctataagtctaattatgatgacccataccaccgcccagcaccgaccttatgtagccatacattgacatgtgtgatcatgctgtgtccccccaccaactcaatctatgtctttaccaaatatttaatgaacaccaccatgctaccatgttaccaggtagcaaaagatgaccgagaccccattcctgctgacaatggaactcataggagaatcaaataacaattgtacttgaagaaattgtctctaagatagtgcgacatggaattgagacctctgtgctctgcatggaagacccgagagggctgctaaggggatactgtccttgacatgagtcatgaggatatatatgtatcacttttcaagtggaaacaagcggaaaaagaaaaaggcatttaacaagaaggtgtttcaggagaattccaactaattcagtatggctgaagtacacagcacctgcaaaaaagcaaaggtggtgagggtggatccataggcatgagctaaaacaaattcctcctgtgtgtaggctccttagcagcagagatttttgtgtgtttattgatggatcctgggtgctccatagtgcctggcacagaacaggtactaaatatatatttgttgtataggaaaacaaatcaatgttggaaatggattaataaatgtatgtcaggaccagaagtttggactttgacctaaagggttattgaaggactttagtcagctcaatggctaggtcatacgttcatttcagataagcacgtaatcaactggaaaacaaatgaaagtatataaaggggctcaatgtgaaggcttacagagaacacacagacatcatctctttatacatatatgtaatgtccaataataaaataaatagcaataaaaatttaaaacaccaagtaaaattaaaatgtgcaagatgtacatctttaaaaacaataaaacttaataaaagaataaaaagaagaagacttgactaaataaagggaaacatcatgttcttgggcaggaagtctcatattgtaaagatgtcacgcttccctaaagtaatatataaatgtaatacagtttcaattaaaatcccagtgaggttttgtggtacttgacgaatagcttttaaaattcatttatatgtacaggtgaatgaaaacggccaagaaaaacttgaaaaaccaataaaaatgagaaaggagcttgcttaaccagatcaaaagacaccaaataaatttatggtaactaaaacagtaaggtactagagcaggaacacagaaattgaacagagtcaagtatctaaaaacaaatcttgtgtatagttagcagtggtgatagctcacatttattgagagcttactatgtgcctggcatttttctaagcattttgtgttactcattttattctcataaaaccctctgaagggtgtcttgttattatccccattttatatatgacaaagcacacatagattatgctacatgcctatggtttcagagctggtgagtgacatccaggctgtctgactcaaaagccttcattttcaatcacaataaaatggtctttctgcaggtaaaaagcagaggcattcaaaacataagagacaaatttgactatataaatatttaaggcattgatcctgaaaaaaacagtgttaaatgaaaagcgaaaagctaggaaaatatttgcaaagtacgggaattcttacacatcaataaaatatgaacacctaaatagacaaagtaaacaatcattatgaacaagacaatttatacaagaagaaatgcaaatggccaataaacatataagatgctcaatctcaatggcaatcaaaaaaaagaaaattaaaatgagatgtcatttttctcccatcagaatgataagaattaaaggtaggagcctagggttggcaagaacatggtgggaacagtatcaagccaacaatattggagcttgaggtaaaaggaaaaatcaataatattgattctacctttatttcaaatgttgatattttgttcatcatggacttttcttgcatgaattttgatttaaaaatattgtatcaaaatatttgttttgattactgaggtttgtttatagcacgttaaattttgtgtccaaggaaaagtgcctcactcgtgtcatattagtcccaactctgcatggacagtctgcaaatataaatcaaaatgtttaggtatgcttagccactactagcacagcaattctttttctaggaatttaacctaaaggaataactcatcaagcacacagagataaaagtacagagatgctcgttatggtatgactcgtaagaaaaagttgtaaactatcattaagagattggttaaagtatgatatatttgtacgctagaatactatacaggcattaaaaatgatgtcatagaggtgtgcatatttaaaggaaaagatatccgtgttgcattaaagagtacataaaaaagcaagaatatgtacaatgtgtacaataattccaattatgcaacacacacatgtaactccaaaaaaagtcttaaaaagtaataagtttttattggagtgacatgaaaaagtagcaaaatggaatgtcacacttcacacagtctctcatcgtggcagctattttattttctctcacaaaactcccttttgctaacataccctcttacaattttttgacatatttcaatttccccatggtagcacgtagtgcctcatatgcctgcatttaatctgcccccatgttttcaattctatagctctgcccatcacccaggaggactagtacctttaacacattagccttctttcctacaaggcaggtgtaacagacatttatttttcttaggggaactccttggcttatgagtctgcctccctctatagaagccagactctttttattccagcctccctttccacttgagcatagacatatgacctgggctcagtcaatcagctgcccctgcccaagacttgcaatcagaagctagtgactgaaagcagcaggtgccatgtagaatccagtctggttgtggtggtggcagctgatgccttcagttttcagaagcagcaattgcagggctcccggtggaggcaaccagtgcccagcatctgccgggtcagcagagcaggctcctgtactgcgttcagtggtggggctgttgtgtttcctccagaccagctctgcagtatgactgggacttctctggccatgcagcctccacgcctgggttgctgaccattccagagattctgtgagtgacttcacattctttaacaaatctctttcctgcttaaattaaatgtttgctttccattgttttcaactaagaatcctcactaatacatagttatttttggtactgccatatatatgtgtgtatgtgtgtagaaatctgatttcaacacccattatagcttactctcccaaagaaaaacaagtgtataggttaaatcaagttgatatgcttagggaagcttcattcatctagaactgtatagtcaaatacaatagctactaggcatgcatggctattcaaatttaaattaattaaaagtaaataaaatttaaattcagtttctcagcaactctagccatatttcaagtgttgaaaacccacatgtggctatgggtaccaaaccggacagtgagatttagaacattttcattattgcagaaagttccattggacaggacaatctagagggatcttgagatttcaccagcccacctcactgaaccatcacagagagtgaaaaaccactttgggttacatgcattgcactatctaaccatatcgcagaaattttgtgtcaacagagaagtaaccttgctaactagattagagtgtgttttacttctctatttaaattattcttgttttcttgctctctgcctcccagcctcccattctctttctttccttgccaggactttgaattttttcaggttacttggccatatgctttaagtcttcttgtgatagtatctgccccaccaactttacaggattgctgtgagccaataatataatttgggagggaattttatattcatgattggtctgaaatgagccctgatattagatgattctatgattcaagccatctgactttgagcaaatcactcaactttcctggattcctgtttcctcaccagtcaattgaagaagttgaataagataatttctaagttccattaacaacattaaaaaattattttatatagagccccaaatactttatttatgatctcttcagcagagctgaggagttctgatgcaggtggccaatgatgaggcaggtagagatgacaataatcaagaatgagtcttttttcaggatttgatgggcactagcccattttactagaggcaaaatgaatataaaaggcagaacagcaaagtgaaagcttatactacaacctctttctctcaaatcactcaatggtcatatttttcatgcaccgtagttaatgtttaaatgttcagaagaaattgcaaatacgtgaagtttttaatctctttctttttgagatgcccagcttcatgcttggcaatgcattccttgctacgggaacacagtctacctgaaaatgattccattgttgttctaactaactatatgttcttctaaaaaatgtaaacacatatttcagaggtaacccctttagatcagtgccaggtccatcccagagaaaacctcttgggcctccgcaaagggctttctattcaggaattcaaatacacacgagagtgtcaacctgtctctcttgagtctcctccactacagtttctattaccagattaaaatgttaagctgaagcttcttgagaagcaagggtattctaggtgagaatgtgttcaagtcttgcagattggatagcttagaatatctttttagaactttctatcaggaaaatggacagtccttattgttattagggaattgtgttatgataacaacattcattaagcatttctacgtgttaagcactttatatgcattatagcattcccattttacagatgtagaaacagggatgcagagtggtttggcaactgccttgccttacatctcatagttaatcaatggtgtgaagttgagaggatttgaagcttggagctgctgcaaccatcttgctcctacttccaggtggaaagtgatcacaacacacagaaggaagaagtaaaagaagcgagctgagaaaaatctcatcctgatgcagcaagtgagccctaaaatcagttgtgcctgaagccagctctatccctgcacactgaagctttgacgaatcagtcccaacccttttcacttaagctttgggtgttagttcttctttaatatgtactctcgagaattttacttgatctaaacttgttttatttaatgttaccagtgaaaatatacataaccttatccaagggataagttttaattcaggagtgtgcagaaaaatagttcaaattttttttattgtggttgaatttaaaaccacaccacccccattgtggctcccataagctggctggacatggaggtttgtatgtcacactcaccccctatttcctcattcaggaacctaagccctgaattgcactggagaaataatttactgtggcattttactgaaacatcctgtggatattttaggtatttgcacagagaactttttgacctttgaataatatatgtgctgagaaaggtcttgggatattttaacaacatgttaaactgagatagtcctgatgagatttattttggtctctgttggctgctacgttttttcaaatcctgttggaatttttagtttctatgaggacatttccaagatttttttactgcagcatatttcatgctatttaatggtccctttatcaaagatgacaggcaggcagttgataagctctccagagagtgactcctcataaagcctttcctccgttaatgtgctaggtacattgccaccgactcccatggccacctgagcctccagtagtcccctccaacttgatgtgtcctaaagtgggtgctgggtacttaaaatgaatacacaattttctaacatttaaaaccgctgattaattctctgaaaacataagtgcaggtgatcacaggcataaactggccagtatagccaaaggcatcatgaggattggatcgcttccacaggcagtggacattagatgattctatgattctagccatctgactttgagcaaatcactcaactttcctcgattcctgtttcctcaccagttgattgaggaagcaaatattaattagattaattaattgaagaaataaatatgatcagactttccccaacagccccttggtagaggaggccagaagtaattctgtcagtgcggtatgacagactgcagcttaaacagaggattaattgaaggtgcatgcatttaaaccacaaggtgcatattctcccagaatgcaggatggttcctaggctagggtttggtatctttgaaggacctgtttaaatttctgtgcaagtaggctgccaggaaatacattcctgccccggaggacactttgtctcctacagaaaggaactagcattgtggaaatttgtgggtgagaatgcaataggttgattctaaattatgttaactggattttcttccaaattaataaaagagcatggactggacctgattgctcattgctgagttcctagaaatgatcacttgtttgcatacaacaagcgtgtactaattatttcttgagtgaacaaatgtgctaaagtggtgagcaaatgtcttgaggagacagaagttaccttgcaaaggagacttttggaactgggtgttcaagaatgagtaggggctctcttgatgaaaggaaagaggagtaataggagaaaaagaattgtagtcaaggaaacagaatgcacaagggaatggagacatggatttcaagcttctagtaattcatagcaggaatctataaggaaaatcttgcacaaagttatgaatgacaaaccttcacaataaaagtgcaaacaaaatcccaattcataaatgtcttgctgtgaatattggtcagaagctggactttcgccaaaacataagcattatactaggtcaattacctttgtgaggtgatgaaacatttctagaagttggcagggtcctccgtgctggttttataggctattgcataatgtcaacttattctagaatgttgcctgaggctgcatcactgggattcaaggattggtcaggaacatacattaaccgtctgtgtttgataaagtgggaaattcttctacaattggtctttggctgattgctgtgtttttgccagtagtgtacttctgacagtttggatttggcttaagaaatctaagacaatttttagaaatcaatgtgtcttagaaaccattaaacacatttatctccttttataagtttaggatatgaataagaagagtccttaaggaatgataatcacccttttctcaggccaatgggatgtgttgcaaaagagaatggggataatctccaaagatgttaggctgctgggcacaccagagcatattccctactcaagcaagggtggagatgtctgcaatctttctaaccaacaacatatcttgaatagcgctcatttgccagtggaaaaaaaaaaaggataacataacatcccttatactaattaacaaaccatctggtgcatatttagataactattcctgaagtgctttcctttgctttccaaccggggactgtcaaatgctaaccaaccatcctgaagcatgaattgtgtgaatttcttattaggaaatgcagatgttaaactaattacacctggagtgtatattgacgttaacttatatacatgtatacatacagacacccactgtctatgctgaactactctgaagtaattacagaggagattgtgtcttaattcctgattttttcctaatggttccatctctacctctactgccagcaaataatggaatcaataaggctgcatgaattaaccaacttatactggacatgattttgctcttttctgtgtcaaatgatgcagttgtcaaacttcttatagtagtttagttctcaacaaattcattcgttatcctgttgatctcatcttcctactcttctgaaaatgaagaaaagtaaactgaagaaaaaaactagtcatggctccaataccctaacacaatcaccttttgaatccagtaaaaagaatggtgaactagaatgtttaaactggagtgaaattgtaaattaaaatatgcttttctttgtatagtctgattgcctgattatcttttacctcagtggacattaggggtgagttatgttacatctaatttattaccaatgctattattattaatagtagtatttcttgactataaacaataatttataatttataagtaaatagtattatttatgaaatgctgaacattgtgaaaaattttgtaatataaactggaatagaataagcatgttatactcctacacatgttctcaggtgaggaaatgttgaagttagccatggtgcaggttaatattcatatgtgtggcatgtgcatcaggggagaagagagggtaagatctgtgtcttgttttggcctgagatgcttatgtatgagatgacattggctttgattctgctccagccacagagctggatggggactgtggatggtgccacaaataacgtcctggccagatttcagccaggtctgcgatttgagaagctgggtactttcgtgccttcagcaggagccactttggcaggaaggacaatgagacaggaagaccccaacgagacctgtcttcctcaaagcaaattcaaattacctgcgtcattatgtgcagggctggaaattgtgcaaagaccaatgtacagatcaatggaagtgaaagacattgcacgtaagaatagcattccttccacgtgtacctagctctgtggtttccccaaagctctcaggtatattgcctcagaaggctgggaaggtagtgtgctgtgatgggaatagcaccagctttggagtcaaacagtctgaaagctcagctgtgtcttcactgtgtccctgcatgttcattatttataataacatatccatgacaaggttcctgtgatgattaatgaggtatctttgggggaaaatagcttttatttataattgattgctgtcacctaagaatgggtggatgacagtagttggaagactttttgtttgtttattagattgatgggtggtgggcacgcaaggttagactagttaggaaagagctaaattgtttccactcattcattcaacacatggatatttgggatatagatgaacaaggcagacaaagaccctgatgatacggtgattaccttctagttggggaaagacagataataaagaaatagtcaaatagaaaaaccatataatgcgggtaatgatgagtgctatggagaaaaagaaagtcaggggaggggttagagaatggctgaaatggaaagggtagcagggagaaggtctccctttcaagatgctcagagaagtcctctttctgaggtggtggagcaagttgtgcaaaattcagtgttgaagagtgttcctggcagaggttgctgaggtataaagaccctgcagtgggcatggggtgggtatgtgtgacaaattccccagggagatcaagggatcaggagtagaatgaggcatgcatggtaagaagtgagttctgagaggtagacaggacccagataatattgagaggctcaagttaggggttcagattatattctataggggctgggaagccattgaaatgatttgaaaagaatgattccattaatgtatataagaaaagggcagggatttagaggcctagaaggaagaatgaggaaactagaatgggaaatagagtaatttagatgcatcctggaaaggggttgagggaaaaatatatcccttaccttatcttcccactggcttggtcaaagagggtcgttggggagaagagaagtgacaaaagaacatttgttagattgttcaaagtatggtgtataatgagagctcttgcctctatctctgctacagaatcttcaagaaatctcacactggttaacaatactttagggtgagtagatcctgaatggtgagtgggaggaagtgttgtgtctggcttaatggctaggcagagtgagaacagaggctggaacacacgtggaaataccctggtgtggtacaaagcagagactcaagaagtgtgcctttccccttccgtagtccttacttcgttttcaatctgtgtgtagggccatctccttgtttatggaatgacattcaaccagcctgagttcctttcaaggctgtcagtttataaccctatggcctatggcttttatctcccagacaagggaactctctctaaatgtaatttttccctcaattttaatcacagcatttaatgtaatcatttgggggaatcaatctgaaaatcatcagggattcttttttctttttactgctaccacgaatagtgattgtgcaacagagttggggaaagacttttgtttttgatgttgcaatagcaggaaatagaaagttgctgctgtcagccacttggtcagagttacatttcttttgcaccacaaaagaagacttgtaggagactggaatatggttccaggtaacccaactatacattcaatgatgaatgcaccactgcaaaggagaggtgtggccattgttgagtaatttgatgaaagaacaactaaaacagattctagatgatttaaccttgacttaaagtaagcccgagggggagaccataattataactaacttccatttttcttggcagagtctacagtccattttgttttcatttcatttaaagtattcccactactggattatctccattttagatcaataatcctcttcctccctttgcagtggctttaaatgttttaagaatttgtagtcattttttttttaagctatcctgaggaatcaatctagactatcacttaggaacaagaaatgcatcataactggcatcttgcagctagtataaagagagtaaattacaaattaaatattgaaactaacattgaactgtgctgatagatagccaataggcacatttgtcaatttaaatttaaatgaattacaattaaataatattaaaattcagtcctttatttgtcacatttcaggtgctcaaaacagccacatgtgtctagtgtctaccacattgatgtaatagatatggaatattttcctctttgcagacaattcaattggacagcctgatttaggaattttaatagttggagtcaagagaagagtcctttagagtgtataaagaggcaggagagtctcatcaaacagattccatgacattttaatttcattaaacatgacttcttcagcaacggatccatgtgttagaaccaattagctatcccaaaggaagaaaagtgaagataactttcccacaatttccaatgtgttagtattgcccagattgtaggttactttgcaaaatggccaaaagcatttgcagcacacggaaagagggtccctctgccaaataatcacgaggaccttcccctccctggagaaatagattgaaacctcttcccctccctggagaaatagatccaagcctctccactgccatcttgtcaaacatatttacattgctcaactgacttgggaagaaaacaaatttccagtatgagactctctggtgggccaagctgtttctcaaggagcattgagaaataatagcaactccaaatattaccttgggcaagacaaggcaaatgatatccttaactttgttatccaagcatagttgaaagagtgtcttcttccagttctctgtgtctttgactctggctagaccctcagggcctggctactgccttgcatactagattcatgggtattttcctgaagctcctttgtagctcaagctgggcctgctctccagcaactcaaactcaagtagagcttttggcccaccatcttttatgatctcctagcactgtagggaaggacacactgtgtatatatgcacattcgcacacttgggatacatgctctctgaggggctctgggaggtcatgtttcaaaggcttcctgcatctggggagtctgggttaaaggcagtttcatgggacaaactctcagctcaaatcttgtcctgcagggagctatgagccctgagtccagtaactttaatcttcaatgctatggaattgggtagaaaaagactaaatgaaatgcctgtaatcacacagcaagttaattatggaatcaaaaaatgattttttggctgaaatgtctgttgcatgattaagaagtttcctcttttcattttgcactgctctttataaaggagctttatgtgcccagaggaaaagggaagatggtgtagatactgattttcacttaatagagttcccttgggatgtttgttagttttgtcccaggcattaatggtaggtctgccttcatgcaccttttcatcatgctgataggaggaagagaaacaaaaaagaatccttctttccctgctgcttaagactgtaacttgggtttgccttctgtttgtgtgcaacaggcttgggaagacaggccatctctctcgttctcagatgttaaggactgggaccaaatgagaagaagaaagccaagtaggcgtttctcccatggtagttatctttagtctatgctgaggtcatgtcccagcataagaaagttgcctgcttatgggcttggggccaaattcacactgattcttgaagtctggaaaatcaccaaccattccagcatctaggatcagacttcttcacaggcacaacgacggttaaaatcccctgtgtttttgtcttgcgtttgtatatttatatgtggaaaataggtcccggggaactagtcttgtacaaaaaagtgaattactataaatacatataatttgtgaatatatgcatgtacgtataaacacacactataaaagttttctgtagcgacaatgaacatgagagaaattgatcatttacatttaaattgaataaattgatgatttattggaagacatgttccaagaatggtctaggtgttatgaaagggcttaatcttccaaaccgaaagtgaattcagaccaccactcagtcactattggccaaacaatagtctaagcaagattagttattctttctttagttttagtagaaggccttgacgtagagccatttttgcttcatgactgaaaatatttgactgccattttctttttttacttttatttttatatattttaaaatttaatttatttttaagtttttatgtatttagggggtacaagtgcagatttcttaaatgtatctatcgcgtagtggtgacatctgggcttttagtgtacccatcacgtgaatagtgaacactgtacctaataacaggtgattgtcaaccctcaccccaaccttccactctcccgccatcccaccttttgtagtctccagtgtttattattctggtctgtatttgactgccattttctgaagcctggagaaaagcatctcttcccatgattacagctaacatgtggtgtgaatatgcaacccaagagcaattgacaggaaatagatagccttaaggaactgaatcactaccactgtcgccgtctcttttgtatattagccttggccatgctaatctttaacatcattgggaactagaaagcatttgaaaattgattataaggacagcatagtgtaagatgattttatcgctagggaggcatcatctaggaaagtctttgccaggaagcgttctttctcattctaaatcctaggaggcacaggaggaaagctagggatgagtgctctggatcataaggcaccaaagggatcctggaaacgctatgattacagtggcttccagagatgtggtaggaaaaatgtgagcaccagtggtcagcatgaccaacttacaggtccagcaaactgggtggcctgagtggtcatcacgatgggaaagacatgacccatggatctatttgttctgtgacagcacagttaggactgtgcagtcatgggaggtgactaacaaactcactgactccatggccatgtggccaagggtgaggttcagcttgattgtacaaagtgtcactcactctgctgagtgtgtatttggaagaagaggcaagtgaaatgttagagacagcagcagccactgtaaatggaaatgaagcatgccaggagacctgccacagatgaaaagaagcaagccaggcacacaagaaagaaaggttgaaggaaaacaggacaagggctggaactagggctttgctaattttagctaggtgcatctactgacctcatagtaacagtaattgacagtccaacaagaacaataactagttagcacacagtcaattagttatttttcatcctacattgtttagcaaatatgtaagtagttcactcatagggttccaaggcttgtgctttcaaagaaccaaattaaagaactctgttcaaacattattactaatcttaaaatgggcagttgccatccagtttgaaggttttattccaactgtgttttctcaaaaccatcataacatttgggtgttggaaacaaaagacattaggtggatggacaccaacctgactagcatggctttgatgccttggcatggaaaatctttattgagtcttccagatggcaagaggcacagacaatcattatatatttggcctctaaactgaaagtgttcctggtaccaatattggaaaaaaaagaagtggtactcatttactgagcaccaactatatataatctattgcacttgctatgaatttctttatatactcttatgtttccctcacagtatatctgggaggtagaattactattcctctattaaagataaggaaacagtggtgtaaagtttcaagtgagatcttcaacccactttctcacagttgcccccagagcctgccgctgagaacttacaatttggagaaacgacagctgccaccaggggcttactgattggtgtgctctttttgaagaatgaacagaagtaaaagtcatacagttaggaaaagagaataaaactgtctttattcatagaataatgattgtttaggtaggaaattaagaaatctacaaaaagttactagaaccaataagtgaatttagcaaggtctcaggataaaagatcaatataaaaacgtctatttctatacactagcaatggatgattgaaaaatgacatttaaaaacatttcacttacagaattcctggaaagcattaggatctgaatcatttatcattacggtagtcttctatccagaagaaaaagggagtcaacagagaagagttgctaggaaagtcaaatgtctacattttacttccaaagagttgagaatcctcagactctttacaccatgcccagagatactaaataatttgcccaaatccacacaactagtaagcccaaaaactgggatttgaattttggcatctttgattaaaaaaatgtctagttttttccacagcgcccctgcaattaattaaagtgtttccctgtgtactgcaaatggtggaacaccttatctgctctttattccaagagcccaaaggttcaaaaattgtttccgaactctcagaatttccatttggctcttggttggcattcaaagtccaatagtataataatgctgtctcatatttgaacaatatagtttattaaactttcccatgtattacctcatttggttctcacaataacttgtggataagaaatggttaaaattatctcaattttatagctgatgcatagctagacccagatgaaaatctactttgaaaacatcaactcagaaagagcaccagactttgctgacatagacagggttttgttaattcaagtagttcattgacttagacaacatctaagcattgaaatttatttaagaaagtacaggttgttatattcatttacttaaaccagtactctaaggaagatggggaaacggaagtgtggcctcatgttttagagaatgccatcaattgtaaaaagaaataggaaactcatttttaatatgcctatttaaaaaaaatagatgtcatgactgaaggctttactcatccaaagctgaactattccttggtatataggtgtatagatcactgattcaaaacattcaagagttagaaagggatcttagaggtctcctagttgaacctgctctttcctagttgagggaacagaagctccaggattttcaatgattatttctggtcacaccactaattagtggcagaattggtcttggaatccaattagagccagactccaggccagttctatgatacaccccaagctcaggaatttcttcctcctctttttaatttctatgagacactttcaataataactttgaggtctctagttctgagtggccatgattttgtaatgcaagtgatgctagctcagaaactccatgcctggccctctctagacacccaagggaagggctgcagaacgtgggcaactcccagggcttttgaggccctggagcttcccacccggaacacaaaatacactgtcatgtgtcatcttgctttgtgacttctcatcttaaggtcttgtcaaagctggccacgtaggcctttgaaaatatcatagagttctttgaagtaggttgtttacttttcttgaaacacatctgtgattcatcttatttgcattttaaaatgtaagtgttttggccagcaatttgagggagaagtccaatagaaaatcagtataccagtccaatttgacagctttcatctaatctatcatcactttctattcatttgttcactcattcattcagcaactacctaatgggtatttactacatgccaggtactgttctagctgcttgggaaacagcagtgagcaaagcaaggtcaggaaggtttcattccagggaaaagggacagataataaacaaaggtataaattttttatgtgtcagatgttgatgagtactatagcaaataagtagggtgagtgaggatagggagtgtggtgtggatggtgctgattgggatggttaaaaaggcttctttgctaaggtgacattttgtgtagagacctgatggaagggaagaaacaagccatgtagccatttggggtaacaatttccagacagaggcaacaacaaggactggctcctgaggctaggagactgctcggtatgtccaagaaacagctaaaaaataccaagtggagtgagtgaggtctggaatggtagaagacgaggtctggggaggttgcagggaccaggttttatagggctttatagaataatataaggacttttgccttttctttttagacggagtctcactgtgttgtcaggctggagtgcagtggtgcgatcttggctcactgcaacctccgcctgccgggttcaagcgattctcctgcctcagcctcctgagtagctgggactacaggcgtgtgccaccacacccagctaattttggtatttttggtagagacggggtttcactgtgttggccaggatggtctcaatctcttgacctcgtgatctgcccacctcggcctcccaaagcgctgggattacaggtgtgagccactgcacccggtcagacttttgcttttttaaaaaactagattttttaaattgaggtatgatttacatccaaggaaatgcacagatctcaaatttgttttgaaggtatctggcaattttatactctgcaactatcatgcaaacctagacatagaggattttcatcacctcagaaagtttatttgtgatgctttctagtcaattctccacctgctcccagcccagaggtaaccagtgttctgatttctatcactattctggaactttgtaaaaatgaaattatgcatgcttttgagtctgggtttctttcactcaatggaatgttttagagattcacctgtgttgttgcaaatatccatcgttcattgctgggtagtactccattgtgtaattatatcaccacaagtttattcattttcctgttgatgggtaattagattgtttcttggttttggctattttcaataaagctgccgtgaatattcttgaacaggtcttattgtgcatatacgtttgcatttctcttgggtacatacctaggattgaaactgctgggtcatagggcgacagatgttttaactttatatgaaactgctgaacagttttcccaagcgatggaacaattttatgctcccaccagcaaagtgtaagagcttccattgttccacatgttcactgacatttggttatgtctggtgggtttgtttgtttttgttctaatcattctggacagtgttctgtgtaagaaatatctgtctactccaagatcgtgaaaggattttctcgtagaaacattataggtcttagcatttaggttttagctctaagatccatcttaaattaatttttgtgaatgctgtaaggtggaggaaagaagcagatatccaattccacattatttgtgaaaaacactgtattttcccattgaattgtctcagcagaaggagtttgcttttattccaagtgagaagaaagttgctggggtgtcttaaattttcctcaaggcaataatagttgtcttgcataatagtggtctactttgcatattagatgtttattgcacttttaatacacatgtgcatgcacattgcacacactttgagaacaggaactacatcttgcttttatttttatcctcaacttcagtacctagagcagtgcttggcaaaccataatcaatgaaagaatgaatgaatgaattccagcaaatgacataactttttattttcctgtgtagcctgtggatgtactcatttgtctgtgatgtactcacatgtatgtactcacatgtacaaatgagtacatgtgatgtattcacacacacacacacacacacacacacacacacacacacacacacacacactctcacagccacttgagtcgactgaagagatcagagaagaaaagaagtgaggcagcatttactacaacctaaaagccaagcctcagaagaagtgagagcctggaactatgagccttatgtatgagcagctcttgtacaaaagagaagtgagataaaatgggtcaggagtctaaaagatggcaatcccagtttacctttgcttttatcctactttgatcaaataatgagtacatgtgatgttctctttgtcaaatgtactcatttgtctgtgttctatatggctcccacacatactatgaccatttccacttgaggttgttagtctcagatttatgggtcattgataatgtacatgcaggattatatatttcttatatataccacataaacctatgctggccccttacatggttaacttagctgctatttttgttttcacttctacatgccatatttggggtagagaagattaaaaagcatatgtggacaacacagaaatggcatctggaaagcagccgtgttgcagcactctcaacttcccttgaaaatttccagaaaggctcagaaacaagaaaaaaatctcaccacagccacaaaaagcatgcttgtcagacagcctgttgccaagacccaggagccacctccctgagggaagcagagatagaaggagtggagaaaggcttttatgcctcccctggagttttccatttacagagccccttggtctattccagccagaaagctgagtccccctcccatttttcaaggagctgattccttttaaggcaggcaaaaagctgcttcccattcacccttccttctttctctattcacccaacctccacaactccccaaatccagtaggataaaaaaagggagggatctttttccctcccttgaagcatgtgtaaagcttaactgcatcctgggaagtgtagttccagcacttaggtggatccaagaagtaagatttatggcagaagtattctacatgctgggattgtagcttttcatgcacagggtgttgagtcagcgtctcaaagaatcagacaatgacggttaggagcaataccccacccgtgcagagctgcattagaatttagagttaggttagaagctgcgcaaacacctgttctgcagctgcaggtgtgagatcatcatacaaatggagggccggcattgatgaagccaaccccataccatgtatgactgctgcctcaaagtctcaagaaagctcaccttatttaaatatttatattgaagaagtaagttataggaaagactacttggaatcagtgaaaaaattgttgaagaccccaggatgtctatttcaggaaccaggagaaagtttcaaaaattttcaaaatatcttttgaaatgtaagccttccttaggcaggcaacactttctaccttgcattatggttgtttgtgtgcaacgtcttaatacacataggcatatacatacatctgcctgcacactttgataacaggagacatgtctttcttttatttacattcctaacatcagagcccagcacactgcttggaatgtcataggaactcagtgaatgaataaagaatgaattccagcaaatgacaaaatttgctctttttttcttattgagtatgtggatgttctcatttatctatgttctatttggcctttaagaaaacagaaatggaaaaccacaaggtcataggcatgggagtgggagtgaggtgaaaatgaaaatgtgaaatggataaaatctgactgaaagttaacaactcaagagcagaattaaaattcgtattagagtcaacaaataactgaactaaaccagagaagaactgaataatgattggagaggataaactggaaatctctctcagaatgcagagaaaagggaaaaagctatccatgtgataggagagatattgttagatgtggagggcagagaatggagttccaacctcaaaattataggtattttgagttagtaagaataactgaaacagaaataattataaagactttgaagaaacaattttctgtactaaaacaaagaatatggttgtcatactccaggcaaaatgaataacaatttttttatgacaaagagaaagaaaaatatcttgcagatctcagctgatatcatctagctgcatggcgtgggcaattttcggagcctaattttcttcatctttaaatgggaaagtttccagagagtcactagatccctgctagacgtgactattttatgatttcataaatgtttggaggactagagggtctaagacagcaattgactattttaacatctcatttgagatagaacaagcaaagaacaattgcaagtcctcccaaacaaggctttattgccccttaatataatttgctccagtgcattaactgggattccaggaatgttctaagcaccccagatgttctcatagtaacatcaggacctcacagcctctggcaacactacctgtttttgacttcatgtggagcagaaacctcctgatcacaatgatgtctgtcaaatccagcattaagattttgaacactaggaccctccaacctcccagcagattttggcacacttcttgctctctcctctcttccggaagactctaggactaaggcatcttctccatgagctccctctaagtccatgcatgccctcagtcccaataatttttggcttccagagctccttcttctcagcccaggcaccaagcaacttttcagcatttattcagcatttaaatcaacctcaacagtgaacacagccttcctttttgctcattttcagagcccagcgatttcatagaatggcagggcatcaggtccagatcatttagaccactgccatgaccagcgataggtatggactccacttaaaaataaggctcgtagccgggcatggtggcacaagtctgtcatcctagctactcaggaggctgaggcaggagaattgcttgaacctaggaggcagaggttgtagtcagctgaggtcgtgccactgcactccagcctgggcatcaaagtgagactctgtctcaaaaataaaaaaaaataaaaataaggctcatagttccaggctctcatttcttctgaggcttggcttctaggttggagtgaatgctgcctcacttcttttcttctctgatctcttaagtcgactctagtggctgtcagtgtgtgtgtgtgtgtgtgtgtgtgtgtaggaataggcatgaatttaccagccagaatatacacacacaccctttcctgtcttgtcgtgtcctgttttaggttattcaaaatgttattcagtggccacatttacagcaataataaaaataggcagaagtcatcaacactatgaatagtaaacacatttagaaaaaggtggcagacaataacgacgtctgggaagtgtttcagtggagtctttcctcacatgagcacgcagtggtgtggctgccagaactccctggcttctgtacttgatttacgcaatggtctgggttgccctagttgtaaccatgcagcttggctctgggcttcataaattcagaccccagaatacagtttatttatgttatgactccatccaaaacgttgcaaagaagccaactcccttcatcccattaaaaaggtataatatgtatttttactagcctgcagagcttggcattcagaggtaacaatatgtgctttgttactctgcaggtttgccgtgaagtgtgctgtaatctttgccaggggtgtgctgctctctcccaggagggttcacagcccgggaggaacacttcagactgcttaacgacttgctcgggccttgccttatatggaatttttccttctgcacaagagaatgacaaccacttagagtgacagccagcagggaacagatgacagccaaaaatccactgtgctcttggtcccaggatgtcctatctgacttgaacttttgctgtttaggcttgctctctgataatgaatttgggaatgccaacaggtttggaggaataggagtcacttagaaaagctagccagataactccattttagaaagcatgggggaatgtctttcccattaatcctggtaagttagttaacaagcacagggcacaataggtccccaaataaatggaagaaatggtgcaaaatgcaagctacaaagtaggtgtttgatcatacacattcatattttattatttaatttgattcaatcttagggtcagagctaacagaaataaatatatttattattattattgatcaataattattagaaccataaagaagtgtcctcacactcagagtctagtgtgctagcccagtagagagacaccaatgatatccccaggaggtggaagggaggttggtgtggatctggttcaggcactgctgtaaatgctttagatctactgtctcagtgaatcatcaccacaaccctatgagatagtcctattttatcttcattttgcagatgaggaaactaaggcacagggagactaagaaacttgcccaaagtcacacagctaggtgtggctagatgtggcttctagttggcagcagcctagagttcaaatacaggcagtcttgctctatgaagattttaacaggcacaggtggaagagggcagtgcgtgtggcagagatgtcagcaagaacatgagaaaggcatggagtagagaacagggacatgtccagttggattggagtatgggtaagagggttggaggaaaattacaccataaacacaagctactgccatattgtggagggccatgaatgctgatgtgaatatactgtaataaatattgctaataataaaagccaatatttctatggttttatattgtgtataatatctgtaatagcctagctttgtttttacaggtgcccaaaaaggccaccagcagatggattcactaggctcatttctctttgcccttgtctttcaagtggtttatgtcaggctagcccccaggccaccacgctgattttcagttaaaaagtcactggtattgaggttttttaaaattataaatgccttcttaaacagatgttttactctagaaatgtttgttaaaatatattctattcaatttctagtaatggttagcaaatttgccttgacgttcttggggttcctgtcttggcattcatgcagaatttgatataaaattatatatactcataagaagaaccaaagaaccaaatagttcttcttgccagtcacttggagattacaaaacagcatttctgagtagaaggcataatcaaatatgatttcatgaactgatgcatatatgagttagaggccaagaaatattgaatcatgaagtaaagttcttctcatttctaaaatactgtaactccataatttttttcttttttttttgagacagagtctcactctgtcacccaggttggagtacagtggcatgatctcggctcactgcaacctccacatcccagactcaatggattctcccacctcagcctcccaagtagctgggaatacaggtgctcaccaccaggcctggctaattttttgtatttttggtagagacagggttttggcatgttgcccaggctggtcttgaactcctgagctgaagcgatctgcctgcctcagcctcccaaagtgctgggattacaggcatgagccactgagcccagctggctatatgtccataattttaaagattacaaatgactctatcaaaagttattctgttgacagtttcaacacaatatttaccagttgaaactgatttttatgctcttggaagctggtggccaccttcttatatgtatgtttggtttattctaggatacttagttgattaaccacttggaatgaagtagagttgtgttttcttttttttctttttttaactgtagcagagtgaccaagcatgcaaaggagggagagagaatatgatccatggcaaatgcaaataccccctatactctttccatctggacttggtgaattgggctgcccttctgcagttgagggtacatgaacagcccagtttctcattcccaaaaggacactagggtttgcagggaatgacgcactacaggggttcccaagacagctggggcatcggccttaaacatgaggcgataggagcagctcttgtacagaagaggagtgagataacatgggtcaggagtctaaaagatggcgatcccagtttacctttgcttttattctactttgatcaaataatgtgtgatgctaacatcattgtattggaaatagaatcatgatgcttcctaagttaaatggcagattgcatgtactgtcatgtgtcctatctgtcatgatgctgacagttacacaattttgctctggaaactgggaattacactttgattttggggtagagggtgttatattggcttgctaggctgccataacaaagtaccagagactgggtggcttaaacaacagaaacttttttgctcacaattctggagtctggaaggccaaaatcaaagtgttggcaggattagtttcttctgaggcctctctctttggcttatggatggccatcttctccctgtgtcttcacctggtcctccctctgtgcaaggttatgtcttaatttcctattcttataaagactccagccatattggattaaggcccactctgatgatctcattgtgacttaattgcctctttaaagaccttatctccaaatacagtcacattctgagatactggggataaggacatcaacagatgaattttgggaggacacaattcagcccatatcagatgtgctctcccttagggggttctaagacaactggggcatcagccttaaacatgaggcgatagaagcggctcttgtatttctgtctttagtcccttggtctgcccgttagtccttctagaaggagtccacttgacagatcatgatgcccttcagaagtacccaggtctctcacagtatctagcagggcctccccaggctactccaacagactattgaaattagtcacgcgccccaccatattagaaccactttcctgggcctaggcaagtccctagtgctggggaataatcactggactagtgatcaagagatctcgttcttgtctagattgctgctggcttgctcttgggcaagtctttttctcatctggggctgattttcttacctaagaaatgttgagctttatgatttctgaggttggctatatgtgaattgccctagtaagtgcaaatgtgttttcataggttagaaaaaaaaaaaaagcccaaaaagtattttctgggaattgagagttgtaagcacctacaattctagaatatactttattataaaagttaaaatgttatgcaatcctatagaaaaattcaggaccattttgctgttgtctaaaatcagatgtgtgatctccatcttcttaatttgacagacatttgccacaagtcacttccacaccaggcagagtgctgagcactgtgagaaggatgtgggaattcagaggctaataagttctagtcccctgctcccaaggagttcgttgtcaacctgttttcatcactggatgtttagaagccttggataatatcaaaggtatctatgttggagaccatgggcttcaatttctggctgtcttttggcatttagaacctaaacagctctgggctggtagacatcactgacatgactttattgttcccatgagtgaacatctgcatgagatcaaaagtagtgatttcagtgtcaccaatattgaaaaatacagaaattgaaattgtaggtaaacccctggatggttatagttaaggacagaaagacaaggagtgaaagaaactccgtgaaacaggaaatgccaagaaaagcctatagcttccctgacttgagacaaaggctgttgactagaatctcttgattcttagtccagtgattattttctagcaatagggacttgctcaagcacaggaaattagttccaatatggtgggggcacatggccaatttcaatagcctgttggaatagcctggagatgccctgttgcatactggcatgtttgattccttattgaaaacagataaaatatatacaattgcaaaattcatataattctgcaaaagtaatataatgtaaaggaaaaagaggaaaaaaagttctgctaccatgttaaaaaaatcatgcaatgctaagtatgatacctgaattagaatggtcaagggtggccaaccagtggagacaaaactcatttccttctcatcctcagagctctgccctaggacgtgtgtgtgtgtgtgtgtgtgtgtgtgtgtatgtgtgtgtgtctgtgtgtataccaggatgttagcctgtatgaaatttctgggctagatgaaagagaggggttgggattgaggcaagttctggaaaataatttgtttttttctaaaggtcatgatagctacttggatctagccaattgttaccatgaagaaatttttaaaatgttggcaatcaacttaagacattcttttgtaagatatagtatggtccaaacaaaaccatgccttggtcactaatttgcaatttctgttctacagcatcttccagatctttatggttacattaatgatctgaggcaaaaagtgcaattcaagacaggtttctttcccaatgaagaaatacaagataggacccaatacaggcagagacccttgcattccaccctcacccctgcttctggcttcctaagcaaactgtacaatctacttaagtgcgatgtccatgtgagtctttcaaaatatacctgaatccagccaggcaaccctagattttcagttctgttttgtttgctttcaaatgattttcattcagtattccactcagaaaatgtctaaactgagtggggaactgcggttgagttgggcatatacaaggatatcctcagtttgaatcttccctaaatatccataagggaaaaaaccccactttaataataaattattcaaatgtgcattcgttcttgaaacattttaaggatgtttacattgaaaccagatgcctgctccacagacagcccccgtttctgttgattttacagctctcctgctcacttcagttttctcagtagggtctttgttttactcactagtaaaaagaatgtttcttttgtttgcttttctttgccatccgcgctgaccagactctagagggaactccagccatgctgtgatttggctagcatccccttcatttcactcctaaaagtcatatgtacacataatagtaaatcgtttctgagacctcatgcgcttgggcttttcctagctcgttcttcttccatgtggttggagttttgcagcagtttgagtaacagttcaatcatgctctcaattaaagaagttgagtcagttcatgatacccatctcatagagcaagatgaagctaggatttctagggaatttctggccgttcaaaaatgtcatctgaacccaaagcttttatttctaagctgagctgaatccatcaccgagtaaagagcaggagggagaactcatttgttcaaatgcctgcaggtattggcctgagggaatatggggagaatagctattcccaaggataccctttttctttcttagtggttggccattcaaagtgtagcaagaaccagaaaggtgagctatctaagtctaagaaaaagtaaaagtcataaagataactaagcaaagcttttctactcacactctatttggcctgattggtcctttcatgtattcatttgtttattcaaaaaacatttattgagcacctactatgtattgctaggtctgtgctaggtgctgtagtgcatatctcttggtggaggtggcagaagagtccagaaaattttagtgcggtaacttatatggcgagaaacacataggataatgggacactggagaaaggcattcaatgaagaccagttagagtgaaggtagaatgcaagaagacttctgggaggacgtggagcctgaagtgaccatgagtaggaattagcaagccacagcttttcaaactttcacatgcacaggaatctcctgggaatcttgctatactggtgattttgactcaggtctgggatgggtcctgagagtctgcatttctaaggagctcccatgtgaggccaatgctactttgggtaggaaggagataaatgatgacttgacatgggaaaagagaaagagggattgaagaaaacatttcaggtagagggaatggtgtgtcaaaaagcctagaggtgtaggagcatgtggaatgtttggtaagttgcaaataactcagaatgggagaagcccaaggggatgagggggaatgatgaccttgaatctggaagcagccatcatattatgaaggaccttgaaggtggtgctaaggatttggggctatttcctaagaacaagaggaaaacactgaagagttttatataaaggaatgataagaaccacttcattttgaaaggattactctgattgcgatgcaacagatggactggggaaaatgccacctagaggcaagagaccagtagccgggcaatcttgttcatccagttgagaaaagatgaggtcctgaacataaagagtagcagtgagtagagagaaaaagcaactggctttggaatattacagaggttaaatgatgaggagtactagctggtcaagaagaggagaggcaagttcaagaactgcctgttttctggctttagatgaagttcactccatttcaatcctggtcatagtgtcccgcttcctcaagataatgattggtgaaccaagatgccacttggagtttccaagagaaaataccagagccaggatttgtacccatgacttcttgattcaaagcccatgttcattttaccatactccattgcttctcagtggctttcttaaagccagagaggagaaattcggaagttcccacccaagttgagtcttagagattttactactgagcgctgaagcacaggggagggatcaaggctttagggaatcagagtggctggggtacttagtggttgtttccaaaaccgttccagttctgctctaataatgggggacggggaaaaagagggtgcctccttcctcagtttgccatcttctttttccagcttccaaaagcatactcgaggaaagccattggaaacctgtcaagctgttccctagtactgaaagacagtttgtgacaaaacaggcttttctgcgcccttgggctttctgtgactttctcaagatgtttgcagttgatgatctgcatgcaagcaagccacgttgacagtttctgacctgtttccagcacctttgcaagtgtgtgtggaagaactgttcagattcattttggatgcttttccatatatcatggggaatttgatctatatatctcagagtcacttaaagttaactcatcgaggcagttagagattgtgcctatcgtttactaaattataaaaaggattaactaagactaaaagccatccaagcattggagttcttcacttctttaaagtaattgaattcagctcttaactttttaaaaatcaaggatactacatttttcggatttcaaaaatgatacaagtttattgtagaaagtttgaaaaaaatacagaaaagactaaagaagagaaaagagtaattataatttcactgccccggtataactactgtcaacaccttggcatatgacctttccatcttttaaataaatctgcatatacacaacttttcagtgattgttactgtactctgcacattgcttcctcgcttactgtacattaaaagttttcccttgatttttcctttattagattttattggagtgccaaatacaaaacatgtggcatgaaagataaaacagaaaaagtaccctctaaggtatccaaggtagcttggactcttatttgtaaaatcaagaccagttaagctacttctctaagatcacattagttaggaaatgagcaggactacaaagtagaacttatattaagtccattgttttggttactgtgaatcctataacagaatccaaaagctgagaactagaagtaattttagaaattatcaaattcaacttcttcattctctcttttttgtcttgttatggtaagaacacttaatgggagatctgccctcttcacagattaagcgtagtatacagtgttgttaattatagtcacagtgttctatggcagatctctagaacttatttatcttgcattttgtcattgacttcctccttcccatctgtcttagtcagtttgggctgctacaacaaattgctatagactgagatttctgagacaacagaaattcatttctcacagttgtggaggctgggaagtcctagatcagggtgccagcttggtgagggttctcttcctagttggcagatggccttctggctgcattctcacataactgagaggagaagcaagctctcttgtgtctcttcttatatgggcactaatctcatcatgagggctccaccctcacaacccaattactccccgaaggcctcaactccaaataccattacattagggattagggtttccacatacgaatgttggggaacacaacattcaggccatagcaccatcctaataaatggcaccactatccaaccagttgcacagactccaaacctagtcatcattgctgcctctagttcctcttgccctatagcctgtgtataagcaagttctgctgactctcctgccaacaccaagggctccttagaacctccacctctgccacccgagtctaagccaccatcacctcttagctgcacaaattcattggccttctacctggtttccctgcttcctctctcactcacccatccccactcccacatacgtagcagccacaagtatttttaaaatgtaaaccagaaaatgccacttccctgctcacactcctccaacagcttctcattcaactgaaatccaaattccttatcctgaccaacaaggctctttataactggtcctgccagttcctctttcctcacctcccaccactccccctccattcatgttgttccagccacagtggccttcagactctttctgtaatgtgtccagctggttaccatcctagactattggtctcattgttccctctgcctgaaacctcttctccctcatctttgcatggcgcacaccttgtcatttgagtataggaacatatttcctgacaactctattgaaaacagcccacagccaggtgtggtcgctggtacttgtaaggtgggaagatcatttgaacccagaaatttcaggctgcagtgagctatgatcatgccactgcactccagcctgagcaacagagtgaaaccttgtctctcaaaacaaaaaatagaaaagcaaaataaaatagtccccagcccccacctccacccccttagtatccctttacactgcttaacttttccataatgccctcatgactatgtaacattaaatatttatttatttatttattatatgtgaggagagccttgctagaatgtaaacctgatgaagacttcaaaacccctggaacagtgcttttgcacagagtaatcatcatcaatacatacttggtgaaaaactgtaaaaatggcagcacaatcttttatcacagagatgtaccatgataagcatgcagattcattttgatttttcatcactgcacatgatggtttgatgagcttccttatacataaacccttgttcccatctctagttatgttcattactgatattccaaggggcagaatcacctaaatcaatgggtatatatagttataacacttttgattcacatcaccaaatggttcaccagaagacttgcaccatttatatacatacagataccaacagtatgtaagtctgttcctcaaaccttcactaatgctgagtgtgattgcttttgaaatcctgcccactttgatagtcaaaataacagcgtcacattttgtgtttctttggatatctgtgaaatgaacatttctctcgtgtctgtttgccataggtatttatttgtatgtgaatgtgtgattggacccatgttctactattaatcttcatcttttttcttattgattcataagggctgaactgttgatctgttacatacagatgttgtggatatgttttcctattttgttgtttgccttttgattttgattgtggtgctatcttttatagacatgttcattggcttttggccaattttatcagtttgttcttttaggatatgtcctgttccttttacacccaaaagtcacttttcaccctgaaattaggtgtttactttttatgcttagctctctaatccatgtggagtttatctgagtgccagttgtgggatatggattcaaactgtagttaatttctccccagaagttaaccagatactctatgcactttactggatatcccattatttcaccaccagttggaatttcaagatttatcatatactgattgctttgaatcacttgagattgttttatgcatggttagcttttagtaattctgaccatctttaattttttttgatgagtacatatttatagggcacatgtgatattttgagtacatgtatagaaaacctaatgatcaaatctgggtatttaagaagtctatcacctcaagcatttatagtttctatgttttgggaacatttcaagtcctctttctagctattttgaaatatacaatacattgctgttaaccataagtgacctattctgctattgaacataacgtgttctatctatctgtatgtttgcgcctattcgccaaccactctttatccccacctaccctcatacacacccttcccagcttctagtaaccatcattctaatctctacctccatgagattaacttttttagctcccacgtatgagtgagaaaatgcaagatatgcctttctgtgcctggataattttacttaacataataacctccagttccatcacattgcttcaagagaacatttagtggcaaagaatactttgtaagaatcccatactgtatctccttctttcataccaatgcgtggtttaatatataataaccttgtttgaaataaaagcctttgatgcctggtgcccttaccacttatgaagtaaccatcggtttccaccactaaaagtctcctatggtcacaaagtcctttgtgaaaaaatccaaaggcaaagagagaggcaggtctgccccatacagaagttcaagctgtgcattgcacaactccaaggagtgtctatcacatagcaagttatataaatggtgccccagagtttgatagtccgcaatatgtacagttgtgtgcattgatcatgaagagagaatccatgttcacttcccaattcagccctcaagaaaaccaacacgaggtcttcgacagcttactagatcttagagatcaacttcatcatttacagcaaaacatgccaaggttcaccaaaaatgtataggcttgtctatggtcataagacttagtgatagaaaagggatagatcccagatttctctttttttcattgatttatctatgtaactttttatgtatttcattgatttatctatttcattttttctttactttcaagaaggtaatatattctcatggcccaaaattcaaaatttatatccacaaaaactgctttacccatcctaaccccctcccaaccccactgagagttcccataaacaaaccctaataccagttggtggcatatctttccagggatagtccaagtatatacaagcaaatacagccatacattctccaatcactcccctttttaacctaaatactaacatactgcacactattctgcattttgactttttgatttataatatatcttcatgcttgctccccatcagtgcatgaagagtttttccatcctgtcttaaagagaagttgtgtactattgtatgatatacaacaactcttttaaccctatggatggacattcatttgctattagaaatagtacgacagtgaataatgttgttctcatatcattttgagcatgggtcatctgtaggataaaatttgtggaagtgggattgctgggtcaaagtacatttgtaattttaatagacattgccaaatggttctctataaaggttgttccgttattagctgattttcttatatcatcattaacactgctagcaaacttggtacattttgccagcccaatgcatacaagagagtgcagtttgtgtgtgtgtgtgtgtgtgtgtcaatgtaaagacaaatatttctttaaataataatgtatttgtattattttttgcagtggaattggaaattttctcacagtcctatccagatgtgcaaagaagtggtagtttatttctataagtgacctaatcatccactgtgtacatttgctgtttaatgaaatctcagcttctcccagctttaacatgtattctcatttaaagatttagaaagataaagtaaaagggtggggatcagattctgcccttcctctattctttcctacaatttgagtctcatgttggctcttttgttcatttgtttttaattgactcatgatagttgtacctatttgtggggtataatgtgagatagtgcagctttcatttgcctttctcttattatgagtatgtttaagcatcttttcttgtgtttcaagctatttgtattttctattctgtgagctatttcgttcctttgctcattttcttaaaaaactgagctattggtctttttgcttactaattaatagaaagagaagtaactttttcactagttatattgaaatagaacatcttttcatagtttgagagccagtgtattttctctcctgacctgtctgttggtatagttttcccttctcttcttttggggtgtgaatctttttgttcttgatgtatggagtcatttatgcattatagaacccagatttttggaaccctattcccagcctcttacacttagatgtgatgtatcctcatttcttcattgcacatttcttcatttcatagaatggtagaatgttttgtaagtgtacatgtaaaaattaatcaattccagaatcaccacaaactcagaaaacatggcatcaaaacggtgattctttaaggtgcaagatagtgtgaatcatttagtctccagcaaatgcatccatcataatataagaccttttagaattagaaaaataatcaaacctgtaacaaattttgcaagcaatttataaacaggtgctagaatctaagatattggtgacagtagagaagcaaacaaacaacaacaacaacagcaacaacaacaaaaaccaaccagtgattaattgtaatcttttaggcccattttaaatgcgtcctcctccatgaaatatttcttggtttctctggacggatgttgtttctcttgcctctgaattcccagagaactttgtacctctcttagggaaattatcaatctctgtcttttattatagttagttatgtacatgagtatttccaggagcactgccaatttcctatactgatcatagatttttcctaatgaaaggctcaaaggtcccaaggcaaagtattcttttttgaagtaaggttattgtggtgtaatttatatatggcaaaattcactcttttcaaatgtacagttcaacgtgttttgacaaatgtatacatgcatataattacctccaaaatgaagatacagaacatttccgtcaccacagtgttctcttggtacttctgttgtcaagccaccctcttcaccctcagcccctattgatcactgattcgatttttgcccctatagttttgcctattccagaatgttgtatgaaaagaatcatgcatcctgtagcattttgtgtctatttttactctaaaccgcagtactttaaaattaaacacgggaaataatttactcattgctttgtggaatttaggttaagcagacttgctcaccaaaatcatgccagtagttaggcagtggtcaaaaggaaggaacaaagaggaaaagggagggagaacagaaattgagaaaaacacagaaggaaagtttaatgtttattataatattctttattgtttagaaattattttctatagagcacgtccaacgtctccagcattttgtgtcatcttcacgataactttacaaactgttattattcccattctgcagatgaggacgctgaggttcaagttatttgactgacttgtccccaaacagaaccatagaaaaatgaaaaatcagcattgaataaactctgatttgaaggacattgttttgtggactccttcaggcttcctcttccccaaattctagtaagagagagttaacgagaagagctgtcagctctggaaggaagagcttctcgctttcactcaccattgtaaacccagaaactagcactgtgttagcccactgtataagaggtgttcattaaatattgttaaatgaactcacgaaacaagtatctgtccttcagatccttagagtacaaatgcactcaattttcctccccaagagctccctgggagtttttttcaactgttgcattttttttctcattttttaaagtttccttttttactcaaagtaaaacacaaatgatttctcaattcctgtaactttgtgtcagggcacattatcccaacacatgcattgaaggcgtgtgactgagtaccaccttttggattgtctgtcatttgaataaagaatatggtttatgttcattaaggaccactccagaggtaaccttcagctaatcatttcttatgttcttcatctagaccagtggagtaatgatcaaacataaagtgatctatttgaatgaaaaacaggctatacataaaatggttttaaaatgaaaagaaaatctaatcttatggcattttaagatgctgacaaaccaacagggtatgtggaaaattccatccaaaataatattattgctttcctaaaaccaacctgaatgtttgaaggcagatgaataggtcaggaattataacagtatctattactttgtggattgttgtaatgtctgaaacaaggatagaatttttttttcaattttactttaagtttcgggatacatgtgcagaatgtgcaggtttgttacacaggtgtacatgtgccatggtggtttgctgcaccaatcaacctatcatctaggttttaagccctgcatacattaggtatttgtcctaatactctccctccccttgtcccccacccccaacaggccctggtgtgtgatgttcacctccgtgtgtccacgtgttctcattgttcacctcccacttatgagtggaacatgccgtgtttggttttctgttcctgtattagtttgctgagaatgatggtttccagtttcatccatatccctgcaaaggacatgaactcattcttttttatggctgcatagtattccatggtgtatatgtgccacattttctttatccagtctatcattgatgggcatttttgttggttccaagtctttgctattgtaaatagtgctgcaataaacatacatgtgcatgtatctttataggagaatgatttataatcctttgggtatatacccagtaatgagatagaagacatttatgctgtcaacaaacatatgaaaaaaagctcatcatcactggtcattagagaaatgcgagtcaaaaccacaatgagataccatctcatgccagttagaatggcaatcattaaaaagtcaggaaacaacagatgctggagaggctgtggaaaaataggaatgcttttacactgttggtgggagtgtaaattaattcaaccattgtggaagacagtgtggcgattcctcaaggatctagaaggacagaatttttttttttttaatggtattgtttcatataaacctatgtagttcccaaagaggtcttcaaagtgttttaggtccctgggaagtttttgatcttttgaatttctcattttctttttacataattatgtctccaaaatggctcctcttttggcaataaactttgatcagtggaagactagtgacacctggattctaggtctaagtttccacttttaatttaaatatttgtctatttaacaccctggaactttccaatgaaattccatcctagagtataagaaaagtctttattaatctagatgtgtagggcagtatagatattcacctttaaattaattgatcgattatcctcactgaattgccaccccagacccacagaagggattattggagctggcaatgtcttgaaatggcaatgtccacatggaagtggcattaatacagcagcctttgtgctttgtcattgcaacccaggccaatgtaagtcactcactgtgaggcaggaaaaaaaccctaagttattataaaggggcaaaagctacttttatatacttttcagaagtctcttgccttggagctgagataatgggaaattttaaaaaggaaaataggagaatgacatagacaagtgactttttgccttggcagacatggctttcctaccctccttttatctcaatgcccctccttcccattccccagggggtggaggggaggaaagagatgggaatgctgagaacagaaaccagagtaaacattaggattttagggtcaggaaagagctcaaagatgttaagaccatgtggccagagctggccacatgatcagagccaggcacatgcctatgtggacagagaagccaagagagaccagagggcagcactttcagggagtcaataagggtagagccttttcaaggatataagtggagagagcaaaggactccttgagaagcaggtcccaaaagcagggctagagagttggacaggttaacatatcccgggggtcactgtggcatgaaaaacagaagctgagggaaactcagagggcggagggaccacaaaagcctgaaacccagaaggctggcctcctcctgcccaccatccattgccaggccctattcatcctccccgcctcctcaaatctgcccttttctctccatctccatagagctgagaccacgggctatactaccagactgtcggtaggtaagaccctgccctgcctcctacttgctttgcaaccctaggtcaaatacctaacttctctgtgcctcagtttcttcatctgaaagatgggaatgatactaccatatccagtttaggaactgtttggggtgccaaatgaattgacacctgtgaagcattcacagggtacttaatattagtttcttagctatgttagtttcctagggatgctgtaagacatgaccactcactgggtggcttaaaacaagagaaattcactctctcatagttctgggagtgggaagtctgaaatcaaggtgtcagcagggttggttccttctggaggctctaaggaagaatctgtccttgcttctctcctagcttctggcagctgctggaatttcagagatgcataggccctcaatgtggggtgggagggaagtaggtggaggtccttggctcatggacacattgctccaatctctgcctctgtctccatgtggccttcccctctgggtgtgtgtgtgtgtcttaaatctctttctcttatgaagacattggttattgggtttaggtcccaccttaaattcaggatgatttatctcaatatccttaactaaattacttctgcaaagactctaagtgaagtcacattcacaagtacaaggggtaggacttggacagatcttttggacagccactattcacccaggtacagtcatcatagttattactttcaattcaggctcctattgtctcttgactatactcttataatagtctccttgcctgcagtcttcacacagcaacccattctcagtaaagtatccccagtgagctttccaaaacatcttcctcttttacaccctcaagtggctccctgtcacctgcaggggaacatctgacatgctgaactagacccaacctggagcttatctcatctccccagggccatctcccacccccctccatcttgtacatccttctccaaaacagggtgtctcccagaactctaaacacactgcgctcttttacacctcctggcctttgcacagcttgttctctctgcctatatactacctcccccctagcccccattgagagcctatgcatccttgaagttcagttcttatttcatctcctctgagatgccttcctggacccttctctggcagttcccctagatcccaagaactgcctccttatccttactgattcttgagctcacccctgtcatcaaactgtatcaactgattcccaaagatctattaatgtttctgttgccccttgagagttgcaccttattcaactctgcctcaccgatgccagtgcagtagtggaaggtgttgaatgatgaatgactggtggatggatggatgaatggatggatggacggatggatggatgggatgggatggatggatagatggatgcatgggtagatgaatgaacggataaagggatgaatattttttaaaaaaaagaaaagaaaactctgagtcaggaatcatttggaactacaaggtgaaacctggactaaagctaggaccatctgtgatgagaagacctgagcagttattagtgaggaaggaatgtggatactcaggattcatatctttgtcatataaataatgaacagccatgtatctgaactgccccatagatgatgccaaaagtaactgctgagcaaactcattatagctctgattctttttaatgtctaaagccttaaaataaagaaacccctttgggagtggataaaacgtggttctcacatcttacactttagtatgaattagatttacctggtccataagtttaaaatgtggacacctaagctccacccccagagattctgatgaagtcagtctgaggcaggctcagtgatttgtgaagaggttaaaattgcaaattctggctctgccacatctgtgctatatgaccttaggcagttccttaatttttcatgtcttaagtggagacaatgctagtacttcttcacagaattgtgatgagttaaatactagtaagaagagttcagcacatgtaagtgctcagtaatgttacctgcagtcattgccgtcttcatcaccatcatcatgatcaccatcatcatgatcatgatcatgatcatcatcatcatcatcatcatcatcatcatcatcatcatcaatgacatctgtggtttttaatagtggctgcatagtaaaatcacctgagaaatttacaaatagatcctgatatagttagtctggagtgggcattgggtaagggtataattttagagcaacccgcctttaaaagtctgatgtgcagtcacagttgagacccagccttgatctgtgcttctcaaacttgaattgtgcacagatcactagggcagtttgtaaaaaatgcagattctgattcagaaggtctcagggtgttgataatctgcatttcaaacaagctccaggtaatgctgctgctgctgtcacagaccacagtatgaggcatcaggttttaggggatgagtaaaacctcctgagcctgagatgcaatgcacaacatggtcggggacttggtatcaacccagtgaccaattgtgatggaggccacatggttcctggttatacccaggcctgtcatatgcagagtgtcacatgcctgccttctggaattcccccagctcctcactaatgtcccagggaggagaggcaggcaggctgtcttgggcttctctgataagatatgtcaagtgtacatgcattaccttccctactgtctggggagtcctttcggaaagcacttaaggacatgctatgcactgagcacttagctctttatattgtggagctcagggtcaacgttttgcccataaaagggccacttgtgtaggtcaaactgccgagtcaatgaccctgcccagtgggaatagtattgtcacccctgtttttggcacaaatgatttgagtgttttccaaacatcattaaatgccaaggtccctgaccctaaatgtggttcaggtgtagggactcagaggcccacagctagactgggcaagggaggggtagaagattaaaatgggaatgactgacaggcataggctattaattctcaaaggttggctctgcatcttcttgcagactcattgcgatttcctcaaagcaaggccttcactgcctggttgtgcatcatagagttcacagcattgtgaaatcacccttaaggcaaagctgacagcatctttatttattgtgcatggatttcatgttaacctcatcatccttttgctgcatgttgataaggcagaaatagtgagtcatttaaatagcggattacaaagactctgatgtagtaaatctaccctctaggttttcatttcataaagaatctgtgcattatttatcatcctcatcagcagaataataaaagccaacacagaccttctcatgaaccccataatgtagatattattgtcctcagtttacccaggataaaattgaggcacagagaggttaagtaccttgcccagggctcccccatgccaataaatatggagctgacgttggaacccagagccttgcagtgccagtgctgttagccactgtccccgactccatttgtgagaatgctgctgactggcatttatgagagtgcttagtacctgccagacactgtgcctggggatttacatggattatctacttttaccctcaaaacaccgatatgagttaggcactattaatttcattttctgattgagagagctgatgtgagagaaatgcagtgattttctcaagtttaaactcaccttgtaagcttcaaagctgtgattggaaccctaggggtccatgttccccttgctcatgtgttctggcccctcctcagctgactttggatttttgtcccctcctactgctccctccaaccccagagtgaaggtctcctggctttgtccaaacattagttccatcagggccgccccaccggcctgtgcccaccctaataccacttccttggagtcccttttgccattggagatgatgcattcacaggttccagggattagggcgtgggcatctttggaggctgttgccccatctacccctaccacaccattttgcaggtctctcacatgaatcctgcaggatcttgctggtttccctgcttacatcttcttccctgcctcatccctggcagctggagtgaccttttaaaatgtaaatacattactttgcagtttgcttaacccctcccaaggccgagatctggtggggccaccctctggcctcctctccctgaacccctcccctcgctccctctgccctgacatgactccatcgctggcttcattcggggctgtctgattgtcacttcctcctcccatacctaaaccatcacccccatgccactctctccccttagtgttggcttgcttcagagcattcctaagttacagtgtgcacttctctactcttaatgtctctctcccttccctggattctaggtggaaaaaaggcagctgatctctagcacatgggacaatgcctggttcaaagcgtgggctaatacatttagcaggatggaaggagggaaggtgggatggaaggaaaagagggagagagggagaaaagaaggaaggagaaaggaaggaaggaaggagggagcaaaggcaggtaggtaggaagaaaggaaggaaggaaagaaaaagagggaaggaaggaaagaaaaacagtgaaggaaggaggaagggagggaagacaggcaggaagaaaggtaagaagaaaggaaggaaagaaagaaagaaatggaaggaaagaaggaaggaggaaggaaagtaggagggcaggagggagtaaagcaggcaggcagggagaaaaaaggaaggaaggaaagaaggaaggaaggatgggggagtcagctcagttgattgtccttttaatgtttgttatctgaggccttattccttaggatgacagtccaagtacttaaaaaaaaagtatcccttttgcctctttcaaatgcatattttttattcttaaattttttattgatacataatgtttgtacatatgtatgggatttatgtgatattttgttacatgcataaaatatgtaatgattaagttagggtatgtgaggtatccagcacctcaagcttttatgatttttatgtgttgggaacatttcaagttctctcttttagctattttgaaatatgcaattttttaaataatactgctaaatgttcctgatacttaagtagttccacacagtcacatactacaaacagtaagctcatcacctgatattattacatctgccacttagaagctgtgtgactggaagcactctgtgcctcagttacctcatctgtaaaattcagataataatagtgctactctcataggctgatatgaggtttacattagttaatatatgtaaagcactttgaatgaattcagtaatatagtcagcaccatgtaagtgtgtattaaatttaaaaatagaccaggcaaggtggctcatgcctataatcctagcacttcaggaggccaaggtgggaggattgcttgcacctaagagtttgagaccagcctgggcaacatagtgagaccctatctctatttataataaataaatataaaaacaacttaagttcaagactatcctctccagtcttctattcatacttttatttaatttaaaaagactgttggaaactttcaagtttttacttgcattagtttgtttctgccttatcagaacccataaaaatagtagtttttactgacattagtttgtttctgccttataagaacccataaaaatactagttttttactcctacgaaagtgaaatggcaaaagtgtacctatgcacattatttttcccaccaatggtcatattcttagcaaataaacgtttcctctgtgggctgggggtgttacaatgtttttaaatagtgggattatcaagtttagggttttattggctcagagggcaagtgtgaaatcttgagtctgtctggtgctggggtttgaaacctgatgcccatgtgtcacttgctttattaagtcaccaccttggaagggctgcttcctccttattaatgaaaagcctgctccatttgttttggcttgcaccaacctaacagtgtctttaaatcagcgacagactgttttccttggaagccacagagtccaatagttttggactaagctcagattctggctagaacttccaaactggaagtaaaatgacttcacccaacagtggttggggggaaaagccaggcaggcttttggaaagtggatttttaatattggaggatatttgtgaaggtgcctgatgagatggacctaacagtgtttgagggtgatgtggacaaaccgttttattattctgtttcaacatagtgctatgttttatttaaatgaatttgcaacttggggtcctgaaatctatttttgtttttgtttccacctagaatagaaagcactttcaagcttatcctgggaggcaagaatagattgaaaggataactactgtatgtagatgcaaaggaggtaccttctcggggagatcgggtgaaggctgttctccctagaagaactaaaggctgggtagacatggagtcagaggaagctttggttgggagaaagacagtggcagtaacccaagcccagagaggggattccttggcatttgtgccttttctgtgccatcaacagtgaaaagaactagagaagggcagctctcagagctcagacagccaatggttggctaggtcagaggagctcttgggctgggtcggagttggccagacttcttgtgctcttccattcatacccaaaaggagcttctgggtcttgaagataaaccactttctcttgttcctctcagttgctctgatattctaagacccagagcagatttttttttttaaccaggagtccatgagtcttctaagaatgtccttggaagaattcaaggaattcctgataccccagaaactatacataaaatgctgtatgcatgtgcactgctctgagaaggagtctatagttcttaccagattcttgaaaggattctgtgaactcttctcccctaaagcttagaatcactgttctggatggtaccaaaaaccacacagtagaacactttatacttttgtctcccacctctgataataaatgcagaatttggcatagtcaaaatgttacaaaaggtttgtacagcatcaaaagaccttggattgcaaattttacaggtaagaggcaatgaccaggttagcaaccagtcaagaacattcatgagcaaatgctggtctagtctgaagggccatcttgggtacacttgggcacaactggtgctgggctgaacatgccactcaggagtttttactggaacacaggcatgtagaaacacatctagaaggatataggtgtcaacatccagaaggatacaggtgtcaacagataagattatgctcataattagaaaatagaattcattgagcatctgcaatatgccaggagctttgtatacattatctcatttgtttgtcacaataatcttatgaaatgaatactattgtatttcccattttacagacagcatagcttaaactcagagaagtcaagtacaattctcaaggtcattaagtggtaagaactggaagataaggtcaggtttgtccaatctatgcttcctcccaacttaagtagcttcatcacatgcaaacaatgatcatggtggcttatgggacaccaattaatctgacaagagctccttcgaggctgtgactttataatttttagaattaactgaaagagtggcaagttgagcattcaatttgcaagtcatgctatgtttggaattaggagggataaccccttttccttcccaaagggactgacaagcataccaagagggggtgggatttctggaactctgtgaagttaacaagaagggacttggaaagttagaagaaggagggggagctgcattccaagcatagctcatggtatgagaaagcaccaaatttggaatgggacgaacagatgaagaaggtgtcaagttctctggggaggagtggagggtactagacaccaaatacagggtaaaactctggcaagatgctgtggtgacttatctgagcctaaaacaaaggagaaccatcccagaatcctagaaatctcccttcccccaaatcaatgaagggaagtttcataatgatggacagagtcccagatggaaattgactacctgttctacagaaaggtcttcaattctaacagagaactctctgatcgcaggaaaagctatctcaatttcaatgacttgtccactgacagaaaatagtgtaagaagggctcactctgggggagtgagaagtaaggcattagaggaggaaagatgataactgagtgggaagaaagaaaatcatgaaggaccaacaggaggcacctgggtcgcagcccagggagcattaatgatcctacctccagttttaggggcacaatacttaatccgacccagaaggtggaatgcaacaacctccctctcctcccctcccaccccagaggcattaccgcagcagataaacaactggcatgaccctccaatagaaagcaagatcacctttgcagcagaagtggccctgccagctgcccttcttctttccgtggggacagacactgttttccctggggaggccagagagctgctgagtcttcatttcctgaagggttgggccagatttgggagctcatgggagttatagaactgctttttctaatttacaagttctaaagtcttgttcctggtcacttccttctcaaaagcgaagggcgcagaggctcctgtggaaacaccttcccttgtgaagtctgcacagagtcctcacagagcctctggagtggctaccttccatgtgctggctaccaccgtcttcttccagggaactccacaaggctcctggctcccagtcaagcagccgcctttgtgtctgttctttttccacccccacctccccaagtatgccttctctagtgggataaatttagctctgaatgaatgcagaaagaagaacacattaaagtaaacacagaccaaacagcattcaaatataggtttggcacacacacacaactgacaaaagatccaagtttttctgtttccttctcttctgcttatctctgtttctcccatctcatcctctgactgctacactcttttctgcgtgtatttaagctaattagatatgtagatcagaatgtggggctgttggtcttcaaaccccatgaaggggaaatcactggagtgactgagaaacatcaaggagtgaatgagagccccaggtggtgctggcattttcatttactggcttgatcatcttagaaacccttccaaaaacttgaaagcatattttatcttatgtgttagcacaaccttttctcccggtgcactgagtctacagtggctatagaatgttgcaaggtcgggccgggtgtagtggttcatgcctgtaatcccagcactttgggaggccgaagcgggcggatcacgaggtcaggagatggagaccatcctggctaacacggtgaaaccccatctctactaaaaagacaaaaaattagccgggtgtggtggcgggcgcctgtagtcctagctacttgggaggctaaggccggagaatggcgtgaacctggaaggcagagcttgcagtgagccaagatcgtgccactgcactccagtctgggtgacagagcaagactccatctcaaaaaaaaaagaatgttgcaaagtcttttttttttgatatggggttctcattctctcatccaggttggagtgcagtggcacgatcatgattcactgcagcctcgacctcctgggtttaaatgatcctcctgcctcagcctcctgagtaggtgggactacaaccatatgctgccacacctggctaatttaaatttttttttgtagaggtagggtctcactatgttgcccaggctggtcttgaactcctggcctcaagctatcctcccacttcagcctcccaaagtgctgggattgtgggcatgagtcactgcacctggcctgcaacaccttctaaacatcttcccaccaaccagtcagcatgtccctaagccctacttttgaagtattttatttcactgtagttcttcactctcacagcatttgtagttctcagagcactttctcattcacgaactttaaacttataagaatctaatgggactagttagctatccctgttcccagtttacagatggaaaacctattcccattttacaaatagagaacctcagttcagagcaggcaagtgacttgtacaaagtcacacagcaagtggcagagttaggattaggacctaggattgatactttgtcttatgttcattccactctaccatgagctgctttggggaaaggcagtttgtccgggaggccctggctgggagggtcacacattagtaatgagcaatttttgagactggctaggatccatttagtcaatatatggagggtgtgcaaggggcagttgagacctctgtcattcccaaaggtgtcaggcaggcacagcatccataggtggtaggagctgaagctaggctttcccaatttcattattcattccccagccagcagggtggacaggatttagtaggcaggccaccatccctccactgccaaccccgcaggaaatttctctcttgtcagcagtgctgacttgcagaatgtacacggcattattgaaacatggttaacaatgaaagtgttgatggccacgctaccaaaagggattccaagctgacggagcacatcgtggtcattgtgctaaggtaaaccagactggcccctaagctctctgagaaaccaatgacctgactgtgtctactggcatcagataaccaggctggagtagaacctggccttcccaaagactttctagtttgtagctaattcatagccaaacctagaattgtttctaccacagagcaccttcaatatgtaggcatgtagctctcttcctaatactcaaaaattaagctgttcttcccatattttcctaggatttaatctatctcctcttaaatttttaaattccttcttatttataattgttagattgacccacactaaaagataagactgtagatgtctaagaatcattaaaagcagagtctagtaaaggtgtttctagataataaatgacatagggcagaatcctcttgtttaaaagatggaaaatgagaagtactgactaatgggaggaatgttaagaataccgatagctcaacccttaaaaaaaaaaaagcctacataaaagggtggataaaatgaagtcattcacttaagttggtccatggcatttttcatgaagcaatgattgggttgagtgatcaagattaccatttccagagcacctaccatggccaatcacaagccttttacatctgttaaccttatttattacaacatccctgtgagagggctgagattccaacttgtcttcagagttcctgtcttttctgtgtcatatctacctcctacttcctaatcctacttttcaaaacttttgtcattaacaggactaccactctggaccaacatctgaataacacagtatttaaacttatcagatatgacaacccaatgagactggacatcacatattttcatttccatcttaatgtaaggaaactgtcattctaatctattatgtgatttgtccatactaccacaacaaaataaatgtagaatgatctctaaccatttggctctaattgattcccgtacactctccttatctacccagtttcctctagggactcatgttgatcaactgacattgccaaagctaaccaagagaaaaggaagtcatcacagtgaaatattgatattcatttctagccagatttccaattgctcattttcaatctgctatgtaaagaccttagccactatataccttaagcaacattcagcctagtttatttttcacaatggtgctgttttctgacttctttctatcttcttgctccatggggactccctaaatgaatctatcatttggatcccatggagaaaaatagcatatacttgaaatcccatcaactttcccaaagagctaacaaccacaggagccaagaggaccacaggcaatgttctccttcttttgattctgtgcagctatcacatatgttttaaatgaccatttattttcaaaagatcccaggcaaaaaagaactaacacaaatataaacatttgaggggatcctggcattcctttcaaaattacttttgtccaagggaagcttcaggttgctgggaaatgtcacactcatagctcttgctcaacaagactgacttttactcacacaacgggccttggcaagtcatttcccttttggtatacagagctcttgttttccccacaaaggaattggctatgatcgtttgtgattctcaaaggactcatgttctaaaatagattctgaaatttttattaacaaaacatctattttgcatatctagcattctgtatccttttcgtataatgctttgcaatgaagcatctatcataaaaaccactaaaccgtacagatggtgtttatgcaacacaatttaatgtcccagcaagaactagtgatttgttacatacattatgcatcattgtgatgtatatatccagattttaaatgtttggagggcaaatagtcaccaatatcattgtggcactagactacgattttttttcttaataccaggccatggccaaacatctaatataaaataattatacaatatgtttattaaataaatagcatagtttgggttttaaatgcctgtgtttgtaatgggttcaaagattttaaaatactaaaatttagaaagttgaaagaagtgctggaagaggaaaaaagattttccctctgctccttggccaaccatcaggcagtcatttcatgtgccttcctgtttcacctagggttcttggtcccaagcaacagaaatagattctggctgataggagcagaaaaagaatgaaatgaaattgtattagatagctcacaggagagatggaacgtccaaagaaggaagcttgggcaatgggtacaaccaaaggtgaactaatagcctgaaggaattctctaacatgctcagtctccaaaattcttggcaggcacacatgcctgactgagccgagattgcctgccataccatggcttcagggggatctggggaacaagtgtctgatacctcccagcttctaccacaggatgtggctctgcctctcactatggcttttaatatgggaaatccccaaagatgggaaggagttcacaaattggccagccagaggaaaaaaaaatgtgtatatgaacaagtctgttacacttcctacctggccagaagcattttgaatttcctctcttctttggctttttgtcttacctgctttgataatccgcaacactgaataaacacaagctttttttattgtgggtctcagggcagttaaaaatcacttaggaagtacacactattggtcatgagtctttagtctattcctagtaaattcaattagtacaaaggttctaaacccatccctaactcccacatcaccctgtagaaatttaattctgtacaggtcttcaggagattctgatgcagatttctgattaggaaccatgttttagtctttctcatctttcacagtttctttacaaacgatttctatttttctgaagccccaaccctacgccatcagtcttaatcaatgactctttgttcaattgggaaaaccagtccatctgatgcaaattcacttaacctctctcctgagagttgaactcaaactttcttcttgtctttatccatttcttcctccttccctacttcgttattccttcttcccaaggctaactggctaatgtgatgctcatctgaatgtcctcttgactaattagagactttgactaatattcaccttcctttttgactgtatctttggcctaatttccctgttgtctaatttgctttgacccccaaacatccaagtcttgcctgacctaaaaaccctttccactagaccctgcttcccatgggctatgttcctgttctccaccttcatctttcacatctgaagagctgaaagaagcagtttgtactcatggttgcttctctgatctctcgctcatccccatttttgtttgttttattttcaacattcacttggtagcagtcattcctcacctcttgtaagtgcttccaagctcatcttctggacacaagtcactcatggcttactgacagccctccaatggtctcttcttcatctgcatcccccatgacctttcagaagcatatgaccctgttgaaaacctctttccttctttgtggcttttggtgcaaatccctttgaatttttccttctacttctcggatgatactttatcagtcttctttgctgggctctctcctcttcttgctctgttttctcatcctggctgttctcatttctttagctgtaaccgcaaagtagatgacacttggatgtgtgtccccaaccccgattcttctattcagagttcagatatttccaactgatcacttccaaagggtgcccaggcccttttccttctccatctccccattccatcactccttttaaaaatttattgcggttaaaaatacaaaacttaaaatttaccatttcaaccacttttaagcatatggtttgatgacagtaagtacattcacactgttgtgctcaatcataccttttaaatatctgtatagctgggagtagaaggaccatttctggttcaattgtttattcctggggcctgcttctatctccatatcattggccaagcctggtgcttaatggttaagagcatgggctctggtgagtgtgatctgagtttaaatcccagctctataactgtagctgagtctttcaacctctctggtctcattttcctcatcttagtattctctacaatcactctgctgaagcaataacagctttgtttatttgtgagcaaacccctttaaataacttgtcctgctggggcttgtgctggaaatgaagaaaaaaggatgcatttgaagaaaaggatgggcttagccagaaagtagaagtttctgatatattggagtgggatgtagaatctggcactggcttggatttattaaacaatcagctccacctacacttgttatgaaaaagatgggaaaacaatccatcagtaaacgattttggtgagtgcttccatctttggtcagaggagtaattgttcatcagtgacaggtgaacctctgtgaaaattgaaagggcaatttagttgaaatggaagcatttattcaggaaacaggtgatctgggaaaatttgatgtgcatttttttttttttttttgagacagagtttcactcttgttgcccaggctggagtgcaatgatgtgatctcggctcactgcaacctctgcctcccaggttccagtgattctcctgcctcggcttcccaagtagctgggattacaggtgcctgccaccacgcccggctaattttttgtatttttagtagagaaggggtttcaccatgttggccaggctggtctcgaactcctgaccttaggtgatccacccgccttggcctcccaaagtgctgggattacaggtgtgagccaccgcatctggcctgatgtgtatatcttttaacatgcctttaaatcctatggctctaaagaggccatattagttatttcagtgtttatttcatttgatgaagaaacgtttgcatatgaatgttgggaattctagcaggtcctgcctcaatgtgaagaggcatttttttttgcttttggcattgatctccttttggactgggcctgatccacttcttacatccagtccaggacctgtcacaaaagactcacattagtaccacatggtatcctgttttagtaaagaataggtgaaatattttagtgagtagatcctacttttcctttcagatgcaatgaacagaagaccctgaaaggatttcaatccagaatgtcacaggataataagagcagatgtctgtgatgccctttacaaagcacctttacatactgtctctcattcgtctctaatgacacctatgtgatcctccattttttcagatgaggaaactgaggttcagagtgattaagcgagttgcctgagatttcacagctaacacattgtgaaatctagtctagcacccaggactaaaaactctcggcttcttttaaggccacatatcgcctcaccagaagggtggcctctctggagatataccctaccctcggccgacttgatattgagaacttggtcatcttaagcatgtgggccacttgggcaaggcagcccttcccaaattgtaaatgtccccacgtggagctcaagcgtctggcttgagccagaaggtgccctgaacactcggtggccccagcccccacgtaacagcacgtgctcgggtcccacattcggtcagacgcccctctccactggcatctgcccggtggaggcgccactgcgctctgcctccgccccagcaagcgcgtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccatcacactccaggggcggagcgaggcaccgagacgtcagggcggagaactagcgccgggctagcgcgccctcccggcggctgccggcgtcccacgtcctcggctggcgcggccggcggcggcggcgaccgggagatgcagtgagcggcggcgctggggcgcagccaggcggccgggagggcgggggccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtggggggacgactccaggaatattatgaccgaatgctcaggcatacgttggcttcatagcctggagaaccaagagaagggtgacctgaacggtggctgccatcctctctgcggaagctgtcctcctgttaagtggaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgggaaaatgcacacagacccttccttttttagaagcatttgacatggtctccaaggctctgagaccctctttctcaaacgcctcaaatctgaaatgtcttggagacttcaccactgaagtgagagagatgtttgctggcaatattgaaatgccatggtttgcctattaggtaatctttgaacgtggtgctctgaactcagaaaggttgtttttttcttctttctctttccccctgtgcatgtgtattttgatggtttgtgaagttatttgtggtttctaaagttggtggcaaggcagcatggccagtgtgtcatgaacttgataagaatggtgatattgagttaatggtgccatgtagctggtgggtgttttgtgtgaactggataataggctgctttaactgttgatgcagtggctgttcccattggctgctgctgaaggcttccaacagttgtcacattttctgcctttgcacaaccagctttactggatgcctgaggaacagctgaactccatgaaaggacttgctttccaaacatggagccagtagctgctaacactggggtacccttttccaagtgcggttgagtaatcccagcagaggccaagtcgattttccaagaaagatctaggcaaatctttgggaattctcttgagcatataagaatacacacaaatactcacttgtgcctcttcagttattgaagaattgagtttgtcctgtgtatctggggagctgttgattattctcatgaatgtgcacctaatacagtctgccctccctattcatgggttccatatccacgccttcagtcaatcttggattgaaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagacaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctgtggggggtcagaagcaacatctctgaagtggaatgtgtattaatgacttttttttttttttagacagagtctcactctgtcacccaggctggagtgctgccatgacagctcgctgcatcctgaaaccatcctcccacctcagcctccccagtagctgggattacaggcatgtgccaccatgcccagctaatttttaaattttttgtagagatggggtttcgccatgttgcccaggctggtctggaactcctgacctcatgtgatcctcccacctctgcctcccaaagcactgagtttagagacatgagccactatacttggtctgaacagctcttttttaatcccttccttcaactgactgaaagtcagggccctgcccagcatcactttctctaactgctttagacagaggcagagatatgacttgaggattcattcatccatttgttcagtaggtatttacagattgcctcctctgggaaggtattggcaacactgaaaagttggtgtccccaggtttcagctgcctgaggctgaaacctttatttcaccttttgcacataatttcttgaaggacagatgtcctgatacctaagatgcttgtcacatgaacatctgtggaatatccgcccccaccaacaaaactgaattaaatacttagaaactacagtgctttaatggaatcttccatttggatccaggaactaatcaatgagaaaagatgactcttatcctaatttctgccaaaagaagagcaagtccatctttgacaatgatctctacactcacatgctcctttcttctgtagggatactccccaaactttacatttagaacatggtaaaaagcctctgaaacagcatgagtgagaatggtaatcccagggactaataacaacaattgccatttattgaatattgttcattcagaaaggcacggtgtgaaatactttttgtttttcacctaacgttatttatagtctaatggaagaaatagaaaagcacataagcagttactatccaggagtactatgaaaatgagcatccaggaggaacatgtaaaccaatctcagagttgtgaaacaattccccaaaaagaagacattagagtaagtcctgaaaattgggtaaaataaaatataaaataacatcataaccttcccaattaccaggaggcatttgtttattcgttatttgattattatttattcaggacatttagtgtgagaaagggaaaggcaaaagcatgaagaagttaagtcagtagctaaagacacaaactcagagtgaacactgaaatgcttttcagcatgtattatctcattgaatcctaataagaagcttatgaggtaggcactacagtattactcatattttataggtgaggaggttctagaactggtctaacattaaactgatagtatcaaagccaggatttgaatgctgcccgcagcaggccattggagcctttgctttgactgctgccctgagctgccacccaagatggcggcagcgtctcgcacttttcccatgagcacactgtgcaggtggtctcagcagcctgagtgtgagccacagactgattccattgcaatgggaaagcttgagacaagccaggaggcctacctccttttgagagtctttcaagcctggattcagtgcatagaaatacccaacataaaatttaatggaacgagtaacattcccatggggaagaagctgttgtgtctcagtggaaactaaccttgtgggagggtgctgttatgtctgcacattggagaggaagatagttttctttgggcatgagtgaaaataagtaaatgttatataaattgtcttgggtgaaactcctaagagccacgtggacaaggctcaggctacaccagggaccagcatgagtatgtttatatatgtgcggaaataggaaatgctaatctaacctatgctgttctttagggaattttgtcatttaattagaacccactctgtgaagtaataaaaatgatctttgcatttgtgcagtactttataatttatgaaaaccttgtatatgctaccttcttcctgaggtgtgtagagcaaatcttatacgctttacaggtgagtattcagagctatccaagcttacacagatagaggtggaagagttgtagtaaatcccagcctctcctgactcccaattcttgtattagtccgttttcaccgtgctgataaagacatacccgagactgggtaatttataaggaaaaagaggtttaatggacttatagttccacgtggctggggaggcctcacaatcatggcagaaggtgaaaggcacatctcacatggcaacagactggaaatgagagcttgtgcagggaaactcccctttataaaaccatcagatctcgtgagactgattcactatcacaagaacagcatgggaaagacatgtccccgtgattcaattacctcctaccatgtccctcccacaacacgtgggaattcaagatgagatttgggtggggacacagcaaaaccgtatcacttgtgttagtggtacatccagccttggaagggtgctttgatacgggctgaaactgcaactaagatcctgctggactaaaatcttctggctgggaggagaggagtgagcttggatgtgtctctatggaatatgcccttgttaggatttcactttcggcctctttcattcttgaaattctcaccaaggggtcagctagtgagtttatggctttcatctgattctattctcagtcctgcatagacctgggtatacgctgttggcctaggctggctgtgccgtgggcttacagagaagtgctcattggcttttcgttggattcgcctctccatgccttttcttgcctgggagcattacagccttgagtaccaggcttggagtgtggggccagtggccaaggaggccaccaccctgcttttggtccaggccttttaggccgacctgcacagcatgggcaaaaagtccttgcaatgatttacatactatccagtccagcttcccaaggatccctcagaggggttagagactcaaacccaagccctgtagaaacaggcactgtgattcatgtggggaccatccccatccatgttccttgtggacttgtgttattggtatgcagctgtcagagaactggagaatttaagatcctggtcattcatctgttatcttatatctcagagatgcagatgacaccctgcttctaaaattccatgttaaggcctaaaaaatcatttgcgtggtatattggtgctgaggaagggttcaacttggctgagtctgtgaagctgcccactggataggtgacactttgggcccatgcagggtcattgctgtgtctgggagtgccaaggcaggccttacccagcatgcataagggtcacacacctccctgctacttatttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctatatttctttgggggctactcaatgctttggggtcactgctggcccctttgaactctccacatttcaccactgatcccatttgggaatgttgatgaacttgcttggcagtaagagttggtcattctgtggcatgaaattgactgagacagcagatggacattgatgcacagagacggtggtcccaagggctgtcattgtggtggggtagttaccagcatggattttggtgtcaggaagacctggcgcaagtcctggcctttccgttggtatctgtatgatgtcactgtaccttggtttcctcacctgtaagatggggctaatgatcatacccacttcagtgtcttgttgtgatggttcttttagaggtttcttgggaaatgctcagagacagcatgcattaagcactcacaaactttcctatttataataagcaaaccaacaaatcataacttatgcatctttaaacagaaagtgaacacaaagagtgaaaggagaattttgttagccacagcatttttgtcaaactaggaaattagataaatactaggaaatcagataaatgttgtaactcctgagttttcaatgcatgaagatagtattaataataaaaaatggattatttgtagtaagcaggagtagtaaactcaacaggtcagggggccagcatgcaatgtaaatgagggacacagattgagtcgaaagtattggtccctagagagcagatgccacctctcagttaagatgcagttaatttatgccttgtgagaacgtgggtcttatgttgttacatcaactcattttcaagagaagccagaaatctgatttttaacatgtgagatctcccacttaaaaaagaacagtattaactagtttaaaaactttaaaaagattggcagtcacaacacaattccttttgatcaagaggccgacattttgtgacctttagatatagacagagctttgaactttacaggatgctttccttatgcattgatttatttggatttcataaggatactgtgaagtaagcctatcagcacccctgagatatttcataatgttgtaatatcgggttgcattttcaccagagctttgtgagtttggtgtccagatgtttggatcattggataaatggtgcttatttgcgatatcttttgacattaaatgagcccttgcaaatcactgacattattgaaactcagaatactcacatctagataggtaattgctctctaactcaaccaaaacaaatctaaaccacatcaagtcagcaccttaatttgggaaattcctcttattagaaaagaatctttaagaacctatactcaaggtatgcaaatctgaaatgcaaacctgatatgaagcccaagcctaactcatgtcagtcaggatgtttgagttgatcctgatttattattagcctcaagtaatggacattgtagggagattctgctgggctcaggactcatagtagcagcaactgccatttgaccgatgtttttgtcatatatggtatagaacagtaattctcaaacgttagtgcattaggatcacctggagggttccttaaaacacagattgcaagagcacactcccagagtgtctaattctgtaggtctagggtgatgtggcctgagaatttgtatttctaagaagttcccagctgcaactgctattctggggaacacactttgaaaacgactggtgaagtgtaggagatcaatagtaaaggaagattatgacctgggtcctgatgtgcatcacatgcccattgtgatatgcccaggagtttgtgtggtgtgtatattctgaagaggtgaaatagaataaaaggccaaatttagtcttgattaatgagagccttaaacatagcccagtttggaagtcatgcaagccgggtgcggtggcgcactcccatagtcccagctacttgggaggctgaggtgggaagatcgcttaagcccaggagttcaaggctgcagtgagctatgatcactgccactgcactccagactgggcaagagtgacaccctgtgtaactgtgtccttctcacattacactggctaatcaagaagaggtctttgcttatctcgggaacttgctttaatctatttaaataaagtgagatatctgttggttacttgacaacaccggtttggaaggtttgcccaggattggctgggcaggttgagagagtttgcctgggattgactgactgaaactatgggctacaaaattcccttggggaggccttagaggacacctcagtgagataagaagtcatgcagtagagaagatatccagcaacaccatgacagccccattgagagaggcttgccatacatatgatggtgtatagatgaagacatcaaatagcagatcagcccatcaagcctggtggccccttctccagcctgcaggtgctaattcgcgatgtgattgcttctcacgtgggcaactccaataggatgccaggagaagcagcaactgatgttcatttacttaatgatggttaatattttatgaagccagtctgtgtatatgcaagtatgacttgttattggcatatcaaggacaagtttattcttccaaggatgtcatgcaggcttccctcacttgtctttgtaccatgcattttttgagctaacccttcatttttggaaggattctgcctcaccggatctcttgtatatcttaaaacacaaagcacagaggctgcactgtacaggatgaggcctaagagaacgtggagactgtaggggatgggccacacagcatggcggagtttgtagaggaaaggttgctcataagtgctctgggtttgggagaagaccacacagctgagatctatttctgacaggaaatgccggcaggagcagagggtggtgtggggcagtgcgtgttggagctacagtgcccttggttaattattatctcagtatttctcattagtctcttgttgaattaaaatgctcaaaaggagattattaaatacacacagaaagggagacagactgacagacacagagacaagactacaccctatttacataatgcttgaacatatattaaaaatactttggattactctttgaccctagtatcactgtttctataggatcatataagtttagctagaagaaaagaatagagaatctgtacctttcttttgcataagatcgaaggggaaagaaaagccatgtgaggcccaagataaaagccccagctgtagatgaaaaagctgtgggccagacgtcggaacacatcttcctgtccatcatttcccttgtggaagcctatttcattaccctgcaggcttttaggctctagacagctttgcaataccaaatatcttgaaggcatttgtaaaacctactcttacttttttcctggaaaaaaaaaattatactggtttacttactattctaggtgggtgggatttttcccccctctgctaaattataaccagtcatctaagtattcactttatttttaaattcagggctgaaacttaaaaccttgagggttaccaaaaaatgttattcttaagagaaaaacatgcttgaaaacttaacccctttggtggcaggcaggggattttctttgtctgtgtttgagtgctaatgtcgacaactttgaggccaataaataccaaatggggctctaggatttgggcaactgtgatagtgtgtgtgtcctgcatgtcacatgagaaagagagaggccgggatttaagaaaggtgcctcttggctgggtggcatgaactcagtcagctggctttccccaggcacctgattggccttaaacactgagtttttgtggtgtgacttgacatacatcttgggctgatatcacgtgctgtttctactggggtgggaagtgctttgaaaatgtccttgctccagtggaactgtgagacatatctaaaaagcttaaggctaatatgagtgatgctaaaaggaagtcctgcttatccaggtaagcaaaagcatactctaggatagcagtgctcctgtaacctgcatggcctatttttcttttccaggtggtatgcaggcagtcttgttcatgaacattgatgtctgagcatgtgtgttcaaaattcagtgttgttaatcaaataaaactcaccacaaaacccgaaggatatttaacaatagatgagataggtttggcggagatgggtcagaagacagaggaggtcctggaggcagcagtagaatgtactttccaatcttactggtgactagagataagacactagtagcctgtttactccccatccttatttacactggagtgagaatgatatatgtcagatcagtattggatgcgatgagggagaatgaagagaaaatattgactctgaaaaatacagacaagaggaggcaaagttgaaagtaatgtaaactgcttaatcacctgcctttctctctttccaccgtcatctctttctacttgacatgttcctgcttttgcctctggatggttctatctctcatcccctctcagcctgggtccacagagaaaagcaggaagcagcctggcatggcagtggagggagccttttccagccttcctccagcagaagtgcgccctctcccctatagggagatagggcaccccaggcttcagaaagcaagggaaagatggtacttcatcatgtagcttttcttaaggggttggagggaagggctcccagttccggagagggtccatgtgccagccaccctgctgaatgccttatgttaggggggtgagatctcagatgtgcacaggtaccaggttgacttggctgagcttttgggactgtggtagccaagagagggcagactcctgaggggacagagagtgctcaactccaactgatgggcactgtgtgggaatttgagcccagggtctcctgcttttccaagagaacctggaaatccaattttgaaggaagtctgttgatgtttaaatgctcacaacagtttaaatactgtatgggccaaaccaaacataacacagattttaacacagtgtaggctggatttgttccctgtctcaatgaccctccccctctacccccagcctgggccaccagttttccacgtctgcatgtcacaacctattttatttaattacaaaaccaatagtatgtgggaatgggggctggggggttggtacagtataaagctatgtgagttgtagatacacttatgtatgttgggcaccttggtgggatccataccctataagaaaaccatagtcttgggtcagagtcagggctgctacttaaatcagttccttatccagcatgctggatgaactcatcagttctctgtaagaagtaaaaactacaagcactctttaaaaaaaatgaaaatgaatgaagagaaaaatagacttattaaattctttaatttggaagactgggtctcgctatgttgctcaggttggtcctgaactcttgggctcaagcgatccttccacctcagcttcctaagtagctgggattataggcatgtgccattgctcccagcactaaaattgactttcttgatgtacagctctctcaatttgaacacatgcgtagatttgtgcaatcactggtatactcaggcaacagaacagttccatcacccccaaaagtctcccaggaaggctgattttaaaactctaactggaatctaagtcattctgcttggggctaccttataccctgactttgaagaccctaaaaatcagttgagggtgggagggttgaccagaacatgaaacttgggttcccagccattggtggggaactgtttcataatgagcaccctaccatacctatataacaagtttttgcttcttcctaatacataccttctgctccagcctgggtcgtcttttcactatcccctactagggttgttccatttagcaactaaatgtataggatgcccagtgattccatggggacatatttatattaaaatattatttgttgttgatctgaaattcacatttaacaggacattccatattttatctggcaagcccatcctcttcacattcatgccacattctcatgtaagttcaaaacctactttctctgtgtttcaccaaagggtgaaaatactctttgaaaatactctttgattttattacacttaatcttagccaaaggccaagaagcgattgtatgctttgattttaaatagtagcatgtttatagggagatagggcaagtgttggaaggataagagtgctttctatacacataaatggattttcaagaaatgttttgtgaccaactggttttatcctttccagagaacaagaaatgatctaatatgtgctcaaggaaggaggacaactggatttcagaaattggttcatgttacagcccctcctctaccctttttctctggcctgacctttgaataatataagtctgaaaagactaaacaaagagattgctcaaactggatgagtttaaaaataacattggaatgctagccttcagcaagccatatatcttatactgcactgagcaggacagtgccctgtggtgggtagaagatgagtcacacagtgatcacaaccagatccttcccagcctggatactttggtggagagtggtgtgatggctgatttatttgtcttgtttgtttgttgtttcatttttccattttactagtgtgatttcagaatcacaaggaggcaaggaggaaaattgattttagatagcagcttcagaatgaaaaatgagtggaaattccacttttcggtctagaccagggaccagcaaacaatagcccgtgggccaaattcagcctgcagcctcttttcataaggcctatgagcagtgcctggtttttatatttttacaaatttgaaaaaattcaaaaaaggatcttttatgactcatgagatttgtatgaaattcaaatgtcagcatccataaataaacttttaccagagcataaccatgcccattcatgtatgtgttgtctatggctaagtttgtgctataatggcagaggtgaataattaaaacagagactctatggcctgtaaagccaaaaatatttactatctgaccatttggagaaaaactttgccaacccctgctttctacatggcgtatttcaatggctgtatttgcgatgaaggctccaggagccttttatctaaagaaatcactattgcctcattgcttacagtccagaacaataaagcatctcagacatccttttcactgttttctgggcttaccatgatgagaggttttgtttaccgaagctggcatgtgagttttgccgctgtggaattttctcattatatcctttgctatctaagccaactgcatgttgttgttgttgttgttgttgttttttgaaaaccagaaaatctgatctcttagggttaacagtttggcccatctgaaataagtccatacaattaaaaacatttctttctattgacagggactgagggttgagggaaagcactgcagattttccaggtgtatttttttttttttttgctccctggattttgcctgaaccctcacttttctctttcagggaactttaagcacacttagtgaaagactaaaggtcagagagcacaccagccacattccctgagtccaagcagggagccagagaggagtggtttctggccagccttccctgttcagttacctcatggaacccttgggaccagggccttgatttacaaatagagtggccactaggtaaaagttgcccatggccagtggtagcaggatcgaccctagtgtctctgaatcattaagtacttcctttctgccctcttccatttcttactcaaaaacaccagctacaattttgagtctggtctgcctggaaatttccaaagggactttggtgccttaataaatattttcaaattgctcaaggttttggaagatagcagagccataattgtgaaatcgggttaaagaatgattgctgcagtacttgcgtcggccctgtggccatgctgaagtggacagggttgtggacactcacaattgctcactgcagatggacagcctttgcttttctggtcatacatatgcttgatcctgaaattctctagatgggctacttctgagcagctgcttggagaatgggaagccaaccctatagtgtaaggtttcttaactgaagtaccattaacactttgggatagataattttctgctgtctgtggggccgatcttttgcattataggatgttagtggcatccttggtctctatccattaaatgctagtagcacaccccactcttcattgtgacaatcaagaaggtctccagacattgccaaatatcctttggggaaaaaaataacccctttgaaaatcactgatgtagtataacataaaggttacctgaccaaatgtacttcccattcttttaccattagggatttatccctttaagtcttcactctcatcattagggattaatttctttaaatgtcaaagtcttttttattttctagaatccctcacgacaatattgatttaactaacctgcacgttgtgcacgtgtaccctaaaacttaaagtataataaaaaataaaattaaaaaaatggtaaatccttaagcttgggatggcagatggttttcagctcctatgtgaactctaactgatagaaagtgtccatctatagtgccgccgtgggaagatctttgaagctgcattttaggtgttggagaaaggacattaagacagattagagctgtcttccatgggcaagagatgagggagttggcatacacgtgtaaggaaccttcttacctaacatttctgcggagattcactatagtcaggccttaggctggtgctgtagttcagccttactgctgagccctgtgccagggcactgttcacacaaggtccctgtagccttgtgtatttgttagggcaattttccagcaggttttgaggaaagggcaccttttctagatcacagagtgccatatgggcgagcagaggtgctgtactctgttgatgggaatagaagtcagggaacaaaaagagaggggcaaagaatataacttcctgtctgtctctcctgcctgactgtaaacttcttgaggccaatgactatgtcatattcaccattatctactctccgcctgtcacaacacattttgcatagtgtcaaagcaagtttagtgacttttagcagagttcttgttctgtatcttggactccttagcagtcttgtggaacctatgggtcgcttttcagaatagtgcttaaatgcacaaaataaaatatttaggattaaaaatataaccaatgaaatttatatatagtcagcaaaatattagaaaactgtgatagataatgtgctttgattgattgatgtacagtcagcaaaatattagaaaactgtgatagataacatgggatttgattgatgtacagtcagcaaaatattagaaaagttaaagataacatgcttttttattaagtaaaatctagtggcagttctaatacttactctaattgcaaattattggtgaatgtaagtgatattttgagctgtctccaacaactgtaatgttatataaaaagtctgtgattcctactcctaataaagtcatggtatattagtccaatctcacactgctataaataacttcccctgagactgggtaatttgtaaagggaagaggtttaattgattcacagttctgcatgtctggggaggcctcaggaaacttacaatcatggtggaaggggaagcaggcacatcttacgtggcaacaggtgagagagatcatgtgtgtaggagtaactgtcaaacacttataaaaccatcagatttcatgggaacacactcactatcatgagaacagcatgggagaaactgcccccatgatccaatcacctcccaccaggttctgcccctgacacatggggattatgaggattacaattcaagatgagatgtgggtggggacacagagccaaaccatatcatataggtactaatgatctacctggggcttgtgcttacattcataactgaaggcggtgctaaatgttagctagggggtggtaaaaataacctttagctgggtaccctaaattctgtcttatccccaaacgccctgaattctcacttctttcttttgtaactgggcccctgctctgatggtttcctcctttcctttgcctgatgctacctcttttaccttcttggggttcttccccagcaaatttttctaggttctttcttctgcattcactttccatctctctcagctgggttgtgtcctttggccgctatctaagttctcactccgcttagcatgggaagggaagcttctaggcccagcttggggttaccctgagcttcagaggagagagggaggttggcacatcacagatactcactgaatgctttttgaatggaaacagttgctttgccaacttcaccttttttatcaggggctcttcttggattcttggactgtgtttgagatcagttcactcttgatatctcccctccgcatggaaagcatccacaaatttccagctagagcatgaacttgcaatttggtttgcctagatcctggaagtctacagagttagaatctttcctggttctgaactcagaagcagcagtgagcagtgggactgctgggacctttaccagcaatcacccaccacatgcaccagcttcaagcagctctgcagaagccgtccgtcaccctccccgttgcacaccttggctgtgaaccgccagggcaggggcatgtgtgggaagcaggcggcctgcagattcattattgctacaagtgaatttcataataaacaaacaaaaatgagccatctctagtttagttccctttgagcatataggccatcaggtcccaaaatgttcagagttgggttagtatctgtggctttcaccaggtaaacacatcagtgttcttcctaatttggactgttgtggcttccctagttcttttttcccctagattgttataaaggttctgtattagttttccagggctgttataataaagtgccacaaattgggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgtccaaatttccccttttcataaggacaccaatcatgttggaatagggcctaccctaatgacataagttgatgacttctgaaaggaccctgactcagaaatatcctgaggtactgggggttaggacttcaatatatctttctggggacagggtccttgcatgctgtcagatgatacctgcatctcgcagtgatggtcaagcgtaccctactctgcttctggctatggcagtagaaattgtgtcccaggggaatggctaaggggcctgtaaacaatgggtgccatatgccattaatggctcaaacctctgccttgtctacacactcatgtatcccataaccctctgtctcctgtcaaagccttttatcaggaaaggcatagaaccacatttcacgctaaggcatgagtgttaaacataccctcacctagccagttaaaaacattgggcaaagctgtaaactacatcacaggagttcaaaatgtcaacagagctgcccccagtcctgtctgtgtttttgcttaggacccagtgttgtgtcactactccccattgataataaacaaaacatgcctcatatgttcacagttatttagagtttacagaattctctccttctatcaatttgtttgtgcctgaaggagcaggaaaggtattattttctgcattttatttcagagaaaacagaagctcagctgagtaatttgttcaagatcatccaggctgtggccggagcccacatcatccatgtctctatgtcagctgtctttccactgctccaagccacctgccctgctgccctccgtttcccctccaggtcactgttgtgcggaccatgcaacccgagtctcaaagactcacggatccccttgctgtgctctaggacccagtcctagcacctcctaacctccccaagagggcaaaaagcagcctaggtctggtgagggtggccaaggccagaggattctgttagtatgcagatcaaaggaggagcatgggcaaagtgacaaggtttgtgatggagcagaacagtgtcaggaagtgatgtgaagctcagcgtggctcgtggatgttgagaagtgaggttgatgggcagggggtgctggaccacagaagaccaggtgttccaagtggggcaaagatgtggtctgtgagaggctgagagccactgaagacctgtggtttatcagagactgctgtggtggcagagtggaggcaggatgaggcagggagctgctccaggttcctgactgccggtccctgccagtgctggtacattcctcaaggcttctcagtggctttccattatttccatagaggggtcacctttagttttggggagtttatttttgagatggggtctcactctgttgcccaggctggagtgcagtggcacgaccattactcactgcagtcttgaccacctgcgctcaagtgatcctctcacttcatcctctcatgtagctgagactgtaggcatgcaacacgatgcctggttaatttttttgtattttttgtagagatggggtttcaccatgttcccaggcttgtctcgaactcctgggctcaaacagtccacctgcctcagattcccaaagtgttgggattacaggcatgaaccaccgcgtcggccaccattaggtttttaactgtttaaggcattctttttatactgaaacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactataagcttatttttagggaaagctaagaattcagtcagagccactcggattccctattgcctgccatacagaatgtgctgttggtggagagattgatgggcagaaatcctatgtttatcacctgattgttacccagcacctcccatgtgccagtataaggtttactgatttgaaaagaggatggagatcaacacaaacacacttttaaatcagaggagcatatttcaaggcatttatatttaagaactaattttagggccaaagaactaatattgtaagagcttctgtgattaggtacttaatatatactactgttatggtaagtgtttagcaaatactaccgcatttaatggaaacaataatactctgttagaggaattcttatcactgttttaacagaagaggaactgttaacttgaggaggtttaacgttagcccaagaccgggtagctgagtccagattcaaactcagatctgtctggctccaaacccatgcaaatgacccctccgggtttggcaattaaacgactcacatgttgccaccctttgttcctatgtatcactaattgatcatggaattatttcttgctcagctcagatttgacctcaggatcctttcaacacaatgctacaggtagccactgctcccaactgagcaatggtagtacttgaagtagcgtctacctgtcatcttagctttatctttctctgtatttactcaaaatagaatctttaaatctacaggggtttgttgttgtttatttctacagatgtatttgtaaccttttattgattaaacaattgtaagaaatggagtattcaatacaatttccttttatagtcactggaaactctgcgtgctttaatagaggatcctaactgccttggagggaagaatgacgtcttaggactcaaagccttgatacaggcaactggcttatgtgtcagtgtggtagtgatgagtgggagatggggaatcagcctgaagaactcaagctgtatagcagtaaaactttcaattagcccagtctggttaattacaactggatggtgagttggggttgggggatgtggtgggaaggctaaagaagcaagataacagggtagatttgggggttgcatacatacacaccttcagttgccgtgaaacatttcagctcagcagacagacctgttgtcctaaaagtatagcaccatgtggggctgtgggtccctccagggagaaaggagttccttaaaagcaaactcagacaagagaatggggaagatacccccagggatagtggtgaagggagaacctagaacccagccttgcaggaggatgaggtagaaattggtccaggaggaagtctatggacaatatctaaaactggagcatcaagaaatagtaatagaaatatgttgcttagaaaggtggattccagatgattgagctgaaatggagttggacagtcacaatgtatggaaggtagtgcaggtgcatcaccaacacagattcattcgataaaattaaaatgtttttgttttactttcaaaaaaataaatagcaaaaaagcaagctcaggccagtggtggctggtggcctgtcagcatggagcatggaccttagccacaggccagggctttaaagccaggactccaggacctgggatgggtcattctgaaagctgattatcagaatgctcaggccagagctgggccagctgcccaggtgttgatatgtgtgtgtgtgtgtgtgtgtttgtgtgtgtgtgtgaagggctgagaactgcatctactaacatactccttgtgtgatgttagggttagtgaattgacctacagtggtacttggcctgcaggaaggggataaaaatgggcatcatggtaagaagttgggccagcaagcagctctagtctcacaaagccttttcctggactaatgagagggaccatggggaggggtgatccccccaaaatcaaccagatcaagttcctgatgaatgggcaatttatgactgaccagctggacacaaaatgccattgaacaacccaaatgaacaacacttctcagtcaaaatgctgctttggagagtctgtgtatgcaaatatacctcatatattcttctcactgtgggatggagcaagaaggccctgagcgtgtttctctaaaaatgcatagcaataatcctagtcttaattttagcctcttctgggcatctgaaatggggttgctacagttaaaataatgctgtataactaacatgatattgggtattgaggtcagagcagggctggcttcatcagcacgtgatttctgtagtcacataggttccccactttgttaaatgctccatagccatattgaaattcttaataacttttggaccaggagccctgcattttcattttgccctgggccctacaaattatgtagccagcagtgggttgtcataccccagagtcccagacaccagccagacatttgctgtgttgaaattatataggggaaaaatataatttagagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggaaaaaaaaagaaacactaacacattaaaatgtacacattaactgtaagatgcattgctatttcagtaacattataatgcgagaggaaacacaatagcatatcttagaattgacgaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggccatcctgaaagtccccaccttctcccaggtagctccagagaaagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatagaagttagttgttttcccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttatttacccctaccgagttttctaaatcagtgaatcagtattttaaggaataaatcttaggcacataaaatgataggaataaaatatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgggcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagcggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaaaggaaatttcacaaaggcttttacattcgtgtaatccagatgagaaatgaagatagggggcgagcaacaaagttgaaagacccaaattgattccggaaggacttgccaagtttctataatgcctcattagctgcttatgtggcagggagacctgggaagagcaataactcttttctaggttctcaggttagggaatgagattttgacgtggccaatatgatcttatatgtccatttatgtcttttaccttatcattttcttttaccttatcatggacagagtggccccccagaagcacaggatgcaagacaacacacatttcagtggctgctccttctgcatacatcattgagctctgccaagggtttgaacacacacacacgtaaataaaggcctaattatgtgtgtgtgtgtatgtgtgtgtgtgtgtgtgtgtgtgtgtgtattatatgtattaagctctttttcctttctccatagcactgcatatacaaagatcagccaccctgagttgaaataaactgtcatgatctgtttggcattgtgagatcaccactcatcataaaataagctttttaaaatgttaaaattgaagtgagagcatgagcacaaagaaacaaggaccagaaggtgtttataatcatgaaaaattgggaacaattcaataggaaaacaggaaaatggttaaatatgatatgttcggagtatggaatatgatgcagcagttacaagtagtaaaatagatcagtatgtactgacatgaagaaaatagacttacacataccttatgtaaaggaggtgaggaaaaggaacaatggtcttttctgtattattagaatttgaatatcaaaattggattcatatattacttatataattaaaaaattaagttagtcagacttagaactctttgaaatctaatttttgaaagttaatttatgccatctggaggcaaacatgccaatgtgattgaagtttcagtggtaacctgaatcctcagtctcgttgcacatttactctgaagacattctcaaaagagaattggagaggaaatccacccagtgtgtcccctcatgtatgtctgtctgggatgctccagtggtgagatgccgtcacctcagtccattgtgttagtttattgcaatgttctagggttcagtctcagccccattcctgccaactgttagcttaaggcccttgggcaaaggagataaaattgttcagggccaacagatctcagagtttcttggaaccttaaaaggagatgacccaaacatttcttattcaagatgccaccagctccagtcactcacagtgacttgccacaggggctggtgatgttagctgcttccttggcgtctgagttctggcttgtgagcagatcttatgcccaatacatcagaaactccatgtctccttcagttgtagtcgttgggagaatccatgggttgactggagcctaaggaaagcaccaaaaagtcactagaggcactggagtggatatgaccttttcctttgaacagcagtttgcacaacatataccggtggctttgtagatctggttttcattaccatttctgtcctggggcagccatggaagccacctggatatttcaattagtgcagcaagctggaattcatttactttagagtctactgcctgaagcttctcccagctgggcacccaactacgcccaggaacttctagatataacacagcatcctgatttcagtctaataagtagatctattttagtcttctcaatttccagtcattttgaaagtgctcccctgtccccataccaggcatgggttccattcccaacttctatcactgtcagtggaggtggcagccttgtgagctgccaggtgggaccaggtgcaacccacagcaaggccacttgatgtctcagtctgtagagtaggtgcttaataattgtctttgacgagttaatgggtgcagcacaccaacatggcgcatgtatacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactatagagcctttgtaactgagctactggggtctacctcatttcagaatccctcagagtccatggtgtatccattcatgcattcattgagcaaatattatgtacctgttctgtgttagagaatatttgaagtggtgggaatatagtggtgagaaaggcatgtttctgccttcaagacatcaccatatgaaagatactctgggatggatggagggtgttaatagaaccccagcaaattgacaaggtggctccccctgtgtcctctggctagtaagggactggtggctccatgaaacagggagctgccctgtgctgcccaaggctccagccctgcttcctcctcatctcccccctggacgtgactctgcctcatggggagcccattctcttagggatctttgtaaactgatcttcttgtgtcaaaaacatcaaatgcctcagattccattgcttataataagcactttgggaccaaaggaattttttgtaatgaaaaaaacagtttttcataagttaatgtttttcctttgagacctggatgcccttctcttattcatccactgcccatgcagctaatcagatttgaagggtaaaataataccagacttatcattgcatgttacatgagaaatgtattagttaggagtctggggttctaaggcatagagacagcatgagctagctcaaggaaaaaggggagggaattgttataagggcacaggggtgccccacagaatcgaaaacagaaatgtgactaggcctaaggaaagcgtcaaaaagtcactagattttttttctctctttcatctctcttcccatcttccccatccatctatccatccatccatccatccatccatccatccatccatctatccatccatctctctttccttctctccttcccagctcctgcctctgtatttcttcctccttttttcttccaactttcatttcaggttcaaggggtatatgtgtgcatttcttatatgggtaaattgcatgtcacggggggttggtgtacagattactttgtcacccaggtaataagcatagtacctgaaggtactttttggacctcacccttttcccaccttctaccctcaagtaagccctggtgtctgttgttcccttctttttgtccatggtatactcagtgtttagctcccacttataaatgagaacatgttgtgttggtttttggttcctgtgttagttcacttaggacaacagcctccagctctatctatgttgctgcaaaggacatgatctcattattttttatggctgtgttgtattccacggtgtatatgtaccacattgatgtccaccattgatgggcatttgggttgattccatgtctttgctgttgtgaacagtgctgtgatgaacatatgtgtgcatgtgtctttatggtagaatgatgtatattcctttgggtagatacccagaaatgggattgctgggtcgaatggtagctctgttttaagttctttgagaaatctccaaactgcttgccatagtccgcctctgtatttcttcctccacctagcttcctctgctttctggtccatgaggtcaatcaaatagggttgccccatagtgtctaagttttcatgtcaccagcccagccacatcagagagactctcgtcagatcagctatggccagaggtcatattgttccatagtggttcctggatgcagattaacttccagcgaaaagggacacattttgagcaggacagacatggccaaagctatctaatatgcccaagtctacacacacagacacatgcccaaatccctctcatggctacacatccaaccagagatggtcaaatggaccctgccctgaacccacatgggaggatatggttctgacttgagctgcaggatcccagggcttgtgttgaggtgggaacagccctggacctgagccagaatactggggctccagtcatggcttcaccattaaacaactctagagtcttaaacaagttcttagcctgtctgagtctttattttctgtataaactgggagtcacagaggcagctttcaattatttaaaggaccactttatgggagggggataggtgtgttacctgtctagtgttggaaggtgaaaccacagtggagaccacagagtggcaatttgtggctggagatacagaagaaccttctcccaatcaggctgccccaccatgttcaacctgcctgccttgcagagagttggctctccctgttactgtgggaaatccaaggggtctcagaaaacatctacagaatggagatactggcccatttcctagcaggattatctgtgtttgtctgggggtgaggggagtaaatagaagtttgagtgctacatacaaatgtgtattttttgcattgtaatcttaacaaacagaaagaagtattttgctccagtttgtatattctttcaaagcctttgaaccacactttatttttttagacaggatctcactctggcgcccaggctggggtgcggtgttgtgatcatggctcactacagcctcaacctcccccagctcaggtgatcctcctgcctcagactcccaagtatctgggactacaggcacataccactatgcctggctgatttttgtatttttgtagagacagggtctcactgtgttgcccaggctggtctcaaactcctaggctcaagtgatcctcccatctctgcctcccaaagccctaggattacaggtgtgagccactgtgcccagctgaagcacactttttagtgtgtctgccacaagggtttccaaggccactagctggcagaaggataaggtggaaatgtaaatgacatgcccctctcttcatgaaaacaatgtcagttgttcctctcagtccccaccataacagtttctgaaattctttctcacctccttcacttatttatcctttctgctccctgctagactgctaggggtggggacaggagtgatgtctgatcaccactgcctctgtgaccataacctctgatactgtcatttcttctttccaaagtcttggctatcatttgaggagctgagacaataggatagttctgctttcacagagcatattagcaaataccctgtgtgaggccctaatgacatatttggccctttccatctttggggctgtaatattccctacagatggaccctttggttaagtctccttatgttgcttttagttttcatcaatctctggttggtttttagaactactaaatggagccattaggtcattcaaaaacaggcagatgtatgtatgtttgtgagccatgatagggatccagaaatatttacataattttcatctattaagagatttaacagctgtgtctgccatgtagttactttaaaatataaaatgcaaggtcagatctcttggggatactgttttgtttttcttttcttatgattgctgttaacgatgtcatgtttaagtaaggaaagaaggttttgatattcctctaagagttaccagcctgtggaggagttgtgctccaagaggatcgaaggcttagaattcaaatgtaaaagtgtttaccttcttaggccagtcatctgatcaacacgtaatgtagctgaattagtacacatttccaaagaatttacgaaacaagacaccttgcaaaactagcagtcaaataaaacagaactctaaaattgaatttaaagtacagttttgtctggctagccatatgtagaaagctgaaactggatcccctccttacaccttatacaaaaattaattcaagatggattaaagacttaaatgttagacctaaaaccataaaaaccctagaagaaaacctaggcaatatctcattcaggacataggcatgggcaaggacttcatgtctaaaacaccaaaagcaatggcaacaaaagccaaaattgacaaatgggatctaattaaactaaagagcttctgcacagcaaaagaaactactatcagagtgaacaggcagcttacagaatgggagaaaatttttgcagcctactcatctgacgaagggctaatatccagaatctacaaagaactcaaacaaatttacaagaaaataacaaacaacccaatcaacaagtgggcgaaggatatgaacagacacttctcaaaagaagacatttatgctgccaaaagacacatgaaaaaatgctcatcatcactggccatcagagaaatgcaaatcaaaaccacaatgagataccatctcacaccagttagaatggcagtcattaaaaagtcagggaacaacaggtgctggagaggatgtgaagaaataggaacacttttacactgttggtgggactgtaaattagttcaaccattgtggaagacagtgtggcgattcctcagggatctagaactagaaataccatttgacccagccatcccattactgggtatatacacaaaggtttataaatcatgctgctataaagacacatgcacacgtatgtttattgtgacactattcacaataggaaagacttggaaccaacccaaatgtccaacaatgatagactggattaagaaaatgtggcacatatgcacaatggaatactatgcagccataaaaaaggatgggttcatgtcctttgtagggacatggatgaagctggaagccatcattctcagcaaactatcgcaaggacaaaaaaccaaacaccacatgttctcactcataggtgggaattgaacaatgagaacacagggacacaggaaggggaacatcacacaccggggcctgttgtgggggtgggggtaggggggagggatagcattaggagatatacctaatgtaaatgatgagttactgggtgcagcacaccaacatggcacatgtatacatatgtaacaaacctgcacgttgtgcacatgtaccctaaaacttaaagtataataaaaataaataaataaataaataaaatacagttttgttttgtatcatgaatattgttgctacttgggaaaaacatgtttaatcaggcactaaaggggcagctgaagtgtttgatggtgattctcaaagggattcttggacccctcaagagttttagaagatagtgatgctagtattttattatgtataattatactgtaaaatacatttttgatacattataattacttctgtttatgacttaggtagtttttgccttgcaaaagggagatagggaaagaaagtttacttaaataattggaagcaaagggggaatgaggagaaagctaatgaagatgtgaatatttgtgaggaaaattgcctgtaagtgtgaatagggtgtgaatggagagtggatgtgtctggcagcacctcttcttattcttatcatcttactggggtgattgaagttgcaaacacatggcccttcacttcttttgtaaacggacataattgatccaacacagcatgattgctttctagtgcagcaattttcagaatactgccttctcaaagatatggttctcctgattgattatgaaatgagataaaaatataagtccttggtttaataagtgatgaacaagcccataaaatactaggtttttacttttgctagagtaatctactaagtgagttattaagggcctttctgaactcaagttagtgtgtcaccatagactctaattagtctgaggactctaattagttctgctaaaaagtctcactgctattcggtgacaaagctcctataatgtggcatgcatgtaggcagttgtagtttccaaaaaagaaagaagtaggtggagcataggatgctcaaagtagacaatgatcaaagacttttgagagtcatcagtctaggaaagttattctcaaccctggctgggtatcagaattgtctgtagtgcttctaagaattatgagttatggccagacgcggtggctcatgactgtaatcccagcactttgggaggccaaggcgggtggattacaaggagtttgagagcagcctccccaatatggtgaaaccccttccctactcaaaatacaaaaattagccaggcatggtggggtatgcctgtagtcccagctactcaggaggctgaggcagaaaaatcgcttgaacctgggaggcagaggttgcagtgagccgggatcgcaccactgcactccagcctgggcgacagagtgagactccgtctaaaaaaagaaaaaaaattatgagttgctggactgcatgatgatctactgaatgagaatccattctccccccagtaaacttttcctttatctcctttatctcattggcaggcactcattcacaggtccactcaagacagtcacggacaaaaggaaacaggattgtgaggatttagccccatggggctagagcactgctactgaaaaaaaaccaccctaactatatttgcagctttacggtgtgtaaaacttcagtttaaaaacaaaagggaaaaaaggtctctgccttcaaagattataagctattcattcaaaaagaccaaacattgtaagaaataactggataattaatccataaagggcaagagaagtagagccagcttttattgagtacctgcctacctgtgtgctgtgtgctgtgtgctgggtgagtactttatatatgtcacttcctttaatcctcattttaatcttcagaggtcagtagtgtcactggcattctacagattaaaatactgtagttgagggaatttaggggatttgaattgcatttcctctctagaatggggtgagacagaagtggtgtccttctttcaggcatctaggtttgtttctttggggtgtgtatgtgtgtatgtttccatgtgtgtggcagcttaccaggctatgtcccaattaataaggagatgtatcatcctcattccagtttttcaaatgtgacttgaccaaaatgcattctattcctattctttgagtttatatgccagaaatggagtgggcatgtgtgtcttctcaggactaatccatgcatgaagctctttgaatcagcacaatattgtacagcctagttgcgttctgttcatcaagcatcggtcgatgatttattgacaatgcaaacaagtggtctgttcatgtgagttcatgatgatttgtgagtgcttcctgcccatctgctctctcattttaagtgtgctctgtaatataaaaatgatagtcatacaataattctattggggtagatctgtaccactacccagagatatttgtttgacttttactattattttacaaaatgggaatttctttcacaaagaagatgagttcattgtactttggctttttgtaagagaaagtgaatgttgtgacactgacatgaataaatgaattcatgttttctgatcccgtggaaaggaaagaatagaataatatcagcacgtggatctcataatgaaaggggagtaaagtgagtcttcagaaacagacttaaaataagctcaattcattgtaattagaaaatggatcttgaaagggccttgccaaaaggcgatgatgtgatgttggggtgtagaagttttttgacagtggactcttttatcacagaatgtgaggtgaggcagaggaaatatgattcatgttatagtgctttagttattgattacataggagtttgctttctccagctcttgttcatagctgctaactggcatacagaggaaatattgtttacttatttaaataatttttaagatagtgaaaattctgtatgtttggttaaattatacttggttgtttgcataggctgtctctccctgagacgctcacctcacttctctatgggtcagcgaaacacataccctgtgtaatcacctcccctataaaaccccatggcaacctcttccaacaattcatcctttgcattccatccaagtatgtcttgttatatccatagcatttagtgcatttattatttcctctcctgctttcctctactagattttgagagccttaaggactagagagtgactgattcatccttgtttccccagcaccctggagcaaagagcccagcacatagtagttgcttgtggtgaatgtaattcagggtgtcttaggactatcctgctcattatgaatagaggataaaaacagatttctaagttctccatctgccataaaattctgggaagaaaaaatatgaagtattcctttctgcacacacagaagtcttccattttgcaattttctatctagtctgctgtcctttctctctcttctttatcagggctacacatcctctctcctggccagagcgtcatttgaggcgtgcttatgcagttctcattgtcttcaattaaggtttgggactgagattaccagcttggcttggtaaccctgttcacttattaaaaaatcagtcgatccttcatttttatgaaaagatgcaatgcaaaataaccttgatttagaatttaatgaggctgacatttaacctgagttcagttaggaagacaaacaaaaaacacagacaaagttgagagaaggaaaataattacctacttgaatagtgtgggcaattctccatccatatgccccaggagaatatgaggtgggagatgcatgaattacctgaaatttcttttagcctctgtttatgattttagtctttcaagatgcaggtatgtttttcaggccttgtggtccccaaacacaaggaaactttctttatctgatggtcaaaagaagtgacgacctagtccttagtaggagaaaaatgtgcctgcatggactctttgtgagacagtgttgttggatactttatgaacattttaagggattctcatgagtaattttgattatagacgatttttactttatgcattgactaggaaccaaatgcaactttcttagagagacacaaaattcattgtccaaatagaccatagggtcagcaggctttgtaaacatgttttgtatgtgcctaggggttgagagcaggggcgggagaggttctggtccgttcatcaaaccaggggctggtgttaatgtttgatcaacaaaacacatgtaggcctaggctctgatctaggtccaactgccaacatagccttttcatgcctgcctttcctacttcaggtagagagaggagaaaaaacctattgaggaaaaaagaaagaataatattagcccaagcagtggttctactcacttaaggagaatggagtatgtttatttaattttaactgaaaagtcctggccaatatttctaagcctggcttgggataacagaatgaatggccttgggggagagggaggagaaagaagatgactgattttagtgtctgctttatggtgtgtgctgtttaatcctcatgacaatcctaagtggaaggaagaactccccatgttaccagtgacgcagcggaagcccaggtgctactgaaggtcacgcagtcagcattgacgaagtctacactagaatccaggcctgacacaacccaaagtctgtattttttccctctgcagtctcttaaaattggcaaaaggtaaaccttcatgcgaccctagatttgattggaacagcagatttaggggtcatgcaacaggagaatgagtggattataagtttttgagtccccagatctttggggagaaaacccaattctgttgaagtaggagctgttcaattggaggtgagatttttagtagggatttctaatgcattcttttttcccattgatggttgttaatacttcccctacacacacacacacacacacacacacacacacacacacacaagcataaatagggcacacgtattctcccatgtaagggctgctgtcccttctccctcccacttatagcgatgtgtgcctctctgtagctgaaggttgccttgtattaggacactgactgatgagtactccccaccagggtccggagagtgtgcttcattcacctttcagcctctcacagttctggcacaggggagataaagatgttgatggtttgaggtgctttttggtaaataacataggcaaacacttgacacccctaggctaccacctgtcctgttgtgtggatacctattcagtgaagccagataacttttacaaatcacaatgaatacatcctcagcagagccagttgcctgagggaggttactgaatcttctgggagtcgtttgcaggcctttagacactgggctcctttctggaccatgcccaaactagtgacagatgcagtcagagtagcagaataaggaagtctaaagtcacccaagcctcttagttcttgataattgacatgtccagcatttcttgaccatcagtagaaaatactaaactttacagtacataaaataatcaattcattcctctgatggggcaactatttaagtcagtatggaactctatctttctgattgctgcattagtccctttttttttgtttattttgcttcttagtagaaaagaaaaatctaaaagattctcattttaagtgacttgagctatcagttaaattttaaaagccaattattttgaagcagtagagccttacgaattctaaagtcacacactggaagccaaactatctagagtataaatatttccttttgagggggatactgacagattcttctattttatcccaattccagttcctgacctccactcacagacagggaggcaaggggaaggctcactaattggcaaggctggacaagcataaaggattcagtgcataaagaatcaagcttctgatcctctcaagaggtcacacgcagagtgtctatgtgctggacagctttggctgtacacaccagaagtgttccaggcgtaaggtttttggcaagtctcgttgcctacgttcaagtcctctctgagtcgcttactagtgtgtaaacatagctgagatatataatgtttctaagcctcagtttcactgtctgtaaaatggcaatgacaataactgtacccacctcacaaggatgctgtgttgtgaggtgtgaacgagccatttgtgtcagaacatagcacagtgctgggctcacactaagcattccattcatgtcagctactagctctttggaacttttcaactttggtccctagggctacattaaccctctttcctgccagacaataatctgaggttggttgctgctttcagaagaaacagtgtttgaaagctaagaaaaatgtacctagaaatctaatttctaatttcattgtcatgccttaacagaacacccagatgccttaaaagacttttacaaaatgcaaatttctgatccagaaaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcgtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttttaagatgtagttctctggctaggcacagtggctcacacctgtaatcccagcactttgggaggccgaggcaggtggatcacgaggtcaggagtttgagaccagcctgaccaacatggtgaaaccctgtctctactaaaaatacaaaaattatctgggtgtggtggcacacacctgtaatctcagctactcaggaggctgaggcaggagaattgcttgaacctgggaggcggaagttgcagtaagccgggatcacgccactgcactccagcctgggcgacagagtgagcctctttctcaaaaacaaaaaagaaaaaataaaacatgaagttcccaaccatgtgctgtgtagtgagcaccatggtggccctgcagtgtacaaaggtgaattggccatggtgtgtgttggcatggagctcccagtccagctaagaatacccttcagggccaagctgactccaccctgtttcctgaggcccagtcagcggtcccagcttctggtctgtgggctcacctagtttaaagacccccttgagcctcaaaggatgttcgaagcatgattcagttggggagttattggtcaacatggtgggacaattcttcactgtgtgggactgccctaaacagtacagggtacttagcatgtctgccctcccaatgctgagtaccagtggtgctccacagtcactgtgacaatcaagaaaagtaatgattgccacatgtttctgaatacccctgacctctggggaataatactgccccaagttgagagcctctgtccggtttaggtctttctcctcagtccatacctctgctacctccttaagggaccagttccctccaaggggcatgctttcttagaaaagtcatttgatggccgggcacagtggctcacgcctataaacccaggacttcgggaggccaaggcgggcagatcacctgaggtcagaagttcgagaccagtctgaccaacatggtgaaaccccgtctctactaaaaaaataaaaattagcaggacatagtggcatgcacctgtaatctcagctacttggcaggctgaaacacaggaatcgcttgaacctgggaggtggatgttgcagtgagccaagatcacaccactgcattccagcctgggtgacagagcgagactccatttcaaacaaaacaaaacaaaacagaaaagaatgtcatttgacagtgtacaaagtttatatattttaacatacaaatgaagttgacatggtatcaaccaaagggaaagaagggccattttgtaacaggcagaaaccagttgggatttaagaagcattttaattacccttactttttttctataaaggaaaatacttttatttctttcactgatgtgccggtgagagtcttagcaggcttgcctttgtaggtaaatatgatggcacttcccaatcatcatgtattgggatgtgaagttgtgtggagtctgaggctgacccctggtagtgtgaggaccttgggggattgccttggaaaatacagggtccagcccaaggctctggctttcagggtcgggggttgagatgaatttgtcacagctccgcctgagctcaccacactgggaagtcaaacagaggcaacagcttctgtttgctaagtgttaccacatgctaggcactgtgttgagtatggtgaaggacctcttaaatcttcagaacaaccgacgtttcagcattttacagctgcaaaaactgagtcttagcaaacatggtcttagagccacgagaatggacctgggacttaaatcccaagtctagagcctggacttgaccacagcagcatccagcttctcacccatctttcgctcaattcatccctttaatcatttattttaggattcagtttgattcccccaatctcaaaactttcaaggatgaacaatacttctcacacaaacacaccttctaccgaatgccaggaggggtctgcacttagattcctcagctgtcacagtgccattgagtctgaggctgcctgactgcttggttgtggttttttgacacctggcatttgtgtttaacagccccagtggttgagaagcagaggggacccacactggcagaggtggagggaaagaggagagggtgtagggaaagaggagagggtgtagggaaagaggggagggtgtagggaaagaggagagggtttagggaaagaggagagggtgtaagggaagaggagagggtggagaggtagaggggagggtgggggaaagaggggagggtggagagatggagaggagggtggagggatagaggaaagggtggagggatagaggggaaggtggagggaaagaagagagggtgggggcggttccaagatggccgaataggaacagctccagtctacagctcccagcgtgagcaacacagaagatgggtgatttctgcatttccaactgaggtactgggttcatctcattggggcttgtcggacagtgggtgcaggacagggggtgcagcacattgagcattagccaaagcagggcgaggcatcgcctcacccaggaagcgcaaggggtcagggaattccctttcctagccaagggaatctgtgacagacagcacctggaaaatcgggtcactcccaccctaatactacgcttttccaatggtcttagcaaaaggcacaccaggagattatatcctgcgcctggctcagagggtaccacgcccatggagccttgctcattgctagcacagcagtctgagatcaaactgcaaggcagcagcaaggcttggtgaggggtgcctgccattgctgaggcttgagtaggtaaacaaagtggccgggaagctcgaactgggtggagcccaccgcagctcaaggaggcctgcctgcctcagtagactccatctctgggggcagggcatagctgaacaaaaggcagcagaaacctctgcagacttaaatgtccctgtctgacagctttgaagagagtagtggttctcccagcatggagtttgagatctgagaacggtcagtctgcctcctcaagtgggtccctgatccccgagtagcctaactgggaggcatcccccagtaggggcagactgacacctcacatggccggatacccctctgagatgaagcttccagaggaatgatcaggcagcaacatttgctgttcagcagtattcactgttctgcagcctcggctgctgatacccaggcaaacagggtctggaatggacctccagcaaactccaacagacctgcagctgagggtcctgactgttaaaaggaaaactaacaaacagaaaggacatcgacaccaaaaccacatctgtacgtcaccatcatcaaagaccagaggtagataaaaccacaaagatggggaaaaaacagagcagaaaacctgaaaattctaaaaatcagagtgcccctcctccaccaaaggaatgcagctccttgccagcaatggaacaaagctggacagagaatgactttgatgagttgagagaagaaggcttcagatgatcaaacttctccgagctaaaggaggaagttcaaacccatcgcaaagaagctaaaacccttgaaaaaagattagacaaatggctaactagaataaccagtgtagagaagtccttaaatgacctgatggagctgaaaaccatggcatgagaactacgtggcgaatgcccaagcctcagtagctgattcgatcaactggaagaaagggtatcagtgatggaagatcgaatgaatgaaatgaagtgagaagagaagtttagagaaaaaagagtaaaaagaaatgaacaaagcctccaaggaatgtgcgactatgtgaaaaaaacaaatctacatctgattggtgtacctgaaagtgacggggagaatggaaccaaattggaaaacactctgcaggatattatccaggagaacttccccaacatagcaatgcaggccaacattcaaattcaggaaatacagagaacgccacaaagatactcctcgagaagagcaactccaagacacataattgtcagattcaccaaagttgaaatgaaggaaaaaatgttaagggcagccagagaaaaggtcaggttacccacaaagggaagcccatcagactaacagtggatctctctgcagaaactctacaagccagaagagagtgggggccaatattcaacattcttaaagaaaagaattttcaatgcagaatttcatatccagccaaactaagcttcattagtgaaggagaaataaaatcctttacagagaagcaaatgatgagagattttgtcaccaccaggcctgccctaaaagagctcctgaaggaagcactaaacatggaaaggaagaaccagtaccagccactgcaaaaacatgccaaattgtaaagaccatcgaggctagaaagaaactgcatcaactaacgagcaaaataaccagctaacatcataatgacaggatcaaattcacacatcataatattaaccttaaatgtaaatgggctaaatgctccaagtaaaagacacagactggcaaattagataaagagtcaagacctatcagtgtgctgtattcaggagacccatctcatatgcagagacacacataggctcaaaataaagggatgggggaagatctaccaaggaaatggaaaacaaaaaaaggcaggggttgcaatcctagcctctgataaaacagactttaaaccaacaaaaatcaaaagagacaaagaaggccattacataatggtaaagggatcaattcaacaagaagagctaactatcctaaatatatatgcacccaatacaggagcacccagattcataaaacaagtccttagagacctacgaagagacttagactcccacacaataataatgggagactttaacaccccactatcaacattagacagataacgagacagaaagttagcaaggatatccaggacttgaactcagctctgcaccaagcggacctaatagacatctacagaactctccaccccaaatcaacagaatataattattctcagcaccacatcacacttatttcaaacttgaccacttggttggaagtaaagcactcctcagcaaatgtaaaagaatagaaattataacaaactgtctctcagaccacagtgcaatcaaactagaactcaagattaagaaactcactcaaaactgcacaactacatggaaactgaacaacctgctcctgaatgactactgggtacataatgaaatgaaggcagaagtaaagatgttctttgaaaccaatgagaacaaagacacaacataccagaatctccgggacatatttaaagcagtgtgtagagggaaatttatagcactaaatgcccacaagagaaagcaggaaagatctcaaattgacaccctaacatcacaattaaaagaactagagaagcaagagcaaacacattcaaaagctagcagaaggcaagaaataactaagatcagagcagaactgaaggaaatggagacataaaaaacccttcaaaaaatcaatgaatccaggagctggttttttgaaaagatcaacaaaattgatagaccactagcaagactaataaagaagaaaagagagaagaatcaaatagacgcaacaaaattgataaaggggatgtcaccaccaatcccacagaaatacaaactaccatcagagaatactataaacacctctacacaaataaactagaaaatctagaagaaatggataaattcctaggcacatacacccttgcaagacacatacacccttccaggaagaagttgaatccctgaatagaccaataacaggctctgaaattaaggcaataattaatagcctaccaaccaaaaaaagtccaggaccagacggattcacagccaaattctaccagtggtacaaggaggagctggtaccattccttctgaaacgattccaatgaataggaaaagagggaatccttcctaactcattttatgaggccagcatcatcctgataccaaagcttggcagagacacaacaaaaaaagagaattttagaccaatatccctgatgaacatcgatgcaaaaatcctcaataaaataccggcaaactgaatccagcagcatatcaaaaagcttatccaccatgatcaagtgggcttcatccctgggattcaaggctggttcaacatatgtaaatcaataaacgtaatccagcatataaacagaaccaaagacaaaaaccacatgattatctcaatagatgcagaaaaggcctttgacaaaattcaacagcccttcatgcgaaaaacactaaataaattagatattgatgggacgtatctcaaaataataagggctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtacatttagaaaaccccaaatctccttaagctgataagcaacttcagcaaagtctcaggatacaaaatcagtgtgcaaaattcacaagcattcttatacaccaataacagagagccaaatcatgagtgaactcccattcacaattgcttcaaagagaataaaatacctaagaatccaacttacaagggatgtgaaggacctcttcaaggagagctacaaaccactgctcaacgaaatagaagaggacacaaacaaatggaagaatattccatgctcatggataggaaaaatcaatatcgtgaaaatggtcatactacccaaagtaatttatagattcaatgccatccccatcaagctaccaatgactttcttcatagaattggaaaaaactattttaaagttcatatggaaccaaaaaagagcccgcattgccaagtcaatcttaagccaaaagaacaaaggtggaggcatcacgctacctgacttcaaactatactacaaggctatagtaaccaaaacagcaatggtactggtaccaaaacagagatatagaccaatggaacagaacagagccctcagaaataataccacacatatgcaaccatctgatctttgacaaacctgacaaaaacaagaaatggggaaaggattccctatttaataaatgatgctgggaaaactggctagccatatgtagaaagctgaaactggatcccttccttacaccttatacaaaaattaattcaagatggattaaagacgtaaatggtagacctaaaaccataaaaaaccctagaagaaaacctaggcagtaccattcagcacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacagaatgggagaacatttttgcaatctgctcatctgacaaagggctaatatccagaatctacaaagaactcaaataaatttacaagaaaaaaacaaacaacccaatcaacacgtgggcaaaggatatgaacagacacttctcaaaagaagacatttatgcagccaaaagacacatgaaaaaatgctcatcatcactggccatcagagaaatgcagatcaaaaccacaatgagataccatctcataccagttagaatggcgatcattaaaaagtcaggagacaacaggtgctggagaggatgtggagaaataggaacacttttacactgttggtgggatgtaaactagttcaaccattgtggaagacagtgtggcgatagctcagggatctagaactagaaataccatttgacccagccatcccattactgggtatatacccaaaggattataaattatgctgctacaaagacacatgcacaggtatgtttgttgtgacactattcacaatagcaaagacttggaaccaacccaaagtccatcaatgatagactggattaagaaaatgtggcagatatacaccatggaatactatgctgccataaaaaaggatgagttcatgtcctttttagggacatggatgaagctggaaaccatcattctcagcaaactatcgcagggacaaaaaaccaaacaccgcatgttctcactcataggtgggaattgaacaatgagaacacttggacacaggaaggggaacatcatacactggggcctgttgtggggtgggggtaggggggagggatagcattaggagatatacctaatgtaaatgatgagttaatgggtgcagcacaccaacatggcacatgtatacctatgtagcaaacctgcacgttgtgcacatgtaccctagaacttaaagtataataaaaaaaaaaaagaaaaagggtggagagatggaggggagggtggggggatggagaggagggtggagggaaagaagagagggtagggggaaagagggtagggtgggggggtggagggaaagaggagagggttgggggagagaggggagggtggggggatggaagggagggtggagggaagaggagaggatggaggggtagaggggagggtgaagggaaagaggggagggtgggggatggaggagagggtggagagaaaggagagggtgggggggtggaagggagggtggagggaaaggggagggtggaaagatagaggttagggtggagggaaagaggggagggtggggggatggaggggagggtagagagatagaggagaagttggaaggatagaggggagggtggaagggtagaggggagggtggaaggaaagaggggagggtgagggggatggaggggaagttggagggatagaggggaggtgggaaaaaaagaggcctggagctggtgttaggaggccagggtctaaaccccacttgaaaacctacctggtggatgacatgcacagactctctgggcctcagtttcccattcacatataagatggggaggcctttatccacttccctaagagggttgttgtgacaattcagagcagtgttagagtccaaagtcgggtgaatgcccctggggagtgtacaggaccatcctttatagtgtgagtagaaagtcttagcatttttattttttactcaacaagaaattaggctttacaaatatttgatgtatggatggaccatgacatccacaatcagctgcgtgttctgggcatgtcctcaaagaaagaagggactttgcaaacgggaaggggttgggagctctatcctcattcattcccttgcagcctttgtgatgtttgattgcaatttgccacttctggtgaggcgggtacgcagaatacattatccagcttaaactcaacaaaccctgtttcaacaaactgaagaagtggcttaaaaagttttcatgaattaaaagctaattaaaatctataatgaacaatatccacataaaccaaaaaatggcagagttaacacttcactgggaagaagtttttgttgtcgtcgttgttgaatcagccccagtaagatgtgaaaaaaaaaacagactaatgatatctgacaagaagtcggcccaagaagttcaaaattatcaaggtcaggtgcagtggctcatgcttgtaatcccagctctttgggaggccaaggtgggaggatcacttgaggccaggaatttgcaaccagcctgggcaatatagtgagattccatctctactaaaaatcaaacagttcggtggctcacgcctgtaatcccagcactttgggaggccaatgagggcggatcacctgaggtcgggagttcgagaccagaccgaccaacgtggagaaaccccatctctactaaaaatacaaaatttgccgggcgtggtggcgcatgcttgtaatcccagctactcaggaggctgaggcaggagactcgcttgaacccgggaggtggaggttgcggtgagccgagatcgcgccattgcactccagcctgggcaacaggaatgaaactcggtctcaaaaaaaaaaaaaaaaaaaatcgaacaattagctggatgcttgtagtctcagctactcaggaggctaaagaggatcacctgagcccaggactttggtgctgcagtgagctatgatggcactaccgcactctaacctgggccacagagtgagcccctgtctcaaaaaaaaaaaaaaaaaaaaaaagaagaagactttttgaattaaagaaagatttacatctcctctcattaatagcactattgatttttatttgatttaacacattatttcattgttattacaaattatgtgttttaaatgcctattttgatgtataattctataatgtacacttagttcagtagtacatgtgtattacttgtatttatcatgtgtgaatatatatatatacacacatggtatgtgctcaaaatattttacagattagagtatgtgaaaaaaatttgaagaccactctgcataataaatgtgcaggggctggcccatgagacatgttcagtaaatgcttgtttccatcctctttctccctggaaataaagtcgatagtgtgtgtgtggaccttgcttattaaaggaaagtggctgatttgatttctggaacaaggtgcatctcaaactagctggcagcactacctcggcctggccccatcccagctgttcacaccgagttccagacatttgtaggagcccggacgaggccagctggctgcctatcagtggccttcttctgtcagcactacacagttgtcacggctcacatccaaccgccagacagccaagaaggagacgccaagatttaaatctgcagttcctgacctccgcaaccacacccgattctttggttggtcctagacaaaaacaacggttttgcagatttgggttctctttctcaaactgccttttgatgatttatttgtgagatatgattgctcctcttgcaaatcagagctggttgcagtagctaactaacatttattgagcgagtagtatacccaggcttcagctaagtgctttctggaattatttaattttcacagcaaccatgtagagtaagttctgccactggcaccactttacagataagcgaatggagacttagaaaggttaagtaattttactagaggaacataaactaacagtgaaagtgagaaatctcagagtctcattggtctgacagctatgtaaggaactgaggggatgtaccattgcaaatcgtcaaaatggaaataccccaaatgcaatgcaggactctggatgcgattctggaacaaagaaagaacacttgtgggggaaaaaaaatagtgcaacccagagtctttatttaacagtattgtatcaatgttaatttcttagttttgacaaatgcatcctggttatgtaagatgttaggattatgggaagctgggtaatgaatagatggagagtttctgcactatgtctgtactgtttttgtaaatgtacaatgattccaaaataaaaggtgtatttaagaaacagaaatgccaagtgtatatgtgtgagtacacacgtgctctcacatgtgcatgtgtacagttgtgcatatgtaagtctttgtgcatatgtaagtgccccttgctgcacaccccctgctgttctgtgtgtgctgctccactcaagcccctgggacttacatggatgtcagcgagaaggaagcctacacaactcacatgtgacatgcccgccatgctctcgtcatacctcacctgtgctgtagaacccctgggtcacaggtggcagtcttgttcccccataacaaatgccagaaaatgatgtgtgtgtgtgtgtgtgtgtgtgtgtgcatgtgcacacacgcatgcacgcacacacgctctggtaggggggtttcaggaagtcattcgtgaagatgcagtgtagcatccagaataaaataaccaatttacaccttaaacactcttctccagtaaggccactacagctgcctctgcttactaagtgcatttgaagagtcctctgctttatccgtactctatcctcctgaaaagaggcactgacctgaaagggaagcccaggagcttctaggcccagacttttgctttgtttctcaccatgtgctgtgtcaaaactgagagaatattttgatcaccttttagctaagagctatctcctgggcagcagcttaaggctagagtaaggacatttcacagtttaagagagagcagtcactccgccaaatggctctgaggtggccacaaagtgcttgacttgcaaaaaattgctccattaactagattcagggattttcaggatttatgggctaggctgtgctaatattactgtggtgcttctcagtataattgctagaggcctccagtgagcagaggaattgtgtgttcagtctgtcctgggtgacccttactgcgtagtcctagggagacaaagaaaacccactcaatccaggaggctacagaaatgatgtttgtggagatctcagtgggtatctaatctgtaacctcagggggagaactctagctggtctcagtctttgctggaaacagaacttactggatgtgtgtgtttactcactcattcatttatttgtttatttatttactgtgacagggtcttgctatgttatccaggctattcttgaactcctgagctcaagtgatcctcccacctcatcttccaaagtagctgagattacaggtgcatgctaccacacccagccatcattcatttacttattgagtgtctaccatgcaccagatgcccaggttaagcataaaggatatagagcaggacaatcaaaaagtctcagattcagaaggaggagatggataaaaaccagcaagatctaaagtagataatttgattatgataagcacaaataagcagagaatacattgatgtgatacagagggccatgtggggggcagtgtgattcctttagattgggtgaatcagggtgatggcttttcagttgacattggaagaatgaggaggaaggaggaagaagtggcagccgggtaggacagcaggtcttctctgtcccccgagttcttctgatgtcctgcacagaaacctgaggggtagagtagcaaaggagaaatccaagctcaggctgggaaagaagctcatggcaccaaggttagggcttgtgataacagggacctgcttcaagagaaagggaggtgggtggcagattggtctcatggctgccacccacataattctaaaggtctcccaatgggagaacagccaccctggtaagtgtccagcatcatacaaggagtctctgcccattgtgactcttgcttgagcccccacacttagccctcaccaagctgtgtgatttaggattcaggtgttagaacggagaaggcaccaggcctactgcaccatatcaatgaagcctttgctttggggaaaacagagctgggtacaaataccagtgccacccattcttccctccatgctctggacattcaacccatctgagccttaatcccttcatctgcaaagtaaggaccatgcagtcttcctggtagtgttgtaaggctcagatagaataaccagacagttccaggtgcatatggcactcagtgagaatccacttgctttatcctccctcactcccttccttcctccaggaataaagagtacactagttgaagaatatttctttgccttccttctttagcagctccaatcccagcctaacagcacaatgagcatcagatgtgcttttttgatgtttgaaatttatagtctctgttgaatgttggccaggacagcacttcgtcatttgaacaatttccattttccacaagctctctgtgattgatgacctaaccaggcacatggcattccgttccaccagcaatgtggccagtggggagatggctatgtcagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacgtatagggagatctgacagatagaaggggagaaggcaatgcgatcaccactaggtagaggttagagggatgcacccctaagtcagggaatgccagcagctgccagaagcttaaagaggcaaaggatgaattgtcccctagagcctccaaagggagtgtggcactgcttatgccttggctttggacttctggcctccagaactgtgagagaataaatatctgttgttttcgatgggcgtgatggctcacgcctgtaatcccagcaccttgggaggccaaggtgggcagatcacaatgtcaggagatcgagaccatcctggcgaacacagtgaaaccccgtctctactaaaaatacaaaaaagtagctggccgtggtggcgggcgcctgtagtcccagccactcgggaggctgaggcaggagaatggcgtgaacccaggaggcagagcttgcagtgagccgagatcgcaccactgccctccagcctgggcaagagtgcaagactccatctcaaaaaaaaaaaaaaatctattgttttaagccaaccagttcgtggttatttgtgtagcagccctagaaatgaagacagcctgcgagcaccttgccccacctggctgtaggtgacttttggtgccaccatttttgactcttgtggataaagagcagactatattctttttataagtaagtccaccttttacagaaaaattaatagccaggatcatggttttagaactcatagaatacactcctctcatcctctcattctttcccccacccattggcttataaacttgttcctatgaaataagtcagctgagttgagtttgtaaatgcatcttgaataaatgtgttgggtggggtcacaaacatgcagacacctgctggtgagtgttactgacctgcactctgaaaggcccctatattgatgatacttcttaatctcctatggctcttcttcagccctgggagcaggggagtgcagacttttgttcaacccctttcacagatgtgcacactgaagtcccagtgtgtccagtgacttgctcaaggtcatcagcactgtctggtggagctgggactcgaacccagtcctcctgctctcagctgtgggaaatggagacagcagttgccctggaagatgtttcctgtgctgcgtgtttgtggttgtctcaggatttgtgagacttactgttttcttgtgtcccctgtccctgtgacttatctttgtgcccactcagccatcaccacttccaacacacacccacacctgtggagagaatgcagcctcctagagctcatgtcatggcaggactgagggaagtagtcagttcttggtgctctctaatagggctctgaattgcagcctgggccgtgcccattcatttatgtattgtctatagctgcttctgtgttacaagaattgacagagactgggtgtggtcgctcacacctgtaatcccagcactttgggaggctaagacagaaggatcgcttgagcccaggagtttgagatgaacctgggcaacatgatgataccccatctctacaaaaaaaaaaaaaaaattagttgggtgttgtgatggaggctgagatgggatgactgcctgagcccatggggtcgaggctgcaatgagctatgattgtgccactgtctcaaaaaaaaaaaaaaatgttgacagaacaagttgattcaattatagacttgagtagttgtaacggagactataaagcctaaaatatttatagtgttaactttgataggacaagtttgccagctcctgcactagaggataaagattaacaggattgactccacatagaggagaggagaggaaggggcaaggatggaagcaaggagggagaagggttagagagaaagaaagagggaggggggtcactcagagacttcacaaagtatgttatttcctaaaaactgtaatgcccagtatctagtgattacctgtggcactgtcagccttctgcctgggaacaggaatcttgcaaagatcaaatgcagggcccagagccccaggactctgcattggcattcgtcagtaagttttgaaggaggcagacatctcaaaaccatcctaagcataaggcacccagctggtgatttgaagatagccatcttccccattactagttggcctcactttaaaaaatgttgtttcttggatagcatttttctttcacaagttggtttgctttcacatgtcaaaaaacaaaaccagggctgggcgcggtagctcacacctgtaatcccagcactttgggaggcgaaggtgggtggatcatctggggtcaggggtttgacaccagcctggccaacatggtgaaactccgtctctactaaaaaaaagaaaatacaaaaattagccaggcatggtggcgtgcacctgtaatcccagctactcaggaggctgaggcaggagaatcacttgaacccgggaggcgaaggttgcagtgaaccaagattgtgccattgcactccagcctgggcaacaagtgtgaaactctgtctcaaaaaacaaaaaacaaaaagcaaaaacaaataaacggaaagagagagagaggagagagagagagaaacacataccatttgccatatttgtggtttctcattcttgcgctatttttttaaacctttcattacattaggcctttatcagatattagcactggttcttcagttttccccctgatcaggaacttccctgaaataaatgctggtaagatcgtggaaagttcccaggagaaggatagaacaggtgtaccccagggaggctgagccagtacagagagacctatgggtttcacgggccctcagtagaactgatttcctctccttgtctcaggttgtcatcagccactgagcaagaccgaataagggatctcgtgaggctttggagatggatgcaggatctgttgcctgcgattcaaagctggtggaggacttgcttaggtcatgttaattagtttttctcagctctcaccaggtgtcattcatggaggttgcataaaagaaactcatacccagggatgagctttttcttaaatattacctttctgaattttgaaatttagtgtagcattgagacatttaaacacatttttgaagcacaaaacttatttatcctagttcaaagccagatttggtttgacctgtcttggtggtgttttctgtggttctgagatccaacccccaacttcgtcccttttgacctagtttatcacccatgtccttgggttgaaaatagtagtgtaatcctaagagaaggggcctgaaaggaagggaagagaaatcagatgtcagctggtgaggatgagaaatactgcaacaagggagcagcattgacccttgagagctacatgctaggtagagtcaagctctacttgccctaagtcaaaaatatcattgacttgtggctaaagcccagactttgaagagcaaagaaagcaaggatttaactgcaaaaatagaaaagtggctgacccaatgctgaggcttttaacaaaatttaccaaatagtttatttcagactgagaaagaaagagctcaaacaagcttaagcagcagcaaatgctatcagcctggaccatgagattgcatgtgccctgcagtgatcttccaccttgactgacattaaaactacctggtagtggccgggcgtggtggctcacacctgtaatcccagcactttaggaggccgaggcgggcggatcacgaggtcaggagatcaagaccatcctggctaacacggtgaaaccccatctctactgaaaatacaaaaaattagccaggcatggtggcgggcacctgtagtcccagctgcttgggaggatgaggcaggagaatggcatgaacccgggaggcagagcttgcagtgagccgagatagcgccactgcactccagcctgggcaacagagggagactccgtctcaacaacaacaacaacaacaacaacaacaacaacaaaaaaaaaaaaacactacctggtagtgtttacagccttgagtgcccagaccaataagatcaaaatctctgaaggtgaggcctgggcttggtgctttttgatgatcctcaggtgatcttaatggtcttccagggttgagcactgtggggaaaattgaggccaagatgtggaggcatctaactggctcgtgcatgttaagaactggatgagatgggaagccagacattagaaataatggggtcagggcaccacttacatggtattaatagccagaggtcttgaatcttcctccagactacagtgaagagagatacacatgttatctacctggtgatagataccaaagggaagcaaagtaccacactgaagcaaagtaccatggaaggactgctccccacttttgatgcatgataaagaccaacctgcctgcatgaagatgatggtgcacttctcctgaacttcaccatcatgatcacagtcaaagccagtgatgatggagtataatcacaccagtaaatgaagttcccctgctgtcttctgactcacttctaagtggcctggaccctggtggttaagaaaagtaaacccccaaagcagtcagtcattgtcggtttgctaacttgagcatcctgaaattaaaggactaagtactttaactgggtcacctctattagtgggtaaaaagctgtgtggtctttgttcacttccttaaaatgctgctatacgtgatggcaagcaacagaactagccacgagaaagcaacatggaaaccactgaagtcaagacttaatcctacctggttccccatcaataggtaaaacaaagtggttctgagcacaaactctgaagccagatgatcagcttttaaaaaaaaaataattaaagaatatttatttatttatattttattttagattcaggtggtacatgtgcagatttgttacatgagtatattgtgtgatgctgaggtttaggcatctaataatcctgtcacccaagccatgaacatagtacctgataggtagtttttcaacccttgatcccatcccttcctccctccttttggaatgcccagtgtctgttgttcccacctttgtgtctgtgtgtacccaatgtttagctcccacttacaagtccatgttgctgcaaagaacatgatttcattcttttttatggctgtgtagtattccatggtgtatatgtaccacattttctttatccaatacactgttgatgggcacccggttgatttcatgtctttgttcctgtgaatagtgctgtgatgaacatacgagtacatgcccttttgatagtatgacttatcctttgggtatatatcagtaataggattgcagagtccagtggcaattctgttttcagttctttgagaaatctccaaactactttccacagggcctgaactaatttgcactcccaaaaacagagtataaatgttcccttttctctgcaacctcaccgacatctgttgttttttgacgttttaatagtagccattctgactggagtgagttggtatctcattgtggttttggtttgcatctctctgatgaatagtggtgtagagcattttttcatatgtttgttggctgcttgtatgtcttttgaaaagtgtctgttcatgtcccttgctcactttttaatggggttgttttttacttgtcaatttgtttcagttcctataggttctggatattagtcttttgtcagatgcatggtttgcagatattttctcccattctgtaggttgtctgtttactctgttggtagtttccttttgctgtgcaaaagccctttggtttaattaggtcccagttgccagacggacagctttgaattctggtcttaacacttcataactgggggatctaggggcaagttacctaacctctctcagcctcagtgtcctcatctgtaatggagggataatagaagcttccccccagggttatagtgagggttgatgaggtagttcatttaaagcactcagaactgcgcgtggcacctgtaaacactcccacccccagtaccttttcacaagtactattaggatgatgctgttagcagcaattatcagcacctctcatctcaagttatattgctagtgacaaaacctttggcatttcagtgtatagctttccaatcttttccataactgtattttttcttataaaagtgagattatactgagcatactctttgctttttaaactgactatattgagaatatctttctatttcatgtaatctacagcttcatttgcaatgactgcataatggtgcagatatatcatagattatttaaccaaacacctgtggtttaatacttaagtctctctcttttttaaaagcaatgctgcagtaaatatcattaagtaaaagcactgctcattggcataatttcccctttagaataaattcctagaagtgaaatgtgttgttcaaatcgcatataaacttgaaagtgtttgctattctatatgactgccaaattatcctctagaaagattctaccaccaccagcagggaataaaaagtcagtttcccctcactatacttgacactgggtattacagtttttaaactgtaatcttttgtatttgttcttgacctaaagctgagctctgctgtttggggcttggcttctctgaacttggtgctgattcttgctttaactggagcttcctactggagcatcctaggtgggctctcactggctcaaacaaccctatgaggctcttcttagtcttctaggactagagcagggctcagccaagcacatggtgctggcaggacacttggagctgtccctataccagcagcaatcttttgtcttgcttatttaattaccttatcctaaagtacgtctttactagaaatttgctgtcctcagtgagaagcagtacctttcccttgttccctgctgaaccaccagggtcactaccagcagatcagagccacttccctgtccctgggggcatcgtcttagactttggtcaccaccaaagaggagacataagaagaagggcaggaagaggtagcattgagcaagagctctggatttgccatcatcagctgaggattctgaattaggaaacatatctatttaggtttaaactacaaaatatgcaagggttcctattccgagcctctcagaaacatccctctggccacaggcaactgtcactggtgatggttattctctcagaagatgctgaggatcagggtgtctaaggagtagctttgctttaatctgagcttggtatattacattttccatgttagcctacctaatagggtgggttcacatagaaatactagaaaacacagaaggatataaagagcaaagatgaaagcattccaaatcctaccatctagatacaacctatgttgatatttagcatgtatgcagaggatagatgctatcctgtagcatgatcatttatatgcatgtgcgtacacatgcatttactttttataaaaatgatataatactgaacatgctattctgtagtcagtttttaaaagaatgtatctttttttttttttttttttttttttttagatggagtcttgctctatcatcaggctggagtgcagtggcacaatctcggctcactgcaacttctgcctcccaggttcaagtgattcccctacctcagcctcctgagtagctgggactacaggtgtgtgccaccacgcctggctaattttttgcattttagtagggacagggtttcacaggttggtaaggatggtcttcatctccagaccttgtgatctgcccgcctcggccccccaaagtactgggattacaggcgtgagccaccatgcctggtgcccccccctttttttggggtgggggaaacagggtctcactgtgtccccaggctggagtgcagtggcacaatctcagctcactgcaacctccgcttcccaggcttaagcaatccttccatttcagcctcctgagtagttgggattacaggcatgtgctaccatgactggctaatttttgcattttttgtagagatggggtttcaccatgttgcccaggctggtctcgaactcctgagctcaagcaatctgcccgtcttggcctcccaaagtactgggattacaggcatgagccactgctcccagccttaaaagaatttatctttaatggctgtgttttatttatacattttcagtcattcattatcaataaatactgattcaggcccagtatgtgttaggcatgattctaggcaagagagagaaaccatgaatgagagacatggtctctgcccttggggagggtgtaatgaagttcgtcagttttgtgctttgtggtttctttctatgcgttatgtttttaaagtcctcttccatcctaaagtcagacaatcactatattttctcatgttttcactttttacattgcctgagtccatctagaaattgttttggtggatgaaaaattttctacttttaaaccattggaggacagcaatgaccacaaaaggattaaatcctctttccttatagacaagtgggcacaacttggctatgcagtaattctaacatcagcagtgcaaagaagggaagtacagtgttgattcttcatgggagactgatggaattataatagacttctgttcttaaggtagaaaattatcatttttttaacctgaaaagatagagtaatagtctatgataaggacaaattaccccaatatgtttttaaaacattgcaattattaacaaagtggtagtttctttcatttaaaacccccttgggccctaaagatatagctaacaagaggaaaaactgtcaaaactcttattaggtggttgagtttattttctgctcacaattgtatcatttaaaaccctgagaaactgttttttggagagcaatttgtccctattagagttttatgtgttcaaatccttgacttagcagttctgctggtagaaatccaccctatgtatggaatcacaaaagtacgtctaagatgaacatagaggaagattcattgcagtcccgtctataattgcaaacaaagcactgagaaccacctaaattatctattagcagcagactgctaaagtaagttaagctacatctgtgaatcgccatgccgtagttgcaaagaatgtggtgggattccatgtgctgaatgaaatagtaaaatctctaagatacatcacgaagtgaagaaagtaagctgaagggcaggtcttttgtgttaagaataaaagaccccaacttatgttggtgtatccattttttcctgtaggatgcataaaggactaataggaattgttgcctgaaggaacaaagctggtagggatgaggtgaagagaaagtcaaatgttcattttattcctgtgtggatggtgtgaatttttctaccctgcatgtttattacttttatttatgttttgtaatgcttactccatttatctaggcagggagattatagacaattggtgtttccttctttatacttttctatattaaaaaatgaatatagatcagaaatgttcaccagatactggcatctaagaaacaaacaaaaacatgatttgtcaaagtcagaaaaggagtgtatgtctctgtttggaattatgctaatttcttggagtttgcgttcctttgttgtcatcagaatgctgcacattgtgttctctttctatttttgtgcacactatcttgttttgtatttccaaccacgacagctatgttcagttgtgccccatcccctcccctgttctgtggcctgcggtgctgagaactgcgagcagccaatgggactgctgcttactgtgaggtccatgcagtgtccacccccgcttcctgccctgagactgcctccaggcctggcacgtcttcctaagacaggcctatcaacccagtggatccttctgccccttcctcctcctgtcctccaactttagggagccatattctgatatccagagatcctggatttagagcatctcctccattcttggtaaattgagaaccttcccaactgctgcctcatctgcagtagttcctttcagatgaaaagttaaaatgggagagaaatattttgcatttgctcttttcattagactattcgatttctatgtaaatgtcttctacagggattgaaagaaatgaatatattggttcaccagacattgctgaaggttccaacacagccttgacctatttttgtttgaaattgagaaatgctcacaaatgtaagaggcctccttttttggagattggagggatttgacatcaagatgttttgcattttcaacagctcatttgccctggatggcttttggcagataaatgtggaggtggcagtgtaataggtttcatgtgtccagagtggaattcacccagagccaaacaaaagctagtagctctgaacatgtctcttttcatggtaaagtactctggagtgagactgtttaagtttcaacccctgtttggccacttcttagctcaagggcacttcccttacagtagctaagtttaggttgtttcatccataaaatggaagattttaaagtatctacctcaaagtgtgatgaggattaagtgaaaaactgcggggcaattcttactataatgcctgacatagcaaggcatcaataaactcagttgccattattattcttaccattatggtttataccactaccatcattgggattattaggttcaaccactacacaactgaattgttgttgcatgagtaaattgcagttgtttagacaaaatcctaagccaaaaacttcgtgctaggtagaaaggaagcaccttcatttattaagtccctgcactctaccaggtgatgtgttagttccatctttgctgtatctcatttcaatcctgcagtagcattttgcaggtagttctatttcagtatttcagacggagttccaattgtttgatgcttactagccatgtgaccctgtctctttatcttcctgtgcctcagttttctcctctgtaaaatggggataatgatagtacctaactcattaggttgttgtgaagattaaacatgttaaatcacacaaaacagtgcctggcacacagtgaccactatgtaaatgtttgctagcattactttataactcaggaagggcacatgtgacagtctggaacgtgtgaagtcgttgttctccttagcactgtggaatgttagtgatgctggaggaaacttagagctaagctggcccaacctactcatttcacaggctggggatccaaggcccagaaacaataagggacttgtctaagtcactcagggagttcgtggcagagcccctacctgatacgagatctcctgactctgctcacgagacttcatggtgggaataaggcaacacacggagagggatgagatggagatcacattcttcgggagagtttgattctgttattcctgccatttgggactttttcagagtcctctaccattctgcctacctgtacagaaagtgctggatttttccaccacaaggggcttatcaatgtggtgtcataaagcgggtcttactttctcatcagagcccatatcagaccacttcccttcttggtctttagaggaaaccaaagtgaagcactcctagcaaagaatttgatgttatgaccatcaaagcaaaagtatagctctatggttaaataattacttaaagggtcacaccgtgggcagaccttaaaaaacagacttaagatataacccatatgggctataaagtatctataaaggaccctaaatggaaactctgctgtgttgtgcatttgacttggcactaataggccagatatattaactgttgggtgaaattaatgataatattgcatctaaattctatgggatgtttcttaaggttttgggtgttaaattaccccttctaaaatccagtattgaggctcgaactaatcaatgtcttctttttcttttaaaaattctcttgaccatattgtttctattacaaatgaaacatgaaggtagaaagtagaataataagttacaagaagtggagaagggagtgtgtgtagtggaggatgagagaggttggttaatgggtacaattatacagttaggtagaaggaataagatctaaggttggatagcacagtaaggtgactttagttaacaacaatatattttagattttaacatagctggaagagaggactaaaaatgttcccaacacaaagaaatgataaatacacgagatggtggatgtcctgaacaccctggttattatacatcctatgcatgtaacaaaatattacaggtacccaacaaatgtgtacaaatatcatatgtcaataaaacaattaaaagtaaataactacagaaaacaatacaaagctggcagttccttcttttacagatagatggcaagctcaagtccaaataatcagttgaagaaaagagaagttatgtagatggaaatgctggtccaaactaagggatgaggaataaatagagttgtggaattatccacttcacctggtgatgttgcgggttaaatgggtacatggctaggcagaacaatgtagaaaacctaccttacttgttcttctgaccaagccttttaaggctgtcatttaaaatggctctgagttctgtttcttagttttgtaggatcagaaaatcacatgccaacttagctttcagctacttatctacaaacccaagtgtctatttatttttcagtggatggacactgcaggggtcttagcaagtaccatctctccatttagctaactacataggaagcctgaatagaaatcaggattatgattggtgatcttgaagacagagccaggagagtgagttttaatatctgatggtgttgagatgagataactgatctcgaacagggatgtgtctgctgagcaaactcagcattacttgttagctggacaggcgattggacaaagctgagtgagcacctcttcaattttttttatgcttgattactcaggttttcagtttttagacagactatttttcttttttttcccctcagatgtataaatagcattgaatctgcagtagtgttagaaaggtaattataacccaaccatgtctgagatgacattgtgatttcttaatagaaaaagcttgttgggtccccacttgcaagttgatttttcataatttaattctcaaaatgtcaccttatttcttggtgtaacccagataaaacctaggtatcctggcaatccagtttcagcatgaagttatattcaaaggaacacaggctagttggccaaagtaatttcagtatccttactggaatcttctggagaacatcagaggggattcattttataagccacagtaaaatatctcaagattctcttttcctgatttcctggccttaatatctcagccttttcattttaaactcttgaactttaaactgtctctgacccctttcagtgctttacttcttcatctcttctttccttttctcgatcatttttccccctaaatagcatccccacccattccctttccaagtgcaactatataaaacagtctgtttctcgcagtttttcagtactttacctctttctctgattcttcatttcaaaagcctaggaatcctctggcaaaaagtcacttaaaaggtttggggcaaggaaacaagattccctttagctcacatggaaggaagtcaaagctgaattatcttcatctagcaatagaaagaataaagattgcaacgtttacaatttaatatattttctttaccctcctcttgtctaaattctgtgatctcatgatggcaagagggccttgagtaggtcttctggtcccttcccactgctgtgccctggggcgcgaggtatcagcgcaagctagaatgggggttcagtggaggaaaggaaacaccctatttctgcttctgactaccttccctgcttagcctctttccctgtctccctgtttctcacacactcagttgggacacccaccttgtccacagccacagcctggcatctcctagtgctccagttgcagcacagtcagcaggagagaagagggagtctcaaggagcaaaaaggtggaaataggctttcctaacaacaggtgcttgccatgtctgtcttctcatcatatttattgaacagaatgtgcttcattctctacgggtgctctttaacaatagtttacgtgttatgttacgaacatgttatgattataacatgttctatcatgttataatccttccagaaaatacttgccaggaaaatatataatttatagaaagtgaatgaaagtggcttgttagccttcccagatagtggaggaatctggaagtctttctaatggattgagatcacgtcattccagatgtctcttgaggcacactgccccgaatggttgctactgtcagctcattatgcttttccctggaatttccacttcccccgcctttctccccagaataagctttccatgattctttcccagaattagccttttcaactctttcctcatatgcatagcaacagtaatttatttcatgtgggttaatgtctttagcattaggacacttctggttttatggactgatggccaatgtgtttttaataatgtattttgcttctattgaagtcatgagtacaaattcgtaattcatttgaatgagggatatggacaaacaggaacacaagtggaagagagaaaaaagaggatagtacactcagagatactcagtaagcataaattacatgtattcatcatacaatattctaggctttagagatgtgtcagccaagatccttgtcctcaaggagcccatagtttgttagagagagaagatgtgtaaatagttaagtgtataaagtgctacagtgcttgaggtctaatgtagaaaaatccacagcctgtggggagggaagagaaaggagggagtgatgcaatctatttggagggaacagaaaaatcttctgtatttgtcagtactctttgagttgtaagtggtagaaacatcactcaaactagcttaagaaaatgggagatttattagtgtatataatttaggaagcctggggatggttctggcttcatgcatgactagatctgggactcaaacaatgtagtaggacccttttttctctttcaactctgcctccctctgcatgttgactttattttcttcaatgtagatgcatttcttttatgtgacttggaaaaattgctactcagaagtacatcatctcagcttaatcctagtggtatgttttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatcgattattgttagaggaagcaataagaacaaaactaagaggacatgaaccagccgggaagatcaggagactgcaagtagtctttgaggttggatcatggtagggggccatggcttgagatgaagctgtgaaatagacaggagcctcactggctatgctagggaacctgctctttgcactgtaggcaatggggagacatccttggttttaggcaagggtcggaggtggtcagatttccattttagaatatcactctggcagcagtgtggagattgagttggagaagccaagaatggatgcagggagactaataaggaaaccactacagtaatccagctggagataagttctgtaatgtgctaaagatgctaatatggaatagtctccatgtccaggtaggagatgaaggaaggagggttaaggcaatactcaaggttatagtggggaagcaaaagatgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggtgggggattgcttgagatggtgactgcatgtgtttgagtttgggggagtgactatgaatagttggcagttcagtatagggatctgcagctcaaaggagaggtagagttgtagagtggatgagaatgaaggcccgaagagttactggttttgtcctggttaagggaaggagaaatctggaaaccagtgggctatcccggtgaggagcacagctcagacctcagccatcaaacaagtatcagaaactgcaagtgagttccttaatggtgtcctatgcaaacttgttgtcgtttgactcatatctaattctgagcgtaggctggttgcctcttgtccacctagaagtgactttaagaccatcactatgggctgggttcggaggctaacacctataattccagcactttgggagactgaggtgggtggatcacctgaggtcaggaatttgagaccagcctggccaacatggcaaaaccccatctctagtaaaaatacaaatattagccaagcgtggtgacacacacctgtaatcccagctactcgggaggctgacacagggaaattgcttgaactcaggaagcagaggttgcagtgagctgagactgtgacaacagactgagactctgtctcaaaaaaaaaaaaaattcactgtgaaagggagctcagctagtcaaagaatcctgaaatagctgtggatgcacagtgggtccttgtcatggggccaggcccagggtcatcagttagaatgcagttgtaaacatgctaatgctgctgcctggttgtatgtgctaacaactgcttagttccaaattctaacccaataaggagtttcctcaggggaaatgtatgactacagcacaaatgggctcagccttactgctttcccactgttaccccttcctgcaccagcgctcttctggtccgtgtgactaaaagccaaaacaccactttgcctaaccccccagatcctattagttttgagtctcatcaattctgtttcttccatttgtccttctctttccattctgattggtacagctctaagctaggaggcttgttagttcatccatccttactgcacaaccaggtgaatggaacatcctcctaaggcacttaaatgatatttgaatccacaggtcagcaaactaggacccgtgggccaaatctggcccactacctgtgtttgcaaataaagttttattagaacacagccacactcattcatttaaatattgtccaggactgtttttgaactacaatggtagcattcagtagttgcgacagagactgtatgtcccacaaaatctaaaatatttacttttgttttataggaaaagtgtatcagcccctattaatccaccttatgtatgaatgccagattaatgttcctaaaatgccatttcaccatatcattctgtagcttagaaccctgcaatgacattgcattgtccatgcaataaaatctaaacttcatggccctccatggtatagtcctagccaatctgttgagtcattgatctctgttcctaaaggcaagccctacaaccagttagattttcctcctcattgtccctggaatatgcagtgcatttctacccttgttcacctagttccttttgcttggaatgtattgcccatttgtatctacctaaatcctactcattccttttttttttttttttttttgagacagagtctcactctgtcgcccaggctggagtgcagtggtgtgatcttggctcatggcaacctctacccactgggttcaagtgattctcctgccttagcctcccaagtatctgggattacaggcatgtaccaccacacctggccaatttttatatttttagtatagatggggtttcgccatgttggctaggctagtctcaaactcgtgacctcgggtgatccacccacctcagcctcccaaagtgctgggattacaggtatgagccactgtgtgcccggccctaaatcctacccattcttaaaggactaacatgaactctacatccttcatgaccatgtcagttacagtgatcaccaatgagcctgctgcttgagcatgtaaaggtccactgcccatactgcctggtaagttttcttctgctcagagaatggttcaccaatatgatgatgggcaactctggagtgaggactttctgatggaacaaagtcacagctgtgggaaagcctgggaatggtttggaaatgacaagacatgtaatgagaacacatgacactcaattaatatttgtggaaatcttgagtcatcagcctctcatatctatgacatacatcttggttctgtatttaaatgtaggacaactacatatcttgatagccagtgggaatgactgacaaagtccagtaagtctactcttgagagattctagaatgtagagatagcagctggaccaggaagccctagctttatcatgtgccatctctgagatggtggatgtgggctgttcccactgtgcctcacttttcccatccactgtcatatattttatggtcttgcacacactctgggattaagtaacatcaattatgcaccattgattggagttctttggtaaatggtactacattcctaaaatattcatgtgtcttactttgtcagggagattatatccgtgacttagatatcatattctagtggcttaagattatgagctaatattttgtaaggtctgggcattgcacagaaaaccttggttgtaatacacattattattacattgatttgaatagcaatggtacaatcatagccccggaaacatagcgactacataaaataaaagcttccgttaacactgagcacagcagccaggcttccgcattgttgttgtccctaggatttggctgttgtattgtcaaatgccattatgtcttatctaataagtttctccctgcatatgtgagtaaacgaaaatgctccagtatagtaaatgtctcagcaaaccactcctgtacgctttggaaacagaacattaacaaggaaactatcatgagagcagacctttctgttctcatgaatcacattcatatgatgtttattgtccacattggagaagtatagagaagaaaaatatgaagggtacactctaatggaaaggttatagtggaaatgcaaggaaaatatatccctttacaaccagcttctaggcattacctagaagtaaaattatgacaataagactaacagcaaataacattgagcacttactctgtgccaggtattgttctaggccttttacgttacatcatcttatttaatccactccacaactaagtggtttggatgcagttattatctccactttatgtacgagaagaccaagacccagggaggtagaagaacttgtcagaagtcagacaggtagtgagtggtagggctgggagttggacccggacagacagattccagatttcatatttatcgtaacctcagctgccccacccacatgaaatgctaccccaaggctagtggcagcaaatataacccatttcatttgcattgtttggtatgtccaactgggtgatttgtcctacaaaatttgaaacaacgtctgcttatttatgtctgtgattttgatcaaataaatctcacccagaatttcccactgtcttattctatggtatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaaggtaagcagctgatcccaggaacctattccattattagacatgcagatcacactccggagagctgggcagtgcctgccctgccgtgaaggcgctgccgccaaccaaaccagcctttttcattcaatcaggaaaccatctcttggcttttcttgtgaatttctcaaattcagggcattattacagcattccaatttctgcaagcataagattacagtgtgcatgtggacagggtggagggtttgtgcgtgtgaagtgtggtggctatatatagaaattggatgagaatacttcacagggtgggtgaggcagcatttcaggattgtttctcccatgcataggtgctgggtgtgtttgctcagagaccccaaaagatatatttcacggaacgttctttttattcacttaaaaatattagtatttcctttcttgatatggagaaaagggagattaaacgatgtgatctgataaaagaacaacactgtgtatttcagattattcatttattttatttgtactttaacaattttgaaagtgttctgtgagagcaagcagttggtcaaagatggctttgaaatgatttgactcagacgggtctccatggtaccatctaaaaagagagagagagagagacagcacacaagagctgtttattttttctttaaaacatgatgcacttaagcatcgtaattgattacagctcaggagaaagctctgtcactgtcacaaggaccccactggttgcagaatgttgcttttcacatgttcagagaataatgtgaccacattccaatggccagccgggagttgttgcttgcctttgactgctcctgggctttttggcaggaaaaccttctcctgcttacctcatgttgctgtgacattgcctgcacagagctgcattgctcagaggactgggtgggaaggtggtgctgactttcggggtgatgctcggtatgaattatctagatttttttcaacaagataaacctttatggctacttttcctgtccttttctagaaaacaggattgtgctaaatgaatacccaaaatgagaaccatcagcaagcgagttactgattgaaaatagcagcatgacctatatctgcttagcatgtttatcagtttttgccatttaccttaaccagagaaatgtgcttaaaaggaagaaaagcagcatgatactaaggatattgcctgtttctctctgttcatcatataaattcattgacagatctttctttgtaggagcttgctctgtatccccggtgctgttgctctttccccacaacattcctgagggaggatggagggctaaaattagtatcctcttctcacagagagggggccttaaaaacacctaatagaactgagtgaattgttcaaggtcaatctgcacagagctaggtctctggctcagagtacagtccattcagtacggtgcttgtaagagaccaacatgtactaaaacctcagtgaatttctggttaaaggtgaacttttaaataagaggaccgaatgaaaaaagagaggctgctttgggctagacagcctcactttaagctcaacgtagttctttgcttttgtattccctgaatccagtcagggaataaacatatgtcaaaacatcaagggattttttttctttggtctcccttctcatgatcctgggtgccaaataagataccaagggctcatttattgctgatgtccagtgcagtattagtatattctgttcatattacatctattcatttttttatttgtttgtttgtttgagatggagtctcgctctgtcgctcaggctggagttcagtggcatgatttcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacattgtgatccacccgccttggcctcccaaagtgctgggattgcatattcatttttcgtctatgcatccattcatccatctttccatccatccatccatccatccaatcaacagaaacaacagtagaaattaacttggtcttgtatgcggaagcagtgaggtttttctcaaggacttggaaacaagggaatcagctagttctttatggctatcttggtaaaattctcacacagttgatgagattggctatctgaaggaacacccaacactcgcaccatggcaaccttgctattgcagggcaggaggtgggtgaggtggggaggactggaggtgatggtaacttactaagtggaggtgagtgcattgtatgtctctgggaaaggcttgtgtggacagaatgagggtgagttatttgccttgaatactgaaaaaggaaagctcagaggttccaaaggtggcagtggttgtctagtactatctgcagagagacccccagctttgggaggtcctgaatttctgtatgctggtgaggtggggtcagtggtaaggtgaggagggtcctcaggccacagtgaggcccaagtgaaacttccctcaggaccttgcctctctttgttctgaattcatcctccctataattattcagttattttgatatgaggaaagggttgcctgattgaaggatatgatcactttaggcactaggaaggaatatgtttcactttaaatcaataaactggtgactgaacttgaatagcatgggactttttccctgtaatcatccagtttgcagcctagtggcctcgcccctggatggaagtacattcgtggaggttatattttcttctctgtgagcctctccaaggagtcagccagttttctcctggtagcctgttagccaccgtcagtaacagtcaccatttttttgagtgcctaacacgtgcctggtactttaaacacataccctcaataatgaccacaagacagttattactctgtcttacagctatgggaacaaactcatgaggtcaagtgatttgcccaagaccatagagactataaatgagggagcctgagagaaactcctgggctgtctgctttcaaagaccgagctctttccaggccaccgttctctttgaaagaaatgtttcctttggaataattcatttagtgagatgccagttaccatcattgctgtctctcttactctaaatatattgtgatggactccagaaaatttagatcatgtggagacatgtcacagtgattattgaagttccttgaagtagagaatattaggaaatatgtcagtaatcaatatttgtttcactaatttgcaaaatcctagatattctctaagaaaaaaatattctccttgcattagagttagttgtcatgtttataagatataattttcatattctttatataattctcatattctatgtcttaagataaaattctcacatgtggcaattatcagatagcctgtggacacttattctcatgcaatgagatgaattatttagacagattcacctgtctgtggtcaaagcaaataaatagaatgcaagatagtagttttggcattcatatatatttttagaagacttacttattgcaatatttaggaacatatagtgagcaactctacaaaatggaatatcatcactttgtatatggacttcgagcaaattccacaatacagtaaaagactaaagtataaaatggtaaaatactaactgctacatcccagtgattaggaaacctcaagatactttgaactccaggccaaattaaactcagatgtatttttaaagcatccttagctatacgtagtgtggtgtaataatttctaagcattacaagtagaactagtaagcaatttttatagctatattatttttgatgattacaaaaggaaagaatgtataatcattgcaaaaactaaattaaaaagtacagcaaaatataaagaaaaaacatatgtactctatacttaccattcagatagaacccatgcagaggtaaatccttctatacttttttccccgatatatttctgtagattaagatatgtaaccatcattcacagggctcaccaacctgtgggtaaaatgaaattatattaacattagcattggaataacattaacctttacctcttttttatgtgggttctttttaatacccatacaaaaacttataatttttataaaatcccatggagcattcttttactttaggataactgactttgatgtcttccttgaaaagaatgtctccatctcaaactcttagctattatgtttcttatacttcaatagcattaattcatctagaatttatttacagacgaggtatgcagtaggaatataactttactttttactgatgctgagctgcttgtctcaatgtgatttattgattaattcatcctttccttcactgatttaaatgtcttctttatcacctacatatttctgacttacatttgagtctaccatttatggattatttttattccattaatctgcccattcctgtgccagtattgttctcatttaatccctatagctttttaatatattgtaatatttcataagacaagaactatcattattcttttgaaaaattgtcttggctttttatttcataggaacaattatttatttttattgtttttataatgagacttgtgatgatatggatttttttaaaataaatcagctactatatcatactagagcagaaggaatttaatatttccttctgtcccttggttgaattgccagagatttgtctattttattggtctgttcaaagtcccagcacagagtaggcactgagtacctactgcaacatgaattccttggagactgtcatatttacaaaggtttgcctgacagagttggccctgtcagaatcaaattgctaataccacgtcttcaatacataaactgcctttgaattacttattcatgagcggggaaccctcactagagttttcttctaatccaagctataaaaattgtcattatatttggaagaccacagccttttcttccaagaaagctgaatgaaaaaagatgaaaggctgaattgtgaccctgtgaaatatttgttgtcaacccactaaggtcatttgctgaagagcctgaaggtatcagaagacttgctacaaagatattacagtgtctttcccggttttgaacatttagcactaattttagactttttcttgttactgggatgtgtgaaagacttatttcaaattttaaaatattgaacagataggcacagtacacagtgtaaagtaaccttagatctcctcccttgtttccatacccagagcttgaatggaagttaaaacctgatttcttctatcagaagtcttgggtcggcttctccctgggtggactgaagcatataacaaaatctcaaaaccaaaccaagatcttatttattgagagtcaagaaagaggaaggaaagagtgggaaggataggggaagagaaagagggacaggacacagataaatgactgaaaacacaaacacagctattgcctcatgctgagtttaacccactttctgttagaaaactgaatttaggccaggcgcagtggctcatgcctgtaatcccaacactttgggaggccaaggcgggcagataacctgaggtcaggagttcgagaccagcctagccaacatggcaaaaccctgtctctactaaaaatacaaaaattagctgggctacttgggaggctgaggcaggagaatcacttgaacctgggaggtggaggtcgcagtgagccaagatcacaccactacactccagcctgagtgacacagtgagactccatctcaaattaaaaaataaaataaaataaaataaaataaaataaaataaaataaaataaaataaaattgaatttagccatattccaaccatcatccactagaatagccaatatcagcttcagccagattacaaatgaatgaaagatccagagtaaaaagtaaaatcatgaaagtacacaaaggaatcacaggtgaatatttttatagtgagggtaaggaagtcttatctatgtatgacatcaaagccagaatgtgcaagtaaaaaagattgccagttatgactttataaaaataacaaacatctgaccaggaaacaacaggagacttattacaagttctcattcacctcctacttccccaatctgccccacccagcctctccagacatgcctcactcttcaccggggtcacctcaaaaagtggtatctaggctgggcacagtggttcatgcctgtgatcccagtacttgggaggctgaggtgggaggatcatttgaacctaggaattcgagaccagcctgggcaacatagattccatctctacaaaaataaaataaaaaataaaggaaagtaagaaaagtgacttcattgcagttaccttagctgtagatgaaaaagattgggttagatgatctctgtgatctttttttagctttagtgatccaagattttatatttgctaaagtacagtgtatgtgcatgattttccaagaattcctcacatgtcagcctccgtggatgaataaaagatacagtcctgactgtgagaactcaggggcaagtgggggagagagagcatcaatatggaacccaccattagaggagctgaaaaatagttttccatgttatgaagtggatcagtggcacctgatgattttgtaaatcctatttgagcaaaaaagaaaaaaggattcttgggtgatcttacacagaggcaagatagtagagtgtacctcttggcttcaaatcccagatctacagctcactcggtgtgataccatggataagtcagttaatgttagcacctacctcatgggatgcttgtgaaagttaagtggatttacatgtaaagcacataaagcagtaagagttctataagaattatcattattgtcaccatcatcacccagtactatggctgcaaataccatttatgtatatatgactgccaaattgagaatcccagtcttccatgttcaactgcttttctgacatgtccgcttagatggatgtcactttcatttagaagcctctgaaacttaacatgcccaaaatgaaagattttattttctgcttttctatcatttgttctactcttccctgtctccagttgatgataccactattcaccctttcactcaaaccaaatatctatgcattgccctaatccttccctttttctcagcccacatctaatctgttacaagtcacactgattctacctccagaatgtaccaccatgccttttgattcttctgtctctcttctgtttcaagctaatattctctgtcacttgaaccatgcaataaactcccatcacttgtactttgtaatcctgccccttgcaatgtgttcttcctattgggcttagaagacacagcaaactccttaacaaggctacagaatcctacctaatctggcccctgccttcttctccatcttcagtttgttctgccctcccaccccaacctcacttattatggtccagccactcgggcatttgttccggtccacaaacacaccaaactctgtcctaccaccaggctggtacatttgccagtccctccacctggaacacccctccggatctcagatctcagcttgaatgttcaagtcatcagagagacctttcccactttaaatgtcctcccctggtccctctttgtcacattgtcctgtctacctcttcctaggcagcatcatagtctgagattatcttgcatccttgtttattgggatgaaggcttgagtgagagtagggacttgcctgtcttcctgagctgtgacttcagggactggcagagttcttggcacctaggaaagggataagagagccactgctcctgagttggggacacagaaggagaggatggggagttcttttagattatggtgtttgaccagccattgagaaagcttgtgtattcttcaagcatttggatagtcataggtcctcatgctgtgctactcaaatcgtggtcctcagtctggcattgccagtgacagcatcacctgggaggtcgttaaaattcaaattcccaggccttatgcgagacttagagaatctgcatctccatgggtgggtcctggaatctgtgtcttaggaagttctcctggtggtccttatgcatactgaagtttgggaaactcagttcttgctttttgttttccaaagctggccaggccagtagagccagaaacagatttactttgggagttccttctgtcctcctttcagaagcccctgtcaagtttccctttgtccagctgccagctccccacctgctccttccttgtattgacttgccatgatgacattcgtttgacaaatgtgaagtttgacagtccttagcaccttgggaggagtttgagaccagcctggccaacatggtgaaaccttatctctactaaagctatgatactatgttagctatgatacttttttttgatgtatgttatttagacaataaaggccacaaacagagaaaagttttttttaattttaatttttttatttctattgagctctgcttccgctaaattctgaaacactgaggcagccaatacaagctagcacagtataggggaccctgtgctttggatggtgcactcagtatacaccattccatttggagacatgttggagacaacataagggggatctggagtcagttaaggaagccttttgaattggtgatttcccctgaaagcatgactttggagccaagtagaaaatcaactatgctttttcggcttcttaaaaatgtctaaacacctttgtgaaacaggattctctgagaccaggcccactgccttttccagttttttttctttctttcttttttttgagacagagtcatgctctgttgcccaggttggagtgcagtggcgtgatcttcggctcactgcaacatctgcttcctgggttcaagcaattctcctgcctcagcctcctgagtagctgggattacaggtgctcgccaccacacccagctaatttttgtatttttagtagaaatggtgtttcaccattttggccaggctggtctcgaactcttgacctcaggtgatccacctgccttggcctcccaaagtgctgggattacaggcatgagccaccacacccagccccactactgcctttgtctgttggagcctctcttcctggctcctcctgttgggatgttcttaatgatgtcatgcctatatcaagaaaagagatggaagtagagggacatgcacctctgggtgaccagagtcaccaggctgctctggccagagctacctgctgatggtggcagctaagttggtgagaagtgaggggctagacccttcatgtgatggcaggaggcactgtgtgaagaacagcagagagaacattccaagagcagccatttacgttgcaagaagttgtggctgcagaacatccctgctggtgtggagacagccaggactgtccatggctgcttttccagaagggtccacaccaacgccaaggcttccaggatgtctatcccccagaatcctaaggtttttactatctgtggtttggacatctttagcacaggaagcaccctgaaagtgtggtccctacccctcccaaataattagagagaaggaaagttgagaatttcccagttcatccatttactcattcattatagggaattgggctacaattccattgactgaatgaataaatggatgaattgggaaattctaggtgacacagtgaatgtgaaggtggataaaggacagtcctagccttccaggaaccagcaggctacagggggaacagatgtaaaaagaaagaatttgaggatagtatgaaagggccatagagtgtgtctcagagccagtagaggtggaaggcttctctggtggtattttacttgttctttcttaggtaaataaagcagaggccaagggaacaggatggacaacaacaatagtaaacatttctatagtactaagtatgtgtgtggcccttttagcctataaactcctttaatcctcataacaaccctctgagctgggcactgctattttctccattttacagatgagaaaactgaggctcagtgaggcgaaggagcctgtccaagctcactcagctggtaaatggcagactggttccagagctcaggctgttagccactgttcagcatggcctcttgcagtctctaccctcttcctgagagtaaatttcagagccaagttatagttcaagaaaagcaaagcaataatcattcttctacttcagaattgctaccaatgaacaatttattttgtgcctacaacagattaagtatctgaataaaaatataaaaacatgaattgattaaaaaatggcctctcataatgtgcaaaacagggtctgtcggggaaattttgagaggtttttgtggagaacaatggttctgaatgttttgtagaaagagcaaccgatttgccccaccctttcccactttccaatggaaaagaatctctgataaagctttgataagcaaccaacgtaagcaaattgtactgccctcttttacacatgattttatactatcatacgatgccctataatgtaaaaactgtacattttaatacctaccctggtggtagatgcacactatttatacagagcacattcaacaggcagcatgtcaccagtgatgcatagctgtttacgcatattgaggtgtgggggtggatcctgtctataatcactgtaagagtatagttaggaataattctatgtgaacaaactcaagtctttaagcctaattattaaaaaattacaggtcaagtaccataaatttgcctatgtgctgcaagagtaatcaaagagatctctacaaacaatgatttgtaatgaaaaggcaagaataacatcaataaaaaccatggtcacctgaacccacactgatgatgtattgtcaacacagagtctctcctggaagtgcaggaattccaggttgattgaacttgctcctgggcatggagcagggtgtctacagcaccagatgacccctggacttctcaatagaatggtgaatcaggaccattagtgaagtctaacttactaatactaagtgttggtaatttttttttgagacggagtttcgctcttgttgcgcaggctggagtgcagtggcatgatctcagcccactgcaacctctgccccccaggttctagtgattcttctgtctcagcctcccaagtagctgggattacaggcgcatgccatcacacctggttaattttgtatttttagttgacatggggtttctctatgttggtcaggctagtcgcgaactcctgacctcaggtgatacgcctgccttggcctcccaaagtgttgggattacaggcgcgagccaccgtgcccagcccagtgttggttatttttaaagactcatcagttcataataaaatgcccttaatgccgcatacaaatgagagtctatggaattgtgcatccttcgctcataagagcttcagggagtgctccaagcctccattccctggctctcagtctttagaagagttctttcctttcacctcgctcaccctgcctgatgagatcaaacgaaattctggacagaggtgatgccagtgagccagggagccaaagagccaggtctttattctgtgttaggtggcttaatagtcattgctcctgctgttcctttcgttgcttactatttctgggaagaattgttcatgtgccctgcatcctcactgtggtcccctctggtgaccactgacctgcccatgggcatggtcactggtccttagccatgatgtacagggtcagtagctgctgccgtctgccatctagggaccatataagtggaacctgaatcaaaattatcctctcacatctacctctccttgctcttccttttagggaatttcaacatgcttttttctggaactgttttcatttcccttctcaaagcagtaattgctgcctccgaaccattgacctgaaacaaaagctttttattccactgtactgtatcgtagtacacttgcaaacatgggatgtatggtttttttttttttttttgacagggtctcgttctatcacccaggctggagtgcagtggcacggtcacagctcgctgcagccttgacctacctggctcaagcgatcctcccacctcagccttcccaagtagctgggactacaggcgtgcaccaccacacccagctaattgtttaattttttgtagagacaaggtctcactatgttgcccaagctggtctacaactcctggaatcaagcaatcctcctgcctcagcctcccaaagtgttgggattacagacatcagccacggtgcccatctaggggcatatgatttttataacatttggagattattactgaagatgattgggagtcattaaagaagggagtcattgaagaagagtcttgacaatctttttaaaacactttaatatggaccagatattaggtggtcttaggaagttttttaattaaattacagttgcatagaaaaatgttcttaatttttagagactcatactgacatattgttgggtaaaatatggttgttatttagtttaaaatcatttgatgagaaacatatgggaaaatatggcaaaatgttcataattgttaaatctagatgaggttacatggtcattcattatacagttctatttttaaatttttttaataatagaaaatgatatagagataaatctccttgggtgttgatctagagggaagtagggagccatgttagtgaggaggtgaaggcagcgattcaggcagcgctggtgaggggtggagctaaaacagcaccactgcagagggagaggacagtgtggactgaaaagtatcatcttgtctgttgtcttccctcacttccacagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttccagcccagggaacccatgctacagtttttcagtgcagtaaccactgctctcctctaggtggcctttctcaatactgttaccttctcctgtacttgagaattttcttcctaaacaaagcacattgatgttgtttaaacttttccagatgacccagagttatgacacagagtactaataattttttatttttatttttaacttttattttaagtttaggggtacaaatacaggtttgttacataggtaaacttgtatcgtggggatttgttgaacagattatttcaccacccaggtattaagcctagtacccgttagttatttttcctgattctctccctcctccctcccttcaccctccaaaaggccccagtgtgtgttgttcccttctacgtgtccgtgtgttccatcattagttctcacttataaatgagaacatgcagtatttggttttctgttcctgtgttagtttggtaaggataatggcctccacctctatccatgtccctacaaaggacatgatctcatccttttttgtggctgcaaagagtactaattattgcactgggctgtaatacagcacagtgatggcttcatgggcccacaaggtgttgtgagcagcttgccccttcactaggtgctccctttgagttcttatattagctttcatctttttcctccttcgggtcaggttgttagctgttattgctgctgtagtgagtctgttttcaaatttgctgtatttggtcaattcgaaatgtgaaaactgtagtcaacagtcttgggattgaaatgaagagtgtggaagtgctgagtgagagcacctctgtaggttatgtgcccgtgctctaaaaattaactttgtattgtctgctttcactgctcagagagtggtttctttatggttctcaaccaggatctgatcacttcaatctgggagataagcgacctgtctgtgggcaataactggccaggctcacacaagagcaataatgtaggtttttacttgggagctatagccactccaggtcccaggacacctagccagagagatatgagatagggatggaaggtggtaagcatagatgccttagaaccaaatctgtccctccaacccatcccaccaaattctacctgaaatctcaccacctggagcttcatctctgtcttctgagcttatgagctctttttttttttttttttttttttttttagatggagtctcgctctgtcactaggctggagtacagtggcacaatcttggctcactgcaacctccgcctcccgggttcaagcgattctcctgcctcagcctcccgagtagctgggactacaggcgtgcaccaaccacgcccagctaatttttgtatttttagtagagatggggtttcaccatgttggccaggatagtcttgatctcttgaccttgtgatccacccgccttggcctcccaaagtgctggaattacagacatgaaccaccgcacctggcatgagctcttttaaaataaagggtaatagctaagctgctaccagccatttataaccaacagcaaattaagactctgagggcacctgtaatagtgtcactaaagggaaaagcaagccaagtaaatcccaaaggcatacgtcagcctatgtccctactttgcttaggtcctcacatgtcttaaagagctttcagagcagcttggctaaacattgtgaaggaaactggccaagaaaaagtttggagggtttgtgtgtacatatacatatgtatactcacacacacccgtgtacatgcacatgctttttcttagaatacaaaggataaaggctaaactgttaccaaccatttatatcatatacatatatatatagagagagagtaggtgttattatagacagaaggcagaaaggatttggaaaataggataaaattagttacatgaccttttctatttttctttttgtttcttttttttttaagagatgagatctcactctgctgtccaggctggactgcagtggtgcgatcatagctcactgcagcgtcaaacttctggacttaagctatcctccgacctcagcctctcaaatagctgggaataaaagttcatgccactgtgcctagcattattattattttttttttttggtagagaaagagtctcactatgttgcttaggctggtcttgaactgctggcttcatgtgattcttcccactcagtctcccaaagtgttgggattacaggtgtgaaccaccgtgtccgtcctattctgtttttcttaagtgtcactgggaaacatggtcttccaatcaaattggcagtttaaccttggcttgaatgcaaatatgttgttattatggtccaataggtggtaactcgcacttgtagaatgagccattgcgtgtggaggctagagtcttaaactgagactcagtttctgggtaaattgaccattggaaggaggtgttgtgggttaggggctggtttattattcaggtggtcatgattatactcaaagaaaagttgttaaagttctttttatcctttacgtcctttacgtcaatggaataaagagcacactcaatgtatgcaggcagtctcacccatttagagctagaatcccaagccagaggaaggaaatcacaatagcctacaggggtggatggtgaggcctggattcaggggccatttcttgtgtcttagtcatgactttgggccaaatgggcactggatgtgtgctgagatgagctgtgctccctggagctgctttctgtaggagcaggactgtggtgagcatcgtttcctctgcagggccttctgagggaggagtttcttctaccctggaagtcagcttctgcttctcttcatcttgctggcatcttctctaccacaatggttattagtgtctttaatcttcaatcccatgggaagaaagagctgttatctctcttcccataaaggacactcagtcacctaagacatttctctgtagttgaacatagcttagttctcactcacagaatgacatttgaatagttctaaaggctcattgcaaacatgagcaccctacggtgttacaaagtccctgtggattggctggcatggctctgctgatagggctgagctcacctacgtgactctaatctgcgtgttgcctgagtccactcttgtttaccctgcactaacaggctaaccatgatgctgtctctttctggcaatgggagaggtacaagagggctgagcagaaacaaggcctaggctcagactgcccacaagccatctgccaaaccaagtcaatgagcaagcccaaaaccaagggaagagacagccagccaacttttagtggaaggaacacagatcagggaagggtgaagaatggggatgaataattcagttttccaggagcatgattgttgaattgaaaactgcaagcattcaggaaaatggaccggcattagggaaactacagaaaagacatttaaaaagaaagaggactggctgggcacagtggctcatgcctgtaatcccagcacttagggagaccgaggcaggtggatcacccgaggtcaggagttcaagaccagcctgctcaacatggcaaaaccccatctctactaaaaatacaaaaattagatgagtgtggtgatggtcgcctgcaatcccagctacttgggaggttgaggcacgagaatcgcttgaacccgggaagcggaggttgcagtgagctgagatcatgccactgcactccagcctggcaacagagtgagactacatttcaaagaataaaaataaaaataaagaggactaactaaaacaatgcaagaatgcagagagaaaggaagaagagagtaagagagaatatgagtgacttcaagatcaaatttgcgatctgatctttatataataggaatcttgaaaactataagatcagatgcagaaccattaaataaaggcattttaagggaaatcttcattactcaaggcaaaacattaatctgtagatctttagatttgggccccctagtctaagtcacccccagcaatcaattagattctcctaaagagatacataaactggttgcaaactataaagtatattagtacagttgtgccctgaaggtattttcgtccttgttgttgaactaagaatagcttgaagacactgaaggaggaatagagaatagtaaccaaagaacaaggaacatttctacaaagaaagactaagggaaattgggccatttagtttagataacaaaaggataatggtatcataactcagaacttcaagtgtatgtaggatctaggccatgtcttaattctttatgtgcaggccattttgaatatggcaaagacttcaaataaagcatgcaaatttctacttagatgtctatttccctagatacctcctagaagaaagaacataatcaccttttaattcttattctgtgattctttacagtgccagtaactgtacaagaagttccaggtttacagacatgtttttttccaaaatgttatttataaattggtggtggtttggaagggcgaatgttgttcctctgccagaattattatatgtggtgcttagcttttgagggcagcccacgaagaaggaaggaatggaggaaggaaggatggaaaaatgtaactagaatattaaaccctgggcattagaatcacttgggaaggtttttaaaaataagaattaccaggcctcattctaggaaatttggatttagtgatccaagtaaggagtcctgtaatctgttttttaaaagggtgttccagataattctgttgtatggtcaggttcaagaatgattgcagtaaatggaaaaaaggatagaccataaatgaaatcccattttaatacctagaaaccccccaaggagagtgggaagtaaatcatgtttataagaaaactggcttcacacacaaggataaaggacaacccaacccttgattcagactgtttctgagccttcctactttgacccaaggatatgtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaaagcaaaatctgtagacgtttccttttttgaattttttgaatgtccacatcttctgtatgctttgcttctttttggagtgacgtattgagaaagcccaagagattgtttctggcttgggcccattgccagccattgtccgtgccattattgtgtgtggtgggtccctggaggccacatgtggacctcgggttgatactttcggagattgtaggtagttcgagccacactagccctgtttacttcatgtctgccccaagcatcaagtcttgttgtttaccttgtcactttcccacttaagattctctttcatttcactgggttttactaaagtgtttgaaatacagggtttttaacttcctttgattagtgagaaatatggggaaaatttatctcccaaccttatcagttgggggcagaccaaccccagtgaagatgagaaacttcatggagtattaaatgaaaatgggatgagctgtcacaaagccaggatgttaattctagctctgctgatcatttgctgtgtgaccttgggcaagtcttttgctctcttcagtctcagtttcctcatatcttcagtgagccatctctcgggatcttccagctctggtattctgagtttctctaatttgaggagttggttagagatctcttttctcaacagtgtacctgttccgagaaatgttactgttatagaaggaagtggttttggaaacgggtcagagtggaggaaagaggttgagttctcaaaaaactaaaggctaggtataagtaactgattcatcacagagatgactaattcatcagaacagctgtctgttctaaaatatgtcacatcaaatattcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaacactccacagtggcattccacatctgtgcacttccagccggggtccccaccccacgttcagccacatttgcagcccaattattgtttccattcttttgtttccttccaaaataaaactatatatgctatgtatacagtaaactatatagtagtgtctctatattgtgtaatatttcctgttttgtcactcccttctgggtagcggcctagcttttctgcctccatttaattcattaattttctaatttaagccttgtaatactcccatgaggtagtgatgatgatgatgatgatgaagagagaagagaagcacaggaggtgaagtaacttgctgcccccccctaaaaaaattcaatggaaggacatacaagatgaatgaaaaataattttaaaaaagtgaaagagcaagtatttgaactcaactctgcctaattctaaagcatgttctcaaaaatcccaacagaagttgttattttaagctaaatttttttgagacctctgatattgagtgaaattacactaacgtgcacctcgtgatgtaggaggagggacaggtaatgtgattctccctcctcaacctccacacatgcttcttcagaaggcggtgcatcagacgcaccatgactctggaggtgccggtcttcagcctattgtgggtggtcatcatgatggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtgagtggctgtcttgagtattgcaagatgtttagtagcatccctggcctctacctagtggcttccaggggcaccattgccctttcccagtcatgataataaaacatgtctccagacattgctgaatgttgccttgggggacaaaatctctccaagttgagaactactgctcaaaagcctggcattatgtgtattgatactaagatgagaatctcaccaccgagtagttccagaatacagaaccctaaaaagatttatgaagataacattagtgattctcagtgcaaaatgacaaagtgtttcagttacttgaaaataaaaggcttctcttatgcactgagccatgaaagtctgttcagagttaaaaagaaatagttgcttttttggtttttgcattcagtattgtgctgcttttgcaaaggcaataattttatgacagttcataaaaccatggaatcttagagtatgcataactgacatgttatgcggatcaactcctatctgattcttgaatttgcaatgaacgtaatgagtgggagtgaaaaaacagtctctccccaaagcctgaaagtgacaggaaactcatttacttgcaaaataaaacccaagtatatactggaacaactctaattattacagaggatcctcctttgggatgaaagttttgttccctgcagctcctaccctctctctggtccctgccctatcctccaaggaccacacagaaaaagccctcttcactgactgaaaaaatctagatgcttagggtttgtggtcagctttgcaagctggcacaggtaagggaggaaacactctgaaattgcagtgcagcatttcaacatttcatgtgtgttacttagcaacaatagcaggaggcctgccagatgtaccagagtcatcgtgcctcgctcaggttttgtaggatccattataatcatctcattattggtctggcaaattgggtttatagtgcccagaactatgaaaatagtagttgaatttcttccatacactgaggccatgtaagagccatatttgggaaatacatgcatttcccagccctcagaacaattgctgcaatggaaggaattctgcaaagtcaacttttttggtagccagttccaggctttttggcctatgattgccacaccccaagttttctctctacaaaaagctttgataatagtctttttccaattttaggtcaccttgcatagcccctctggcttgtaacgtggtcatttccaaccgttctacattcttgatgaaatgaaaacagcaagcttcctgttgacatactcttccacagttttcatgaattatgcattttgaaggcagcagacaagatggtgtctcagtcctttccagcgattctccagcatggaggtcttatttggtacatccatcacaagggcccggagccaagatgatctcttgagcacaatccccacttcgtgtttccccttttcactgtgtaggccacagggaagagtactgtgggacccgaggctgcttgatactcatcaaggcccgcttcctccagccttcctagcttctctttccctcaggtctaggcgtggagccctccaggacagcgaacgggtgataaaatatacaaactgtctctgattatgggattttggctccttagccaatgcatgcaaggatggtagaaaaaacactcatcttccttctactatcctaaaagcaacttccgacatcaagaatttttttggatctctcatccaaaggtataaaccttaacagtgggaaattcagaccaggtgagaggaaagggttacacactaagagatgacttaggtttgggtagtttcatcaggagaggtctgcctgcatcctggttcctgtccttgttttgggaaactctttttagcatacttggagtacatattcagttaaacttgcaaagtgaagaatcagagaatggaggcctaaatgtgattcacctgaggccacacgcagagtgaggagataccagtgtgcttcctgcagaagcatctcccacatctctgccaagcctttttatctcctttgaaacagaatctctaatggaataaaccactccagggatcctagagtcttgtgtttgttcctcctatgcagaaaggcaaaggaaaaaattaaataatatctgaataccgcccagtgcacagagagtacctgtgaaattacagggacattcagccagcaaagaatgtccccctggccagggtgcctggaggaaggcttttaagcattaccatgctgtacagcatggggctgccagcttgaccagattctagctggaaggatcaggcatctttaaagaccggtagcattcagggccattgctgggccacatggctcctttgtgcaattagaaaatgcagttccacagggtaggcagcacttagaaagccactggctggacttcacctccctttgttcccttggctagcatcttgggcaacaacattctgtacaagcatgcaccatggccctgctggcttcttggtctccacgtgcctccttcttgttggtcattaaggttatgccattttcccccattattaagtaatgtcaggtaaggtctgaggagatggagatgaagacttttacaggtcgcaggggaacactgacatgtcactcatcattttgtgtgtgtgtgtgtgtgagacagagtctcactcactctgtagccaggctggagtgcattggcagaatctcagctcactgcaacctcccatctcctggattcaagcgattctctcctgtctcagcctcctgaataattgggattacaggcacccgccaccatgccaggctgatgtttgtatttttcgtaatgatggggttccaccatgttagccaggctggctttgaactcctgacctcaagcgatctgctcaccttggcctcccaaagtgctgggattacaggtgtgaatccccgtgcctggccatcacccatcaatttttaaatggtggagtagctcccatgatggatgttatgaaagggtctatgggtgcatatgaaagggagtggtcattactactcagtccaggtaaaactccctggatggagggtgaagacaatgtggtttgagttgttaggtaaatgtttccttatcatttttcattatatgttacatttacattctgttcatccctaagatataactccttaagattacatctctcagatgtaaactccaccagagtaaggactgtcttggttacctactgtgttcatttcctgagactgatgtaacaaatttctacacgttcgtggcttaaaacagctccagaggccagaagtccaaaatcaagatactggcagggctgtgctttccccagagcatctagaggcaaatccttccttgcctctctcagcttagtgggtccagacattccttggcttgtggctgtgtcgctctaatctctgcctttgtcttcacatgggcttctcctcttgtctctgtgtcttctcctttgtctctcataaagacccctatcattggatttagggccctcctaaataattcaggataatctcttctcaagatccttaaattaattacatctacacagacccttttatccacataaggtcatattcataggttctgggggttagggtgtggacatatctttctagggccatcattcagtgtactatatctgagtgcctagattactgttttacacctaggaggttgctcaataaatagttttcaatttaatttatatgtttcagccttagtttatccataagcttgccatgaggttcagaaaccatcatttatatccagagatggtataaggcagtggttaggggcatgaacatccgcgtaatacttgctgggttcaagttcagaatctctgcttgctgcctgtataatttgaggcaagttctttagcttctctctacttcagtttcttcttctataaaaagaaataataataataataaagatcaactttattggggaggggtgactattaagtcaagatatgcaaagagtacccagaactgtcttggactttgtgcccaataggttttggcttttattataaaaataaaagaatgatatgacaatgtacaatatataaacaatctcaaattgtttgattttatcagactccctctccactttcagaaacagctgagagggctgtcactgcactgagattagcatggcattccagaactcgggcccggtaagcatccaggtccaagggtgccttggaggggtacacctcacctttgcagtccagggcagaggaaggcagggaggctaggagtgcagcactgagagagcagtggccactgccttacaaggccaagaagcgtcccatctccccaacaactgtcaggttccttcctgccctgggaacagctctaatctgtctgtttaccacctacctgccagccttcagcaggaattccaggactgctgggcctatcagctgaagtagaggatgaaaaagaacaaatccaaaggcagaagaaataggacaatatgatagatggatttgacaagaatccagaccaattgtgggcagaccaagttgaaaagcgtgagaggctagagttatctcagcaggggtttcgttttgttttgttttgtttttgagacagtctcactctgtcgcccaggctgaaatgcattggtgtgatcttagctcactgcaacctctgcctcctgggttcaagtgattctctcgtgccttagcctccagagtagctgggattacagttgtgtgccaccacacccagctaatttttgtattaacaccgtagagatggggtttcaccgtgttggccagggtagttttgaactcctgagctcaagtgatccatctacctcagcctcccaaagtgctgggattacaggcatgaggactgtacccaaccatctcagcagttattttaaaaaatgtttagccttctgatgagaacacgtggacacgtggtgcggacaacaaacactggggccagtcgagggggctgcggggagagagatcatcaggaagagtagctaacacttaggtggtgggttgatctgtgcagcaagccaccatggtacatgttcatctctgtaacaaacctgcacatcctgcacgtgtaccccagactttaaaataaaagttgaaggaaaaaagttcacttttctgctttccagttgcttatttaaaaaaaaaaaaaaaaaaaaagaagcatctggctgggtgtggtggctcatgcctgtaatcccagcacttcgggaggccgaggcaggtggatcacctgaggtcaggagtttgagcccagcctggtcaacatgatgaaaccccgtctctactaaaaatacaaaaaattagctgggcatggtggcgggcacctataatcccagctattcggaaggctgaggcagggagaactgcttgaacccaggaggcagaggttgcagtcagccaagatcgcaccattgcactccagcctgggcaacagagcgagactccatctcaaaaaacaaacaaacaaacaaaaatgcatctaagttgtctgagtgatgtcctgctcaagtccataagggacttgctttattacagaaaagtggccaaacccagtaatattgaaagtatggtccagggactgcttctggtcaggcaactgtttattaccagtctgtgacaaagacagaaattgccagtaaggtgtttagaaactttaatagcaatatgatatcccaatgggtgatcaatggacccatcttactgaatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcagctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaagaaaaagaaaaagaaaaagaaaccattagatctcatgagaactcactatcacgagaacagtatgagggtaaccactcccatgattcaattacctccccaccaggtccctcccatgacacatggggattatgggaactataattcaagatgagatttggatggggacacaacgaaaccatatcaaatattaatagagtctggcagggaggaagcatgacttcatactggtggtgagtcagaaggggcatcttcatattttaaggaaggtggcacttagattccaagtgcgtcctgtgtgcagtggagtcatatgcagctctaataaagaacattattcaggccaggcatagtggctcatgcctgtagtcccagtttgttggcagcctgaggcgtgaagattgcttgagcccaggagttcaagaccagcctgggcaacatagtgagacctcatctctacaaaaaatacaaaaattagccaagcatggtggtacatgcctgtcgtcccagctactcgggaggctgaggcgggaggatcacttaagtccaggagtttgagtctgcagtgagctatgatcatgccagtgcactccagcctggacaacagagcgaggccctgtctccaaaaaataattaattatttaatttaaatgttcgaaagaacattatgcagatgcttctcaggcttctcttcagatggcaaaatctcactggttttcaaatatcctaactgaaatgttcagttccagctatcttttgcttcatccagtaattagtttcaagtttttttttgcctctttttagatatgaatcccatgctaggtaacaaattatagtgacaggaaaatgtggatttttccataaagtttaaatattcaccactcaaccttttagcagaaagctctgggaccaacctagcataagtatagagttgagggttaagagtaagcattcttcccttcgtcacttatgtggccttgaaccaattagttaagattttgtgcctcattttcctcatctgcaaaatggaaataatcataaggtatactttggggattagtgtgaggggcaaatgagttaacatgtataaattgcttaaaatagtatttggcagccaggcttggtggctcatgcctgtaataccagcactttgggaggctgaggcaggtggatcacgagttctggagttcaagaccagcctggctaagatggtgaaaccccatctctactaaaaatacaaaaattagccgggcatggtggcgggtgcctgtaatcccagctactcgggaggctgagacagagaattgcgtgaaccccggaggcagaggttgcagtgagccaagattgcatcactgcactccagcctgggcaacagagggagactccatctcaaaaagaaaaaaaaaatagtatttgacaatgacgatagctgctgttattatcatgacccaaatgctatatttgcttcaagcaaatggaatgattctcagaccaaattttttcaccaggcatttattagaaggaggtttcatgtaattctgaattatgctccgaatcatattcacttcattcaatatgaaaagcaagtatagatttacagtttaattgttttgagacagggcaggattcctaatcacatttttagaaatgacttttgtgtctcatattgttcatctcctctatcctctcaccaagattccactgtgtttcataccagcttgttcagttgaacaaggtggagaagcccatttactgtttggattaaatttttttatcaccagtgtatgaggatttgcattaaataaattataggtaattacattaacaaaccaagaagacttacagttaaagagggcaaaaatataatttacttaactgctctatgaaatctatttgtggatttctctcttctcaaaggagaattaatcagagaacaactttgttgttattgttgttgttgtcgtttaagaaaaaaaagaaagaatgaatgaaagatcacatagtagcagtggtaccctattcaccttgcaacagttgtactctgcgcacctgccccaggttatagcaacatcaaggtcaagctcccaatatttcaagtacaaataagacttcacctgtgcacaaacatgtgcttacacacttccatcctcctgaattttctttccagactgttttacagataaggaagcagctctcaaaagacctctctcagacatttgaaaacacattttttttcagagtgctaaattcatgcttcttattttatatatgttagaaataaacacataaataataaacagtcttgcctggactggttcatgttcaattcataggcactgagtattctttattaggacatactcactattgtttgttgaattattgcacttttaagaaatcaatctgaagattaaacattaggagtctcgataaaaaacaagtctctatactttatgaagatcttaggaatttctaactgactttggaacagccatttgttaaaaaacactttcccatcccaaactccactgactccatttttcttctgcactaactctcccttcctcctcccccatatttggagcagcgtctctatgtcccattcactctcctacacctgccaaatcaccagtgactatttaggggctaagtgcaaaggagacttctaaatcctcactttcatcaactgttgagcagcaacggaagctgctgaatgctccctatttcttcttgaaacacactctctccttgtttacttgagatgacactatccttcctctgtccatctgggaaatattggtgctttgaggttcttgacttggggctcctttcttcacttctcccattctctgagtgacattgtctgttcccatggcttctgaaatataggcattctttgatctaattttttctccagacctacccatatagccaactgccccctaaccatatccatttggatccccccagacacctataactcagcatgctaaaaattcattagtcattactttctctgattgattccttttcattgattcttaatctcattgaaaaacatcaccatgcacccagttgcccaagtctgaaatcaggacattgtccttgcttcttttcaccctttcaaatcctctatctaatcagtaattttatataataaaaggattcttgattccttctacactttttctttcccacttccatgacagtagtccaggccaccattatctttcatggggattgatgcaagagcttctcacctagtctcccttcccctagtgttgtgtccttctgacctaacctctgccacccagcagaagtatctttcaaagttcatatttgatgatgctactctccagcttcaaaccctttacctgttttccttggactataagataaagttcaacttccttaatttagcttagagagtcttttatgatgtgacctcctcttacttctctggccttgtctctcataattgtgtcattccattgctgaccactccagcaactacctgccattccttggatgtaccaagctctgtctgtgtcccgttctttggatctactgtcccttctccaaggaacgttcttcagctgctctttatgtggttaactcctactgaaccatcaagtctcagctgagataccactttccctgagccctaaaccctggtttaatgtttcctgtgggcatatttaccttagagcttactgtgtcatagtacattggaagctgatttttttctctatcctcctctagcctcagctgcctaggggtaaacacactacagtgttcacccttgtattctcagatcttagtacactgccaggctcaatgggttttcaaacatatttacataaagaaagaaaacaatgacaaaagtgcagatgacatgcccatggatactctggacataaatgcttgtaatatttctctctgtaagcgtttccagtgggaagttcagcttttgtctcaattactctgattggcatgcaatcatgacaagaaactaaaggaaggagattgttttcttgacatttactgagaagtatagacaagtactgccatgaacaaacattcttgctaacaattcttgctctaaattggttgatataacatccacttgagtcaaaatgattaagtaggtatccattgagtgtcatgcatcgcaatggcaaagcattggagttacagaaaataagtaaaatcatctcccttgctcttacagatctgacagtctaggcacccaatagatgggtaaacaagtactgagagatgtcatacttgtcctcaagatagtagaaattcaagaaagtagtgaccatggaggaccttaggatttgggcttttaccccagtggtgtttggctgagttaatctttctaaaatgtattcatcattcaatcaagtgcttcttctggaggccaagcataattagagatacagagatgaaaatgacagtcattaccctcacaagacctataatctacccaataataatgggaggcaagcctttagagttttttaatttggagttttcagagatttcctgaagcttctggactgacgtttctattgtacttgagtcccatcatttgacattagaagatctccttccaagaaatatttcttaccaccaaaagacagttaactttgacttcagacagaacattctggtctgcacccagaacctttaatacctgaatcttttaaatcagtgatggtctcttcttctaaaaagtaaaaggtaaatcaaattcagtatgtctcaattaattggaagggagtttcaagctcataggaaatgaactacgaagccatgttgggatatgaactgaatggttgctattgagatggagcaaatgtacctggatatcattaggtggaaccagactggaaaatgggggtccttccttgacctcagtgaagatttggccctttcagcctcaagtagtatcccagctccagaactggacctgagttactggataatgctgtcattaggaaactgtgaccacctaggagttggactgctaaatgggcaatgtcagcaggttgttacagatactctatgcagaccaagcttatttggctcttctcagctcagccacctgttgtaaacagctgagaggggcttagctccacgtggaggttgtcactatctctggtatgttgtctctccctgggaacggacatgagtgtggaaacagggaggacacagttgattcctgctttcactgagtcactctgtccattaggagaaacagtccaggcatggccagccaaagggaggttcttcgcaggatcttctgtctctttgaagatgggataatctcaggcctaaccacagaagcagttctggagaagagtcagaatagcagattggaaacagctcacaggggcctctgaatgctaagtggagggacttagaatttatcccagaggccacagaacactattagaagtttcagaggtataataaaggccgttgtgaggttaggatgctggttcaatgtcacaattagagcaaggcaggaggtagagaagtcaagggcagactgggaaccagctgggcaggccactcattttggttgaatttggcaagactgaggaagacaatctaccaatagaggatggatgagaacaccagaaagcaaataaaacaagtcattcaaaaatcccaagatcatcgtggctgggccagagaaagaatcagacagaagcagcgcacggctctggagagttgcagggagaagcattgctgcatccgctgtctccttttctttttctttttttaaatatcagcaatatcttggatctgaatagagttctatcacagattagggtttctctttccccagggttcccaaagactgagcaggatcttattacagatgcagcgaaaagggtacgtttttcagtatcagactgacctcatctgaatctcagcctcacatctcattaactacatgggaccttgggcaagctacttcacccatctgcaaagtgggaatcaatgatatgtatctcatttggctgttgtaaatcttaatcaagttaatatatgtaaagtgtctcatcagtgcctagcgcatagtgagttcccagcttctatagcaccctttcatctttctctccttacagcatcagagagcttgtcctctgtggctcccgtttctctctggccagaggcagagcctccatgggagcatgggagggatataatcagaacagcagcattctttcattatgacgtcaattcagccatccctcaatttactgagcccctgaaaggccatacagtgagccatcattgtaatgaagtaaaagtagctggatactccaggaagcccttctagtggcactttgttaggtgagatgtgtcagcattgacttcttttgtaagtgctacttctgttgaattcaatgcgttgaaaggtggaatgcattgatgaatgtattcagtgccttggccacttctcagttagcttttagagtagaggacctcatggccacatgacagagtctaactgtcagtttccagacatttactgtgcccttggccctgcttggactttggaaatccaaagatacatatgaccgacgcctgctctgggaggaattccctgtccatgtggaacacatctatgcccttctggtccaagtgagaagagaacatgaaggagcaagtgtgcatgcccataagtgccggtccctactcagttctcactcagtcccacagatacccaggtctactttatgtaggtccttgtgttggtttctggcattgctgagatgacagaggccccagtctctggagcctcagagatttcatggacacctttttctgcttgagctcatgagccagatatcactcctggcccaggtcactgggttaccagatgcacgggtgaaagagctgctcttgagcaaagggcctgggacacacatgccggagaagcatggtgagccagccgcagggaggaagagcactttgcaggagcatgctgtgcggggtcttgctgctgcttttcagaagcaggagagccatgagccttggggttcacatcagcaccgagactggcctttggtggcagggaggatatgcgtaccgggaggggttggccatactggaccacagggccactggttgggttgttcataattgatctttggggacacttactgcaacccatttattaggtgccccctctaaagtgatgatctcaatgaagatggttcacataggcccactacttctagaaggcccgaatccctggaccttcccaaccactttttctccctgttcctgggttacatggcttagctggatatttttgcacacagcattaagggcaagtgcactgttcctttgaaaacaacaagggaacaaggagttcagtgttgtggacatttaatgaactttctcctcctaagtacacaataccaaatcagcagaatcacagctgtctcctcccagctttacctaaattcccacatgtgctacctcagttagggaactatgacttcacctgccactagatggccctccatgtgcacataagccgctcccacatagcgaacttgcatcagattttctggatttttttttttttttttacatgtagacacacatgtgcatacacaatcttaacttttaccatccttgaagccaataatcaacactttagttttccttctggcattcaaatgatagaatgtattctcattctctggaaaatcagtttaacatcagaatctacagatattcctgaatattgtgggccacaaagcacatattaagatgaatttgaatttattctattaaatagtatgctttggtttatcttataaatgctgtatttaacagacttgtttctaaattaaatttttttaaagcactggaagagaaaggaagcacaaacatttgaatagtacttgctccatggaggcgggcagtgttctgaggtattttaaacattagctcatttaagcttcataactttgatgtaggtattccatatgcatcattataaccattttatagattgaggagaaaatcagattgcagcatgaaaggtgtttagattcccttttgccttcctgtcaattttcttacctataacatgggaataaaataatccctaattgctgtgaaaggatgttgtaaactctaaagcattacacaaatgttgttattattattatgacttgggtttcatgggaatataattttcttatgtgctcaggaggcttgtgatcattcattcattcacatgaaaacatttatgcaggtcccaggtcattgcctctgcatgagacgtctcataccgagatgcctgtactatttctaaaacaaatctagtctgtcttgaactctcttatagctgagggttccagggaagttgctgtgtgctttcagcaggtaattctcccttagtctcaggatttagaaatgatggatgtggtaggacaacttcaggggtgggacctctgctgaacacagaggtggccggtgctgatttcacataagccaagccagcgggaagaggcaggctgttttttaaaattattattctggagcacgatgtactatctctgtatccaagagttcacatttcaagtggactatcagatcatctctgtgacagagggctttaattaaaagcataagtctctgggtggattttaagtggcattgtttttctttggacgttatgcaagccacttctgtgctgtaaaagggcttttaaaatttggcttaaggaaatttgctttacccctcaggctttgatccctgcgtgtgaatcattttgtatctggaggttccaatttgcagtctcctgggtgtaaggaaaattctaccctcacagaacattttggatttgaaaactgagaaatctgcatcattctcgacataatagctgttgtaaaatagaattagggctgttaagtctatagggataaagttcaccaaagaatattttaaactttagttttagttcctaaagtttttgtctccaactcccataataaatgtactgggacagtgacctacccactcaacacctgaagctcagtgttctctgcactcaggccaggtggactcagccatcgaggccattgtccctgtccagcctcccagggggcacgcatgagccagggccaggatacagatacttctgcctcaacaccatctgtaccaccagaaaagggccccaaaggcccttctcactgccatttgtaaggcaaaatgtctctattttatctaagacaggaaaaaggcagagagatgccagagagaatgcaacgactgtgcccgtgagaaaccaacagtgcagggtggcgatctacccgcagcacatgcaggatgcagcgttagatgctgactcagtttctcagccatacaggagaaaagtttcagcatttctcaaactccatgaccatccttcagtcggctaccccaagccccgttttgctgcagccgggtgagggcagtaatgcagctcagtaggttaaggggccaggctgtccttggacttcagatgatatcagttcagtccctgggacatcttaaattagggcctcaagcttcaaattcatgccttggccaacacgttaccataaatgatcacagggagaagaaacagtcaggccagggatggtggcaggttcctgtaatcccagcattttgggaggctgaggtgggaggatcacttgaggccaggagttcaagaccagcctgggaaacatagcgaaaccctgtctctactaaaaataaataaacaaataaacttttttacaaaaaagagaagaaatggtcagtttacgttgcatttccttcttttcctcaagaagaggtgccccgtggtgcctgggacagctgggccatcacatggaagtggctgagaggtgggctggaaagaagaggaaaatccagggctcccaccaaccccagccaatctctagtcactgggcaacctcaatctacttctggtcatagttttacaattttgcgggggtaggggggatggaatcttgctctgtcacccaggctggagtgcagtggtgcaatctcggctcactgcaacctccaactcctgggttcaagcaattctcctgcctcagcctccccagtagctgggattataggcctgtgccaccatgcctggctaatttttgtattttccgtagagacggggtttcatcatgttggccaggctggtcttgaactcctgacttcaagcgatccacctgcctcagcctcccaaagtgctgagattacaggcatgagccactgtgcccagcaatagttttacactttaatattgccaactttttttcagcccagcctgtgcagccacacaaatgcaaaaaggttagcttaggaagttgtcaacatcattatactataaaaatcaataaatggaaccttcttgcttcccacagtagtccatgctaagcttggcttcaccatcccttgcttggacaactcctaattgttctttatggtttcactctgtaaccctttcatacatccaaatccgttcttttcacatctgtccacatggtctttctagaacatagccaatcctatcactgacttaaagcaaacacataaacaggcagacagacaaacaagaaactcaaatggctttctgttactttccgaatcagactcattagtgtggcattcaagagccatcatatcctgagcctgatcctccctgtcactttctttccctcatgagtgcactcagataggccagtcctacagaggtcctcattcactcacttgagcctgccttgcacatttctgcatcaaagcccctttgtccatgttatcatcctagcttgaaatgctgtctgaacacctctatgccttgatcatttttctcttcaagatcctactgacatgttccaacctcctgaaatcctgccctgcctccccacaagcagagttactcagactctcttctttgcattcctgcagcattttggtcttgcaatttgagctctactgtgcactgcattgtaactattcatatagcttcctccctcatgagatgatgaatttctcaaaagtagagactgggcagctgttactgaatatagcccaacacttgcttgataatgctcgataaacatgaatgagtgacccagaacatttcaaacttcccttccaagacctgaaagactcatatttctgggtgttttaagctctgtgatttctgctctggtcacctgggccaggaactgcctgcctctattttcatttcaggcctttctctctctgccagatgccttgatctctgagccgagtataccttgacccaaagccatgatgcagccctcagcttctgagaggaaggggtagggttcagtagttgcgcctctgagaacatgacagagaacaatagcaggaagcagccaagcgggaaacaatcagcccggcacaacccatgtggaggagcttcctgattggcttgatctggtgggagcaggaactcttacaataactctggaattatcccagtgggatgacaaatttctccactgaggagaagctgtcacctggtaatgtcaagcacggaaaacacagttagcaaaaaacaaaacaaaacccaagacaaagttctcttgaggaagagcagtttggatcagttggaagcctcccagccactgccatagcaccccatgccgacctccttcctagtctctgtttcaggtacaattaagtcgtcatctctaccttccggatagatatcattctgccgtccatggctcaaaggtcagaggtgctgtttattctttggtgtccttttgggtagtttagggaaatccatgctgtaggtgaccacaagagagaatgttcccttttagaactatattgattgagcacaggctgtgtgcaaatactcttctaggcactgtggatgccatagcaatacatgctgtttctgctttcatagagcagtgatttccaaatcctgtgtatcctatggaaagaccaagccaggcaaggggtggagtgacaggagctcccagtcagctttctccttaaaccacagcagctccctttgatcaagatgttggaaaagaaaaatctaccccaaaaagaggaaatgctgaaaacatttggattgggagtggtttcatttgctcttaggcaggacacactgcagggtagcagttaatattctaggctctagctacaagcagacctgggtttgaatcccagctctgccacttactggtggaaggtcataagttgcttgaactctctcaacctcaagttcttcatctgtcaagtgcgaataacagtagtagatattttaccaagtgcaaagaattgaataatgcttacaaaccatttagcatatcatctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacacacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccatcattctggcccaattcctacatatctgtgcatcttctacttatggttttatttaggtgagaataaataagagtacctcatagtagataagaatagtacattacacacgcgcgcacgcacacacacacacacacacctggggttagatgaaattgtatatttggggaacttggggtaaagagtacagagccacacagcagttaccttctgcatcctcctgcttcagagaaagcaaataagaccagtttctttttaatctgttgtttttactaagtccaggattgatgttaatttgaatttgttcttttaagattcatttttgactgaaagaactgagccggaaggtctgcttgaggctacttccagttgagaaacaatttatgtgttcattgagacagtcatttactcaaccaacacttactgagaactttcaatgaggcaggttccttgctagatacaggccagctagatgctagaagccatcatcaaaggaagatgaaaaagtgatggtaattatcctctagaggtttgtaaactggagttagggaagggagcccaaaatccatgaatgagtgattaaaatacagtgggataaagttggtggtagaaatatgtccatgagatatggcagcaaagaagaagagcaccttcatgggaaaagtccaaagaagacttccataaagagatgatacctgagcagatgctttaaaaatgagtagtaattacccatgggaaggggaagagagagaacaagggcaatccaggcagaggggtggtatgagcaaagtcattgagccaaacaaggaaatcttcatttctgcaggtaaatgagaggctgggagtgtgtcatatccatgagctttagcagagagcccatgaggggttttcagcaggggagtgctattgtggtgtgtctaggcacattctggattttagggtgatggggctgcatagaagcagagagattggttagaaggttgttgcaggcatttaggagagagcctatactagggctgaagagaagcagctatgaaaagagatttgtggggcaaattggcttggtggctaataagacacttagttgacctggtgactaataagatacatgtacgtgatgatagtaagcgagggtcaagccagaggtgaagacaacatctaggtttccctcctaagtagaatggattaacggtggtaccagcatctgagctagagaatagggaggagcagctctatggagaaagatgagtttggtcctgtatatgttgtgtatgtggaccatccgggtggagacattcaaaatacaattgtacataaaggctggagttcaggagagatgctgaagatatagtttggatagatttaagcatgttcggtaggaattaaagcatgaggctggacatgagtagccaagaattaaatgttaatcaataagaacaataaaacaaataaacctttagtggtagagtaggagaagaggtgcccatatggagaacatggcgtcatggtctcttcatcatggaggaagagtgatcaaatatgtttttaaaaacgaagaagtcaaacagatccacaccaaagagggtccgctggacgtggcagtcatggacttgactaggagcagacgcagcagggcatgagggcagagggactgaggctgaggcatggacttgactaaaagcagatgcagcagggcggtgagggcagagggactgaggctgaggcatggacttgactaggagcagacgcagcagggcggtgagtgcagagggactgaggctgaggaggggtcaggatgtgaggatgttgaggcagtaagagatgactggccttggggaagtctggaagagggattcagcagcaactagaacaggatgcagggtcaagagaagttcacttatttttagtatggaaagagataattcttgtttattgactagcaggaaggaggcatcttggagagaggtgaagacacaggggagaggggatagttaatggggtatcctcccagatcagtctgcacaagctcaggtgcaggggtggaggcgctggccttcaacagacagtctgagtcagaggctggaggtcagaaggtgtggctggatgggactttttctcttcctagaaaaaagggacatttttagggggaaaaggagggggtttaagctattgagaaaagtactgctttgaaatgaaataatctcactttcctgtaatcaaaactctttatttctgatgaaacagactcaaataagaatcacaacaaagaaatcagtgctcagctcaagcctggaaatgatttcctacacggaaatccacttgcacagattctgatagtgtgagtcatgtgattccagatggagtaaatacacatgaaaaggagagaaaagctggtgtctccatgggctgaagcacacttatggagagagaaattttcatttatttgtatttgggcttcaatatgattacatcaccatcaataatgaaaagtgctgccatgtcccagctgtatacttagatcaagatataaatcagtccaatattgttcttttttctcactgaatatctaaatttgtatatttgaggggaaagtagaaaaaccaagccaagattttaaaaattacatttactatcaccatctccaagttacattcactatagaatcctttagaagcatgttcttgggtagctttgctttttatgcactcaacaaatatttattgagcatctgtatgtacagggaagaatgtgaggtacagtaacacaaaatatatagtcctatctcttaataagcctgcacttgggagaaggtatagatagggttgggaaggataaatatatttttaacactctaatacaaggcagagtgtaccaaaagttagaaatgctgtggagaatcagaatgaatgaacataccaggctgggttggggggctgggggaattatggaaaacattcctaaagagatgtaatttgatttgggcttttattatgatatctgttttcagacaatggagttgagagtggggagtccttcctggctttgtcaggagcagtttgaggtcttggctgaagacaggaaggcataaggctggaaaggggtgggagcagaacatggagggtgtgaacttccagccgaagaagtttgatggggtttgggaaggaggtgagagggagccaccaggaaaggatgtgagctggacctttggaattcttaaagggacccttgtcttctctgccatatttctgtctcagggatgacgtgaggaaaaaaaaaaaagaggaggaaatgggcttgagtttccactgacaccttacagtcaaggaaggccctgttctttcataaggaaaagtggaaatcctctgtttacttaagggccattaacatgttttcatattaaaataccaaatgatctgccgtgactccagatagactcatctaaataaaaggaagctgtttccttacaaattgagtcacaaaggataaatatttgtggagtgccatagaaacaaatgcgctgtcttcctgaaatgtggaaaatgaattttgtagcattgatttgcatgaaaacaatattcttcccagtgttctacctagaatattgaaatggaggtattaagatagatgatagataggacagatagattgctagagagctagattagatagatagatagatagacagacagacagacagataagatagatagatcgatgaggttaaatattcttaggatggaagaaggggtcagataatcacatctcagacagatctggaattccaggcagcaggaactaatgaagtggtctcttcagagttttaccatgggacgaattcacccccgattagtttttattctttgagtcacttctctcaagacaaagatctttgggcaagagttcagttggcctagcttagatatgtttctactccttggccagggatgtgagccttctgaccaatagtttcaccaaatctacaaggaaccctagagagacttttttcccagtggaggagctggatgttgttcctaaaagaaaagggcagagggaccctgggcaggcaaaattttcagctgcctgccaccttagcccctgtccccacactcacttctgaaccacatgtgatcagtcttctcttcccaccacataactgaaacttcaaggtcatgggtgagctctatgttgttaagtcttatttataggagcgatcagctcgctgcactgcaaggctggaaaggtgtttaaaatgtatacttaggcatgtcttggctctttctgatataattcagctggcaaaggctctggcaggaagccagacggacacaaatagcgcaccaaagagatgctaagacatgggtgattataattgtgcaaggagtagaaacttctctgctgagactttggatgtggcagagatttggggagtagaaggggggcaaagcacagttccagccaaccccatttacaggcgttgattagcagtaatgaattcacaaccttgcaattgctcatttttttttcttctgctgctgagtcatggataagactctaagctctgattagctgtgatccctaattctcagcacaattctaagagcattccttcaaattcaacaatatgtggtaagtgtcttgtattaattaggattccatgtggatgcaaggaacagagacccacaataacagtggcttaaacaagatgcttatttctttttttttttttttttttgagacggagtctggctctgttgcccaggctggagtgcagtggcgcaatctcggctcactgcaagctccgcctcctgggttcatgccattctcctgcctcagcctcccgagttgctgggactacaggcgcccgccactacgcccagctaattttttgtatttttagtagagatggggtttcaccatgttagccaggatggtcttgatctcctgacctcgtgatccacccacctcggcctcccaaaatgctgggattacaggcgtgaaccaccgcgcccggccaagatgcttatttctcccttcaataaaaatccacaggtctgcagttatgtaaacatccacaggcatgcagttaagagctgtttggtggctgtgccctgtgaattccttagggacccagacctgttccactttaaccctaaagactgatccttgtcaacagtgaccaagatggcagtttgtgcctcagctgcatacatgtgcatttcaggcaaaggatgaagaaagaactggagaagaaagggctaaagaagattctaggagctgacatatagcactttcacttacatgcctttggccagagcatgtggctacaaaggatgctgagagatgtggcctttactctgtgtggccatatgcccagctcagccacaggaatgacattgctttgagagaaggggaggatggaaattgagcaacttagcagtcccctttccacttttacttgtgctgaattcataaacatgtgggcagctttcctctcctctgagcagcaaacacttcttctgaggttcttgttttggcaggttggccagacaggcaccccacttgactgctcaactatgaaactgcagttccagagaagagaacaggtctgaattaagcaccttaagccagttggtcagcatctccttttattcggagagtagttactgagattcaaacccatgtcaactgagtagcaatgtgtttggctatagggtagggcgtaaccctagtctatgtctctcaatagtgagttatttcataaaggctcagcccatcgtcaggaatatgctggtcttgcgtaagcctttttcagaagtgttcatagggtcctgagaattttgtgagcacttctttactgcttctcttgcctcctcttttagttggtgctgagttcactgcatgaagggtcccaggagtcctctttccccttggtttttctactcctttccttttctgctctttctaccacctcctactgctggacctctttgtatctgtactccaccatggaaaataagttttgtttgccccagatcttcccatttcccagagtggagcctttataattcatgatgtttactaaacttgatctctgccctttcaagggatggaactcagataatgaaagatatagggagggatacattgcttaaatctgtgagtgggcattacgatgggcctaagtgtcccaagagggattggcttgccatgggaggtggtgagctccccatgtgtggagaagttcaagaaggtgtgaaataatcgttgggtggaggacagttcaaggacttcatgtttctggagagcaattaagttcaatggcttctactcccagtctgacctgtgcttctgtgagcttgaaaaatatatattgtgttgcaatgtgcattctttagggaatgaaggtaaaagggcaagtggtcatgggaggatgtcaaggataggggcaaagggtactggttccccagccagaccaccagggtccaaattctggctgcacatcatctctgcaaccctggacaagtcagtgctctttctgtgtatccatccatctgtgtcatgggagttgcagatttttttacttcatgggatattgtgaagattaagtattataatgtacgtaaaacactcataacagttccaagcacacagtaagcactcaataatcctaatccttatgattattattgttacatatattactgtatctagcaaaaacaatattagaattgttagtattataataattattatcatcattgatggggaaggaaaaatgaagcccacctgagttcacagacaagaccctctccaaacagtaaaacaattaaaaaccaagttgtatttgtctgtgctcctttggattcaactgaccaacacccaggcaaagggaaaatatattggcttgctttttttttttgagatggaatcttgcactgtcgcccaggctagagtgaaatggcatgatctcggctcactgcaacctctgcctcccaggttcaagcgattctcctgcctcagcctcccatgtagctgggattataggcacctgccaccatgcccagctaatttttgtatttttagtagagacggagtttcaccacattggacaggctggtctgaaactcctgacctcaagtgatccacccaccttggcctcccaatgtattggcttttgtaagtaagaagggcaaaggagtagctgaggatctgggaagcaggaactggagattgaatggcacgggtccccagcagccagcatgctctgtcttcccttctctttgtttgggccttgcaggaaggtaggctctcagcagagccttgaaggccaggtatttgagagccaggcaagtgaagcagaaggagagcatgagtgagccattgggagtggggacggaaacggcgagaacctatccaaggcaccgtgctgagctatgaagctggagggcagcgcaggctgtgacccaaaaaggccacacaaggccacatgctcctgagtgacaggagggacatgtgatatgctgggccttggcccatgctgtctcctctgcctggctcattttctcctcttttctacctggtgaatgcatccttcaaggcccagttaattcatcatctactttgtcgagtttttctcaccacctgtatcagttgagaattgcattcagctatgatcacaacagaggcttaagcccataacaagcaatctggagccaggcattccagaagtggtgtactctttccatcgtgccctctgggacccaggcaatgtctctctttctgcacactcagacatactattgcccctgtggacataggattactgctctgcctatagcatcatatcccttgcagtaggtagaataatggacccccagagatgtccacaggctaagcctcagaacctgtgaatatggtaggttccatggcaaagaggaattaaaattacagatggaattagagtttccaaacagctgactttaaaatagggagatcagtatcctggattatctgggtacactttgtataaccacaagatccttaaatgtggaagagggaggcagaaatcagaaggaggggtggctgcagggaaggtcagagagatgcaacagtgctggttttgaagatggaggaagggacccacaaggcacggaacgtgggtgacctcagggagctgaaaagggcaaggaaatggattctcccctagagcctgcagaagggaacacaacgctgccagcaccttgattctagcctggcaaaccccgtgtcagacttctgacatacagaaatataagataataaatgtagattgttgtaagccactaagtttgttgtagttgttatagcaggaattggaaacgaatgcgtctctttagcaccaggtccctgtacctggcaggaaggaaggaaaggcaaatgtcacttaagccaacgctcctttccttttttttttttttttttttttgagacagggtctcactctgtcacccagactggagtacagtgttgtgatcatcactcactgcagtcttgaactcctgggctcaagtgatcttcccaccttagcctccagagtagctagaactaagggtatatgtcaccatgcccagctaactttttattatttgtagaggtgggggtcttgtcttgccacgttgctcaggctggtctcatcctcctgggctcaagcaatcctccagcctcagtctcccaaagtgctgggattacaggcatgagccaccgcacccagccctcctttcccttttagggagttgtgtggaagtcccttcggatcatttttacttacatctcattggccagagctgtcccatggccagctttatcttcagtggaagctaggatacataatttttttcaggtgggcatgttgccatccccaaccaaataaggattctgttagtttggaagagggggagaatagatattgagaagaccactcagcgtccccaccacacactcccaggcagaaccaactattctacagcatgttgttctttcctctattattgctatttttggtttgtattgtaatttatgtgttcacatggctgtttgcattacttgaccaagaagtctcatgagcagacactgtgtctgatttatttctccatccccagtgctcagcatagtgcctgatacagagaaggtgtttgcatgaagttagatggatgaatgtctaaataaactttgaaataagagcatgatcgatgcacttcccagagcgagagttcctttctgttttcttgtgaggatgatctattggggttaggtacattttataagaccatttggccatgattgcaacctcatctccagtaaattaaacctacacagctgcagtgtgtcacctttccttatggcttattacagtttgctttttgctcagaaggaactgagcaagcaggttagaggctgttatgtgcacctgccacagcctacggatcctcaattaaccttgcgtgtaaattacacttcctgcccattctttatttttagcacagcaacatctacttggctcttccagagaagactgcattagatttcagtcatgaaactacaaaacagtggcgtctgcagcctggctgggatgactgttgttaaccccatgacactctgttccttgcgaagctgctttgccccaggactcaggttttcctgagaaagagagcagcctggactgaccacaccctcagagcctggcccaaggccacatgtgaacttatagaaaaatctgctattggatctgacataaactctccatttccttcattcattgcatttgggttgaaactcagttgttgttatcacaaaggtttcatttcgttccttttttttctctccctctctcttcgttccttctcagttacacagtatcatgacccaaatctttagcacctgaaccatatagcgcagagccttgaaacccatagggccagggcaccccgtggagacaggccagccagtgggcatcaggtcgcagagaattcttaaccacttaaggttgcttcactggaagaagtgagttactgagagacagccattttcggttttagtcagccatttttatcacgatcttgtttgttttagaatcccctgtagtgcctagctcggagtccaaccaaacaagctccataaatgttgattttgaatttaaatagatgttggggtgctcccatttccccttcactagacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccattactcagagacaactatcactgacatttttctgttttttcagtcttaattctcatgaaggtgtgccctgtttccctccagatttctcagaggattcaggattagggaagggaggagagggtgccttatgttctttctaatcgtttagctttgggtattattgggatatatataaatacattaacacacatataaatatatgtgtatatatattatataactggcatatacattattgggatatatattagtaggatgtatatatatatatgtgtgtatacatatgtgtgtgtgtgtgtgtgtgtgtgtgtgtgtatatatgtaaaatgtatacacacttctatttgacctgtaccagttcattattaccacaataatgctaactaacacgccctcaaattcagtggcttaaacccaaagtcatttattcttgcccacacttctgtgagtaggctgggtatttgctgatctaggctgggcttagctgagtggctctaatttcaggtgcttctgaactatatagctgagagccctgaaacccatagggccagggcacactgtgcctatctatgggtttgcctcaggtctattccatgtgtgttctttctgtggtccaggctgaaggggcagcagctgcccagataagttattgtcttggcattggaaggggtgcaagaggacaagctcaactgggcaagcacttttcaagcctctgcttgtgtcttatctgctcacatcctattggctaaagcaggtcacatggctgcggccagtgccaagggactgggaagtgtaacccatctaccataagcctagagcaaatcacatggtcaagattgacatcagtggcttggggaagcatgtactcttcccatggaagtaagggaggaaggaagggaatatttttgagaataatgtaatcttttttttttttttttgagatggagtcacactctgttgcccaggctgaagtgcagtggtgcaatctgggctcgctgcagccttgcagcctctgtctcctgggttcaagcggttctcctgcctcagcctctagagtagttgggattacaggtgtgcaccaccatgcccagctaatttttgtatttttagtagagacgggctttcaccatgttgatcaggccagtcccaaactcctaacctcaggtatacgcctgcctcggcctcccaaagtgctgagattacaggcatgagtcatcgcaaccggcccaagaataatataatctactgcacaccctaaatatctgctaaagtactctgtactttgagatttaaatcaaatctgctcaggccaggtgtggtggctcatgcctgtaatcacacctcaaataaataaataaataaataaataaaacctgctcagagcccacctggttggtagtatcatccagtctacacagggaacctctagtccagagctcctctactcattgaattaattcagtttctggataatgtgactgtctcgtgtgttgttcctatttcacactcatgtctctttacttactccccccaaaataatttacacagatgtgtgtagaagattttgctgaacatctggaccagcaaagaagttttacatctttatgttcgtatctctagattggccagccccctctccataaattctctttgcgtctcgcccacacacagcctctcaagttaaagcttgctgaagaattcactcttgtctccaaaattctgaaagtcttatcttggctgggccacacctttgcgcaacttagctcagctttttaaattcattcaatgtaggtgtattgagcatttgtgccctctgtctgaggaatttataatctagtaggggaaattaataatgtatgttactatttggggccagaaaattctttgctgtagggtgccatccggtgcactgtgggatgtttaccagcatccctggcctctacccactatgtgccagtaacaccagtcccacccccttgagctttggacaaccaaaatatctctagacattgctgaatatcccctgagggacaagatcacctcagttgagagccactgctctaatatatggtagacttgataagacttctgataaaacaaaataatgtgctaagaaatgttcagagggaagcgatgttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagtatgtcgctaaataaattcatgcctggatcttggtgttccttacctttcagaaaaccccactctgaactccttattttaggtctaagtctaatggccagttcccgagagcagattaaaagatggaaaaagagggccaggcacggtggctcacgcctgtagtctcagcactttgggagcctgaggcaggaggattgcttaagcccaggagttcaagacccacgcaggcaacatagtaagacctcacctctacaaaaaaaaattaaaaattagctgggcatggtggtgtgtgcctttagtcccagctccttgggaagctgaggtgggaggattgcttgagcccaagaggtagaggctgcagtgagctatgatcgtaccactacactccagcctgggtgacagagtgagactctatctcaaaaaaaaaaaaaaaaaaaaaaaaaaaaaaaaaaaagatggaaaaggaggaaggcaagggaggggacttatataggcagacacagactcagcagcaaagcttccagcacaacagaggggaaagagaccaaaagaaaaaatgaatgaatgagtgattgaatgaatgaaccaatgaataaattcagatcaaataattcaagaggcacagcaatctagagttttagcaagagaacatttatcccttcattcttcctgaagacattgctgcatatcagtgccatcctactctgccaatatatgtaatgtttaacaaggtgggggatgtggagaacactttagatcccatgtggtaagagttgctcaatggttaggaacagggtctagagtcagagcacctggcttgaatccttgcttcaaggctctgtggcactaaagcctgctttactaggttacttcaccttgccaagccctactgatctcatcggtaaaatggggattccctactcacagggtcattgggaagtttggataaaataatccacatgaattcttagctcagttcctggcacagaataagtgctcagtaaatactggtggtaattattatcatttcactgaaagaatatggctgttgagactttccccaaatcatagctgcagctgctattctggaatatttccagagtctcctggcagtgctgaaatttcccttttataaaatacataggatggctgtgaaaattgaggaaagttccaaaaggcaggggcagttgcatctgtcttcttcatttcccttctttttggcagtagaatccagaccacagagggagaggacaccaggctcccaagggtactggccaccagctatttcttggcaacatacttcctttgagcaagaatggccctttactttttgaccaacctgagagagcacttactctgagccggtcaggagaatatgaagctattttccttctgatgttatgtcctatgctatgtaaatataatctccctccaaataagaaaggtgcacatgcatggtgttggcagggaaacatcgaaacatattgcatagtggtggctgtgaaccagtggaggcagtgctgtgttgatttcccttgaccaatgtctgcccagtggcagagctggaaacacaagatgctgtgtaatgtaaaaccttggcctggctcctcagcgtaatgtaaaacaaaggctgccaggaaggtacaaatcgcccaacaggaaggagctgctctcttgcccgtggatggcaggacaataaagtaacttgtcctttgtttgtgtgttttccaggctggagcaagaaatacaaacgctagaaagtgaagagtcccagatatctgccaaagagcaaatcatcctagagaaactgaaggaaacagaaaaatccttcaaggactttcagaaggtgaagaaaaccaaaacgatttctcaaagttatttccatggggaagtagggcctagcaaaatggtgctaactgggaaacaggccagtgggcattgatgagaaatctgagccacgaactctatgaaatgaggggcagatgtgtgaggaccaggggccatcctgaagctaagcatgacatatctttgggtgtgggaccatctggcctgctgcaaggcatagggaagagtcattagattaccccatctgcctgctctccggatccctgatatgccttgtgcctgaaaagccttctcttattggactctagaattctaaaaccaattctgatgaagcagaataaacatgctctttgtggctttaattatagtttgctttttgagtctttcattataaaaaggccagaagcaacaccttatgaagtggacaagaattccaaatacaaagagtgtaaatacatgacattttactgtatatagaaacagatggtgcctgtaatcccagcactttgggaggccggggcgggtggatcacgaggtcaggagatcgagaccatcctggctaacgtggtgaaaccctgtctgtactaaaaaatacaaaaaaattagccaggtgcggtggcaggcgcctgtaatcccagctactgaggaggctgaggcagaagaatggcataaacctgggaggcggagcttgcagtgagctgagattacgccactgcactccagcctgggcgacacagcaagactgcgtctcaaaaaaacaaaaacaaaaaacaaagacaaacaaacaaaaaaacaggtggtgccgtgtatcaaagagtagagtccgtaaaaccagtaggctctgaacaaacatctcaggacctccctccattttataactgtttctgctgtacctatgagtgacagaaaagcaatctaatgaaatcaatttaggatgggattttctgatatcattctccagcatgaccaaggatatttgctagatcattgaaataaatctctattgggagaaatttagtataaattgggaattataattttggaattctaaataaattgtccagaagaaaagagatcgttgcgtttccccagcacagtcaaattctgggctggggcatgggagaaagatgggttaagtctttaaagatgggaaaagatgggattgtacccccacatgtagagtaacgctctgccttgtttttgttcctacagggtttctccagtacggatggaggtaagtgctctctgccccgactgtagatgaatgttttaatcctggtcagcttagggggtttcattaacaggggcttaaggaagaggtactgtgttgatttgtaaaggcatcagaagaagtagcagcgctggttgcaggccactgaggaggtccacattccaagccttccctgcctctcttcttcaggaactatctcttggctcactgtttctcctcttacaaaattggcctggctcttctccttcccattagtcccaacactcactgcttgggcctctcttgaaaggtacccagcaaagaagagtactaacatcaggacctggtcccttgtagggatgagcccatttgtcttggtggttaggtcctcaggttgaaacatacgtgagaagtttaagaaatttggggaaaatatttggtgtttgggaaacctttctacagcctctggattttctttgctttctctctctctctctctgatcagacaactgtcgtttctttcatagaaacagggctgggcaaaaacttccctccctgtgtgggatagttggttcagagcataggaaggtaggagtggggtcctggcttcctggtggcaagagcaggtctttcaccttctctaccttccctacctttcctctgtcctctcctctccttacctggactgtggggatgaacttgagattgtgtacttctcacccttcaccttgctccctatcctcagctgcaaacccatgattcctactttcatttggccctcagctagacctgctttacaatgcagggacttgttggaaagaccagatattgtctgctcccctggctcttagaaagtcacattctagggctgggtgtggtggctcaggtctgtactgccagcactttggaagactgatgtgggaggatcccttgagcccagaagttcaaggctgcagtgagctatggtcacaccagtgcactccagtctgggtgatagcaaggtcttgtattaaaaacaaacaaaaaaggtcaacctctagactaggaagatgatcaggagccaggataagaattggcatcagtgttttcccagcgtcatttggaaatatacggggaaaggtttaaaaatgtgtttctctggattagtcaaaggtatttgcatgaaggatagttctgactttggcaaaacaaacaaacaaacaaacaaacctgtgatttttaatttttttttcccctagcaagagacctggattttgtctccccaggtgatctttaggaaggtactaaattaaacttcatgctctgagtacatgtaggcagggccaagtcatgtccaagctagcaaggactctaggaaaagcggacctacaatacttctaggaagtctctatggtgtgaccaagtcagggcacttgttctgtgctttgggggtggggcacggattgaggaagtggccttggggaattgtgggtacagcatggggaggatggcaggcttccctgagtctgggaagacctgaggcatgccacacaattagcaataatacagtgcatgtcaggctgggatgaagtgtgggacactgacccatgaacacctacccaaagagtgcatgtcggccttttatgctttcactttttttttcccttcccttctcaaatcaggaatttccctagacatctctctgatacttagggaagggaaagaccctgtatgtcatgttcctgaggagtctgtgtggggcatggagacctgtcatactctgtgacttgttaacaagcaaaaatgcagccgcatcataaactctcaccacctctttcatttttacctcaaacttctttcattttcttctgcattgcttcccattgttttcacttatccacctaagccatttgtagaggtggtaagaagcctagtcataactgaaaagagcctgcagggaaagttgcccacagactccatcctccaggatgggggagctcaggcttaagaggatgcaaaagtcttagggatctcatttcttgggaagtggcccagggaagagtttccgtggtcttacctgtcaccctgcattataattcctgccatctgtggttatcaccaagcctgggtgacctctttatctgtcataccacatctattagcaaagaaagaagtttgaaggcgggaacacatacatcccagaatgtgattgatgtatatagagtcacaatgtggtgaagcacatcccagttgagggactttgggatgtctctttatcttctcattcttcaatttcaaaggccccgagttgccaagaccctcttagaatcatccaacttgctacaaaaaactaaccagatattattatagaacaatggtgacttaagaaacacagttaatttctgatgcgtgcagattacagaatccaggtccagttaggattatgtaactatacagacactgcagataagcagcaaaagcatcccaactcgtgaggtgctatgagatagctgctggtgtctgtgtgtgtaatgaccccatctcaggtaacctaagtgtgtccctctatgcatggcagaggaaatagaggtaccgtactgctggatcaccagtggcttttgattgcatgatagcctgggcaatcaagaacaatttattctattcttgagtagaatctcctggtcatatacattctgacacccactctcctcccccgccaacacacactgttgttatatagcagaacgctcatctattgggtgggttggttttcactgtcttaggcataatgtcttgtacacctataaattgcatatagtatatatctggtgctaattctgttctttacccactgaggagggagctgatgcaaaactcttgccagaacaggcaaaggaaaatgtctgtcctgggcctatctcagtccttggtgtatgatatggatcttcttaggttcccatcccataccagtctgtggtggcttagagcgtttcccacatcaaaaccttcataccagttattcgcaaacctcaatcttcagttgcctgtaagttatgtgtttgtttgtttgtttatttattttgagatggagtttcactcttgtcgcccaggctggagtgcagtggtgccatcttggctcactgcaacctccacctcccaggttcaagccattctcctgcctcagccccccgaatagctgggattacaggtatcagccaccgcatccagcctaagttatgttttaagaagagttttcatcaatttgtttctctggctttagctgtttagattcttcatagctactgtaaatatttcagcgggattagaactaagaagcagcactcatctttaatttctactctataagttactgctttccaccttctctgtcagtggggagaatagtgttagactattctgactttggcaggaagagggcagcttattaattgaggccacctgaagaagtttttcccattgaagttttggcaagcctgtttgttactctttgtgctggcctatcagacacttcctgtctatataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcgattctcctgtctcagcctcccaagtggctgggactacagacacacaccaccagtccaaatttttgcattttagtagagacagggtttcaccatgttggccatgctggtctcaaactcctgacctcaagtgatctgcctgcctcagcctcccaaagtgttgggtttacaggtgtgagctactgcgcccagcccattcccttatctcttaacagaagccatgtagcccaaccctctaagtgctgtagacttcaagcttgtagccagtaaacatctggcaaaggtaactccatcatccattcccatctggcagggagctatctcctggaggaggctgagacataagccctgggaatcacatgttctttcagatggaaaattccctgtctgtaagtagtttttttttttttgtttcttttttaaactgctaaaacattgagtatgcagacacacatgtgaccagtccatgagatctcacatgggctccagcctccatcttatttgaatgcagaaagtcaaattcaccaagatcccattccacagatttctggaaattatcagtgaatcttggaagttctacaaatctgctctggtcatcccttctttcctaaactgaccctctagtcctagattactgcttcactcttcccacggacaattgtcacccacctgcccctaccccctcaggactactgacctcaaggtgctgctctttctagttctgccttgtgctgctttggggcacagacccttcctacagccttccacagtgggaattaaaggaaagagaagtctgtgacctaagtttaagaatcatggaggtggctcacgcctgtaatcccagcactttgggaggccgaggcgggcggatcatgaggtcaggagatcgagaccatcctggctaacacagtgaaaccccatctctactaaaaatacaaaaaattagccgggtgtggtggtgggcgcctgtagtcccagctactcgggaggctgaggcaggagaatggcgtgaacctgggaggcagagcttgcagtgagctgagattgcgccactgcactccagcctgggtgacagagtgagactccatttcaaaaaaaaaaaaaaaaaaaaaaaagagagagaatcatggaggtgcagttcaacatggagaataatgcacaacttcagacatgtggcttcactcacagcccctgactcaaatccaaaaccatcttcagggggtccctgcaggctgctttccagccatctcccagcccaccatcatctcaaaggctcaatttccttccttgcagtgaggggtgccttcaaccatgtctgccttatccaggatccaagctccaacacatataaggcacctgagagggaaagcaacttgagcctcactccaccctaagtcctgctgttctaatcttcctttctcattccttctccccaaatggttaatatggaaaaatctatttttttttttttgagacagagtctcactctgtcacccaggctggagtgcagtggcacaatcttggctcactgcaacctccgcctcctgggttcaagcgatcctcctgcctcagcccctctagtagctgggactacaggtgcatgccaccatgcccagctaatttttgtatttttagtagagacggggttttgccatgttggccaggctggtctcgagctcctgacctcaggtgatccacccgccttggtctcccaaagtgctgggattacaggcatgagccaccgcgcccggcgaaaaatctgttttcttagcgatactctacctttgcctatgaacataatggtctaatgtcaatacattctggattgttcagactcatttgcaagtcagaaaagggtctggttggtctagaactgaactaagcctagtccagtgtgtgtttgcaatcctcttcagcaagaaatgaaaaagaaagctgctagaatggaagcagtacgagtggggatgcagaggaggggtcagtgatgagaaatgcggaggattttgaacagaggcagaggctattgaacagattggataccagcagggggaagagtgaagggtgctgctgaggatcccaggtgaactgcagtgctcgtgagccaagatagaggacaggagaagcagcaggtgagcagagatacaaggtccattttgcacatgttgagtttgaggtgattgtgggatattcagtatagacctacagtgagcagttagatgtaaccattgatgactgatggacgttccaggattttgtgatatggtcgtgatgcaaggaagggatcacatctcatggtgcccagctttccggaatcttcctgctttcactttcccacttctttctggggtgtacccagatttgtcttgtcttacctcaggggtttcctcctttcctctgataccttggcatgcttgctaatgttcatgctccccatgtctcacctccctaaagaggcttgtcgaggtatttgcccaagcaaatctaatgggctccttcttttacatagcaacattccctgcaactgggctaatggtgggctcaaggggtattgtcatttagaatctcaggactttctagctgaaacaccagcctgcagtattgaaaacatgagatcaattctgaagtctgtttatttgttgtaatgcatataaaattggtcttttgaatgaatcaggctcataaagctatattgccagttcagggaatgaaccccataataatcagacacagaaagctttatttccggttcagagaatggatctgtttttcagtactgtttaatgtacatttctagttccatgttttctatttgtcaatcccaccaagttgataatggctcccacaagcccatctctgaatcttccccccgtccctgaactcattgtcctcctagaatctagagatttctgatgactcttctaatacatagagccatcctggggcttgagctctctggccaggatccctcctgcctcagctactctgctgaataccagtcactgggcaaatgcttgtctttgtttaccctgatcctcctgttcagtggccgcctcagcggtccattatgtagggcagacaagctgctgtctcggcagtgaacccattgggcctcccaacactgtgactaattgtattccctgttctctgctaccagatgcagtaaattacatttcctcccagcttcccgacctgccaatcctctgttcacgaacagcagaaccatcacctgggcaggacgggaccagcagagcggctggtaagtcctggggacctttggacgctaggatggtccaaggggcttgcatttcactgagctttattaatgagatgagtgccctgctatccttacatagggggagctcaccttcagcccagcctcagatgcagccttcacagtggccacacaaggcaggcaccggccccagatgggtaactgaggaccaaatgggaaggagttctgaggaaatcatacggcatttcacctccgacttcgggggagtctttctttggtgtttgtggtccttatatctgtgtttattctcaaagttaatctgtattctgcctccagggattttcattttcctcattggaaatatacaaattgagagagccatccatgatggaagctggatgggaaatattttcaaagcctgtggtatctttacagaatcctttgggaattgtgctatttgtatattatgaatacatatattcctaagtcttcccatttctggaattatttcttagccactgtggtatatttgggaggaaaagaagcaatttaaagcacacatgttacttgctaatgtgtctcacaattggaaattttacaaataatatatttatgagtgttgagtgtagggagaaccatgctttgctctgcttaatgcagacatgcctcagaaatcagaactggaaggatgcaagcaataaatctgtacacgaacccttatgatctacacagaaatgtgctgagggctgggggttaaatggaaaaatgaattgcccaaggttgcatggttagttacaacataggtgacttcaaatatgagtatcagattctgctttgcatattctaggtaagtgtatgtttaaaataaatcacataatggcagattttttaaagtaaaacaatcatggatgtttaagccagaggatatcttttatataggccaacctgaatatttcatgaagcaaagaatccctacttattttaatacaaaagtaaaataaaaggcaagtaagaattaacatagttgtcacgtccactggctaatttaaatatctgttgggcatctctgtaaacatcttagcagattacttttatgtacagactcacagagtcctagagatggttgggactgtaagtggtatctggtcaatccagagccagttccacatcttcctggacagtgacaggatggataaacaggaacctgcaacctgcagttatgcttcaaaggactcactggcagtcactttaacattggactctttaagtactccagggtacacttctgaggtacacttctgaggtcaacttaggtaaaatgtgtttaagagtgacaccccttccctctggttattagagacatgggtgttgatggctcctgatagttgtgggtaaacaacttctcaggtcctctgcacaagttcctgcacttcaaaggacacaggatatgatccaacatatggatcagcttatgggagggtagggacaatgtatgagaaataattttaagagacagaaaaagaatttgagcagtgtgggtagtcaaagagtttaaagttcaagagtaacacatgaatgtgattgtagtgctgtgtaagcagcaatacacattattaccacaacccagctccctttatctttgaagatcctgcaaaacatgattttaaaagccaatgcattttcaaaagtataatgtgatcagaatctttttcaaagtaattttacatatgtttctgctgattagttaagagttaatttgcgtaaatgcatctactgtgggattacatataagcagagctatggaaggaattgtatttgttacgatgaactcctttgtccaggctgtttagggaatgggatgttcagattcatgatcaattatggttaatggtgactacacagagcatgtgtggcttaccaaccaagggtactcactagaattctcctagatacagtccatcttgctttaggaatgtccttttggaaatttatataacctcagggacattttgacaaatgtcacttgtcattactgagtagtataacaaatatcctggttgtttggcgtttggaaggtttgggactctgtataaatgggaatttatttagaatcattgcttttcagaattaggagacatctattccaatcctttatccaaacattgaatccttaacatagcagccctgtgaagaggtcctcaaaccctggtcacacacctctgtgattcatgtttaatcttcctccaagtttcccattccatctctggttggttctgactattgggaaattcttcctctgatggagccatcatttgtctgccttcatcatccacccacttatccttatcctgcaccctggagctactcagagcacatctaagttctaatttcccttcaagtgtagaaagtcactgttatttcctgtttttcccagatcctcactctaaatcccctttgtgctcacagtcccagtctctccagctggtattgagatgatgagattgcctttagacaccctccgccatccctgtccctcccctctgcacgctcttcacttggttgctagtcttcttgatgtatcatgctcagagctacccaatgccttcagagctaggctgctcacccccaaaatagagcacgacgctgcagaccacatggctgactttgctggcaatgtggcctttcagcttcagttttgaaaggcctcaaagtcatttcatgtgtgccactgctcagcctcactccgtttatccatagaattgttgtttctgagtcatttcagttgaaatgttcagtctgtttcccctagctatacatatactacttcacctgttcatacatagaaggacctacagaattcttttgttttttaatctcgaaagacaaaaataagcatgagctatgcacttttctgtcctttgtagatttgctatgactattaaatttcttcttgttagattgtctctcaagaatgttgcgggtttcatggaggcactgaggaaccacagcaggaagtgggggaagggaatgatgtcatgggatttgacagggctctgacattccctcccatttcaaacacgcgcagttcctccatcctcatgtttacatattgtgtttccacatcagatttcacttgaatctaggcctcaacaagttttgaatgtagaaaaccctcttctctattgttagggtctttgtagctcatgattatggtatcctcatagcctcactttgcttctcagtttagtaccccctcaaatctgaaaaagcaatcttttattattttttatcatctcattgctaaaaatgttgcatgttggaaccaaagtcagagccctgtggcacaccattagagatctcttggccctcaataaccctaaattgacatctttggggtatgatcatgcaaccactaacaagttaattgtcttaacacccaaggcacatgtttctgtgtagtccacaggaatataagggattttgtgataatccaaatactctggatcttttcaaatgcaatttgcctattctttccagagaccttgaacagaaaagaaaatgagattaatctgcatagtttctgcttgattaacccatgctggctcttagtcatctctggtctttgaagattaactttagaatttagctagccatgatgtcaagctccttcgatgtagtttagaatcccctcattctcatttttgaaaatcagacctttgagtgtcagcttccagcacctttcctgatgttcaagattcttgagacaaattcaacaagggaactgggaccctgatcccaaagcactgagagcctttatatccctgcagtgctatgttattttccaatcttctctgctcatctgggcttcacttccctttctgccactttctttctggcactttacaggctgaaaactctccttcttgaccaaaaatagaagcaaaatcagacacaagaaattggcttgcctttattatccatcaacatcacacccttgctgacttatttttgttactactgaggtgtcttggaaaaacaattgattcacagaaatttttgatcactgttttttttggggggagttacaattttttattgatacataataattgtacatatttatggggtacatgtggtattttgatacattcacacaatgtataatgatcaaaaaagggtaatgaggatatccatcatctcaaacatttatcatttctttgtgttgggaacattcaaaaatcttctagctattttgaagtagacaataaattattgttggctttagtcaccctactctgtattgaacattagaacttattccttctatctaactatatttttgaagttggagattgtgctttcggatgagagggagaacccattctgaattaatttcctcatttttattgtcattggcatcacaatagccatttttacatttccagcccaaagataatatgtgaacacatatttatatgtataaccatttgctcgaagggataagactacccatatgtgtgttcattcaataagtcaaccatgtgcattgcttgtctatcacatgccaggtgcaatgccaactcctggatgtttctgttactgagatgaccctgaccccccatggatgacacttatgatctgcttctctcctactgtactttacgcatcactgactcgtgaaccacgcagggtgttcacagcaccataaaatatcaaatctggataactttcattgtacaaatgagaaaatgaagccccaaaatggggtgtgatctggataggaattcagatcctatctttctccctcctcccatctccctgactaatgacagcggaacatgtggtgcttatattttagatgtgggctctcagcctgttcctcctcccgtaatcacagtgagtgaaagaaagtgagctgggaaaagcctgaatcaatgattgaactttccatcctcctggaatagtcttgttttgtatgctcttggactgatgctcaaatgtattcatgtccattgctcttcccgccttgcttgtgtcggttactcttgttccctcttctctaggctccctacagcccttgcagttgctttcactctgccaaaggtgaaggcaacaggcaacacaggcatgtgtagagccagggggataagtctgaatcagaaccaaacattctctgctcctcagacccatctctctgggccctgcagagcaatcgcttctctgctcaaaactaccaccttggtttttaggtgggcaccttccccagaggcctcacactccgctccacacctgggtgttttcagaacctagagactggaattctcaacctcaacttaatgtctctactccttcagggcgtttccctattgatgaaagaattattagggagcaagaaccaagaaaaccaaatgcggaggcccaaaatcaaagtatccatgcagtcattcatctgtatccctttgaataagctagcaacattcgttcttactctctttaataaaaagagcatattaaaataaaataaaataaaataattcttaaaaacagcatattactcagctgtctcgctggcttcttggaaggagtagcaaatatgctttatatactccaatctcattgtcatcagtatatagggtttggaaatcaataattaaatacataatttaataaaaacatacttccagatttcagccagcctatcagtgaaacttccattgaattgtcttctatttcttttccttcttccccaggtccttcatccaggaaaatttccagagctttccttcaaatacttttctgtatgtccatgtatgtttcaagatttctttcagggctccccagaaagccctcacccctcaacagcactccctcctcattttttaaataagatgaacaaaggcagcaagccctttgaccctcatcattatacaaattgtagtgtacctctgacatggagaagctggagagaagacagggcaggttagagagtatgctctgtgctttgtggttagagacaaagggatgaaaagtgtgagaggccattggtataaacttttggcagcaacaggaagtagaagagtttttaaaatcttgtgcatcaaaaataagacattgcactgaaaacgtaagtcttatgttcctattggttcatatgcactctagttcatgcttttgtatattattggctgagaactgaagcaaaatataaatgcttactcataaagatgacatttaaacattcacacctcttgcatggctttctaaaaggcctagataacattctcatatatgtatccatgaaaacgaaatattgcctttgggttaagtcagagcttctcaaagtgttcgcctttgttctctttactggaggaaagagtgaatgcagaaaggaatgtagaatcacactcttaagtgtgatttgtggttcctctgaagccttatgttttatctaggaaaaaaatacatatgcattttgtgacataacatatctaagtttattttattataaaattatattaaaattcttaaaatattctatgctcatattctaggaatattggaagaatagtgtacaacatgtaaatataaataggtaaccctagtaaaaccatgtcacatgtggttcagtcccagagccatatcacatttaaagaactacagcttaaaattgcacaccaaaaaaccattaagaaggtgttctgttctttaactatttctcctgaaggatattaaaagggaccttggccgggtgcggtagctcacgcctgtaatctcagcactttgggaggctgaggagggtggatcgcttgaggtcaggagtttgagactagcctggtaaacatggtgaaaccccatctctactgaaaatacaaaaattagccaggcttggtagcatatgcctgtaaccccagctacttgggaggctgaggcaggagaatcgcttgaacccgggaggcagaggttgcagtgagacaaagtcgcaccgctgcacttcggcctgggtgacagagtaagactctgtctcaaaataataataataataaaaaataaataaaagggacctaatttatatctccactaagtaataattctcatattcacttttctttcctccacatatcacctgctctaaagcatcatttaccaccacaaaatactccttctctatgcatatttcatacagtttttactctctttcccactaaactccttctttctcatttgtgtattatgtggatatacttaacctttccagcaaagaacttttcatcatcatctctcctttcttccaggctctgattctagaacaggcaaagattaaaatgacagaaaattggaccaacaatgatcagcattctcattggtgggaagagggagagggatatctgtaaacatccccatgttaataatttgtatttttatcctatcacatatggatataaaaatagaaatattttgttccatattctgtattgatcgcaggccagtgtgtggatttgttcacagataactgaatgtttgcagaataataagatattgtacctacaaactaacaattattactttccttatttataactgtgtcccatgagtgtgttaatagtgataagatatattctaatcccaaactgctttttaaaataagtgttatatttcaagaacaggcttttggagtccatgcaaattttaaatgcctattctattcttctgatggcacattttgtgagaaatcaggaactaactgagataaatgtttatttggatacacagtcattgtgtgtgtccatgcacctctatgacaaatgctggttggcctcccattgtgtcacttgaagaaacttgagatctttatgctgaacaagtgaaactttcaaaatggatctgatgaaaaccaaacatgggattttgtttcataatctttttagttaagtgttaaccaggaacagagtgtatcttattatgcaagcagatggaacaatatcatcactgttattttttcaaacaagttcaaacattaattactgtgtgtaccatttcattggtgtcatattatacaaagtatttgttactagattacaacaaccatattagactcttgaattattagcctttgtttgagagatgtgtatattgggtacctgctatacaaatggctctaaggtaggtgctgacagggagggggcatcatggataggtgttgggcaagaaactaaccctcaaaagatcctaaaaatctatgaagctgatgaaacattcccacagataattatacaactgagtggtaattgttaagagccttcagagaagtttagaaaaagtattgagaaaattttaagagagggatgacttagagatggaaggatcaaagaaagcttatggaagaggaggcagttgaccttggcgttaatcaatgggccatatttggatatgtagaaactcaaaacaaagacatttcaggagaagggaatcttaacaaaagcagaagatatttacgtctgggatggtgttatttggttgtgctaaatggaaaaggagcactagaacatatggttgaaaagatagtttggatcttcttaacacagggaacttattcagaaagaggtagggactcaagacaatgacaagcagatgggctagatctctagaagtttggaggagcaacagaaggctatctaggcagagggacagcaggcacacagatgagcagccgtgggaggaagttgagtgtcctgggaatagtgagaagtcgttatggccacaatgtgtaaagaatgagagagcccacaagacaaggctagaaaggaagtttgcagacacatcctgaagggaactatatgccatgctggggagtttggtgtttattttctaaagacacaaggaaccaacagagggtttatgactcaagtaactgtgggcaggatggagcacaggctggcaggggtcggcaaaatttttgtataaatggccagattttaactattttagactttgtggaccatatagtctttgtcacacattaattgttttctttctcttttctctttccttcccccatcttttcctccctctctttcttcttctccttcctcttcttttttcttccttctccttccccttctcttcttcttcttcttcctcttcttttttttttttttttttttttttaaagaaacaaccctttacaagtgtaaaaccactcttagctcctctggccatacagaaacaggctcaggctgtctttggccctctggccacagtttgcagtcttctagactagagcaagaagacagaagtgttaggtaaaataaaaagcaaggctgttgtgcagagagcagaggagggcctggactaaggccttggtgacagaaatggtggtgaggagatggatgagatatatctgaagtagaatgatttactgtcagtgagtgtttggctgtaagaaagtaggaagaaaagaacaagtcaggtgtgattctcaggcctgtggcttgagagactaggtagcagtgctgctgttatttggcatggagactgtggaatagttttgatagaagaagctggagtcagtttggaagctgctgagtttgatgggttcgtggcacatccagataaagggcacctggagcctggtggctctatgggcctgatgcacagtttcttcccatccaggaagactgtgaagaaaccagtttggaagtatgaggtgtcacaagagtctataggacaggaaagagctgtccttagcaaccccagactggcagcaagagttgggatgaattagaaaggatacaagactgagagacaggggcaaggggagggggagaccaggtaggaagctcttccaacaatctagggaagaggaagtgaatgtcttacattgaccagtagcaatggaacaaaaagaagacaacagatgggaaaggtattaatggaacaaaaagaagacaacagatgggaaaggtattgtgggcagcaggacttggcactctgtgcatggaagatgaaagaggccttctgcgatcattgtcttcaaattccagtgtcctatgtgatgttacttctgtcttgttcttttcttagttcttattttaggtacctagtttagtgactgaagtactcacagggcacataatatgaatgctcccatgctttttcaattgttgaaaatattctgttgtatagtacagtggaggatagccatgacccacctatgaaaacctttgtggaaatgtagagaaaacgaaaacacttgatgaaagaggttttttcatttatttaaaattttggacctggaacacattttaaccaagggtttgtaaattgtctgtcagcctgggaagccctcagtcaaggtagtttgcatgttgccagcctccatgaaattcttcacactaagatctaaagtctcttgtgcccttattttagcagatcttccttaaatgtgtgagtgccattgagatatagcaaccgtgcatctgtcttccaagtgcattaaactgctgtgttacaatacagatataaccatctttattcacagtgcgcacctcactctaacactcaagatgcttggcagttagaatagaaagggcacaaaacctttttttttgtctgtttggcaattaaccattcactggctttttttgttgtaacatgcacttcctttctcttgttttcattcaagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttcttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatcta

SEQ ID NO: 1213 - DNA, 171180 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtggggggacgactccaggaatattatgaccgaatgctcaggcatacgttggcttcatagcctggagaaccaagagaagggtgacctgaacggtggctgccatcctctctgcggaagctgtcctcctgttaagtggaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgggaaaatgcacacagacccttccttttttagaagcatttgacatggtctccaaggctctgagaccctctttctcaaacgcctcaaatctgaaatgtcttggagacttcaccactgaagtgagagagatgtttgctggcaatattgaaatgccatggtttgcctattaggtaatctttgaacgtggtgctctgaactcagaaaggttgtttttttcttctttctctttccccctgtgcatgtgtattttgatggtttgtgaagttatttgtggtttctaaagttggtggcaaggcagcatggccagtgtgtcatgaacttgataagaatggtgatattgagttaatggtgccatgtagctggtgggtgttttgtgtgaactggataataggctgctttaactgttgatgcagtggctgttcccattggctgctgctgaaggcttccaacagttgtcacattttctgcctttgcacaaccagctttactggatgcctgaggaacagctgaactccatgaaaggacttgctttccaaacatggagccagtagctgctaacactggggtacccttttccaagtgcggttgagtaatcccagcagaggccaagtcgattttccaagaaagatctaggcaaatctttgggaattctcttgagcatataagaatacacacaaatactcacttgtgcctcttcagttattgaagaattgagtttgtcctgtgtatctggggagctgttgattattctcatgaatgtgcacctaatacagtctgccctccctattcatgggttccatatccacgccttcagtcaatcttggattgaaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagacaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctgtggggggtcagaagcaacatctctgaagtggaatgtgtattaatgacttttttttttttttagacagagtctcactctgtcacccaggctggagtgctgccatgacagctcgctgcatcctgaaaccatcctcccacctcagcctccccagtagctgggattacaggcatgtgccaccatgcccagctaatttttaaattttttgtagagatggggtttcgccatgttgcccaggctggtctggaactcctgacctcatgtgatcctcccacctctgcctcccaaagcactgagtttagagacatgagccactatacttggtctgaacagctcttttttaatcccttccttcaactgactgaaagtcagggccctgcccagcatcactttctctaactgctttagacagaggcagagatatgacttgaggattcattcatccatttgttcagtaggtatttacagattgcctcctctgggaaggtattggcaacactgaaaagttggtgtccccaggtttcagctgcctgaggctgaaacctttatttcaccttttgcacataatttcttgaaggacagatgtcctgatacctaagatgcttgtcacatgaacatctgtggaatatccgcccccaccaacaaaactgaattaaatacttagaaactacagtgctttaatggaatcttccatttggatccaggaactaatcaatgagaaaagatgactcttatcctaatttctgccaaaagaagagcaagtccatctttgacaatgatctctacactcacatgctcctttcttctgtagggatactccccaaactttacatttagaacatggtaaaaagcctctgaaacagcatgagtgagaatggtaatcccagggactaataacaacaattgccatttattgaatattgttcattcagaaaggcacggtgtgaaatactttttgtttttcacctaacgttatttatagtctaatggaagaaatagaaaagcacataagcagttactatccaggagtactatgaaaatgagcatccaggaggaacatgtaaaccaatctcagagttgtgaaacaattccccaaaaagaagacattagagtaagtcctgaaaattgggtaaaataaaatataaaataacatcataaccttcccaattaccaggaggcatttgtttattcgttatttgattattatttattcaggacatttagtgtgagaaagggaaaggcaaaagcatgaagaagttaagtcagtagctaaagacacaaactcagagtgaacactgaaatgcttttcagcatgtattatctcattgaatcctaataagaagcttatgaggtaggcactacagtattactcatattttataggtgaggaggttctagaactggtctaacattaaactgatagtatcaaagccaggatttgaatgctgcccgcagcaggccattggagcctttgctttgactgctgccctgagctgccacccaagatggcggcagcgtctcgcacttttcccatgagcacactgtgcaggtggtctcagcagcctgagtgtgagccacagactgattccattgcaatgggaaagcttgagacaagccaggaggcctacctccttttgagagtctttcaagcctggattcagtgcatagaaatacccaacataaaatttaatggaacgagtaacattcccatggggaagaagctgttgtgtctcagtggaaactaaccttgtgggagggtgctgttatgtctgcacattggagaggaagatagttttctttgggcatgagtgaaaataagtaaatgttatataaattgtcttgggtgaaactcctaagagccacgtggacaaggctcaggctacaccagggaccagcatgagtatgtttatatatgtgcggaaataggaaatgctaatctaacctatgctgttctttagggaattttgtcatttaattagaacccactctgtgaagtaataaaaatgatctttgcatttgtgcagtactttataatttatgaaaaccttgtatatgctaccttcttcctgaggtgtgtagagcaaatcttatacgctttacaggtgagtattcagagctatccaagcttacacagatagaggtggaagagttgtagtaaatcccagcctctcctgactcccaattcttgtattagtccgttttcaccgtgctgataaagacatacccgagactgggtaatttataaggaaaaagaggtttaatggacttatagttccacgtggctggggaggcctcacaatcatggcagaaggtgaaaggcacatctcacatggcaacagactggaaatgagagcttgtgcagggaaactcccctttataaaaccatcagatctcgtgagactgattcactatcacaagaacagcatgggaaagacatgtccccgtgattcaattacctcctaccatgtccctcccacaacacgtgggaattcaagatgagatttgggtggggacacagcaaaaccgtatcacttgtgttagtggtacatccagccttggaagggtgctttgatacgggctgaaactgcaactaagatcctgctggactaaaatcttctggctgggaggagaggagtgagcttggatgtgtctctatggaatatgcccttgttaggatttcactttcggcctctttcattcttgaaattctcaccaaggggtcagctagtgagtttatggctttcatctgattctattctcagtcctgcatagacctgggtatacgctgttggcctaggctggctgtgccgtgggcttacagagaagtgctcattggcttttcgttggattcgcctctccatgccttttcttgcctgggagcattacagccttgagtaccaggcttggagtgtggggccagtggccaaggaggccaccaccctgcttttggtccaggccttttaggccgacctgcacagcatgggcaaaaagtccttgcaatgatttacatactatccagtccagcttcccaaggatccctcagaggggttagagactcaaacccaagccctgtagaaacaggcactgtgattcatgtggggaccatccccatccatgttccttgtggacttgtgttattggtatgcagctgtcagagaactggagaatttaagatcctggtcattcatctgttatcttatatctcagagatgcagatgacaccctgcttctaaaattccatgttaaggcctaaaaaatcatttgcgtggtatattggtgctgaggaagggttcaacttggctgagtctgtgaagctgcccactggataggtgacactttgggcccatgcagggtcattgctgtgtctgggagtgccaaggcaggccttacccagcatgcataagggtcacacacctccctgctacttatttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctatatttctttgggggctactcaatgctttggggtcactgctggcccctttgaactctccacatttcaccactgatcccatttgggaatgttgatgaacttgcttggcagtaagagttggtcattctgtggcatgaaattgactgagacagcagatggacattgatgcacagagacggtggtcccaagggctgtcattgtggtggggtagttaccagcatggattttggtgtcaggaagacctggcgcaagtcctggcctttccgttggtatctgtatgatgtcactgtaccttggtttcctcacctgtaagatggggctaatgatcatacccacttcagtgtcttgttgtgatggttcttttagaggtttcttgggaaatgctcagagacagcatgcattaagcactcacaaactttcctatttataataagcaaaccaacaaatcataacttatgcatctttaaacagaaagtgaacacaaagagtgaaaggagaattttgttagccacagcatttttgtcaaactaggaaattagataaatactaggaaatcagataaatgttgtaactcctgagttttcaatgcatgaagatagtattaataataaaaaatggattatttgtagtaagcaggagtagtaaactcaacaggtcagggggccagcatgcaatgtaaatgagggacacagattgagtcgaaagtattggtccctagagagcagatgccacctctcagttaagatgcagttaatttatgccttgtgagaacgtgggtcttatgttgttacatcaactcattttcaagagaagccagaaatctgatttttaacatgtgagatctcccacttaaaaaagaacagtattaactagtttaaaaactttaaaaagattggcagtcacaacacaattccttttgatcaagaggccgacattttgtgacctttagatatagacagagctttgaactttacaggatgctttccttatgcattgatttatttggatttcataaggatactgtgaagtaagcctatcagcacccctgagatatttcataatgttgtaatatcgggttgcattttcaccagagctttgtgagtttggtgtccagatgtttggatcattggataaatggtgcttatttgcgatatcttttgacattaaatgagcccttgcaaatcactgacattattgaaactcagaatactcacatctagataggtaattgctctctaactcaaccaaaacaaatctaaaccacatcaagtcagcaccttaatttgggaaattcctcttattagaaaagaatctttaagaacctatactcaaggtatgcaaatctgaaatgcaaacctgatatgaagcccaagcctaactcatgtcagtcaggatgtttgagttgatcctgatttattattagcctcaagtaatggacattgtagggagattctgctgggctcaggactcatagtagcagcaactgccatttgaccgatgtttttgtcatatatggtatagaacagtaattctcaaacgttagtgcattaggatcacctggagggttccttaaaacacagattgcaagagcacactcccagagtgtctaattctgtaggtctagggtgatgtggcctgagaatttgtatttctaagaagttcccagctgcaactgctattctggggaacacactttgaaaacgactggtgaagtgtaggagatcaatagtaaaggaagattatgacctgggtcctgatgtgcatcacatgcccattgtgatatgcccaggagtttgtgtggtgtgtatattctgaagaggtgaaatagaataaaaggccaaatttagtcttgattaatgagagccttaaacatagcccagtttggaagtcatgcaagccgggtgcggtggcgcactcccatagtcccagctacttgggaggctgaggtgggaagatcgcttaagcccaggagttcaaggctgcagtgagctatgatcactgccactgcactccagactgggcaagagtgacaccctgtgtaactgtgtccttctcacattacactggctaatcaagaagaggtctttgcttatctcgggaacttgctttaatctatttaaataaagtgagatatctgttggttacttgacaacaccggtttggaaggtttgcccaggattggctgggcaggttgagagagtttgcctgggattgactgactgaaactatgggctacaaaattcccttggggaggccttagaggacacctcagtgagataagaagtcatgcagtagagaagatatccagcaacaccatgacagccccattgagagaggcttgccatacatatgatggtgtatagatgaagacatcaaatagcagatcagcccatcaagcctggtggccccttctccagcctgcaggtgctaattcgcgatgtgattgcttctcacgtgggcaactccaataggatgccaggagaagcagcaactgatgttcatttacttaatgatggttaatattttatgaagccagtctgtgtatatgcaagtatgacttgttattggcatatcaaggacaagtttattcttccaaggatgtcatgcaggcttccctcacttgtctttgtaccatgcattttttgagctaacccttcatttttggaaggattctgcctcaccggatctcttgtatatcttaaaacacaaagcacagaggctgcactgtacaggatgaggcctaagagaacgtggagactgtaggggatgggccacacagcatggcggagtttgtagaggaaaggttgctcataagtgctctgggtttgggagaagaccacacagctgagatctatttctgacaggaaatgccggcaggagcagagggtggtgtggggcagtgcgtgttggagctacagtgcccttggttaattattatctcagtatttctcattagtctcttgttgaattaaaatgctcaaaaggagattattaaatacacacagaaagggagacagactgacagacacagagacaagactacaccctatttacataatgcttgaacatatattaaaaatactttggattactctttgaccctagtatcactgtttctataggatcatataagtttagctagaagaaaagaatagagaatctgtacctttcttttgcataagatcgaaggggaaagaaaagccatgtgaggcccaagataaaagccccagctgtagatgaaaaagctgtgggccagacgtcggaacacatcttcctgtccatcatttcccttgtggaagcctatttcattaccctgcaggcttttaggctctagacagctttgcaataccaaatatcttgaaggcatttgtaaaacctactcttacttttttcctggaaaaaaaaaattatactggtttacttactattctaggtgggtgggatttttcccccctctgctaaattataaccagtcatctaagtattcactttatttttaaattcagggctgaaacttaaaaccttgagggttaccaaaaaatgttattcttaagagaaaaacatgcttgaaaacttaacccctttggtggcaggcaggggattttctttgtctgtgtttgagtgctaatgtcgacaactttgaggccaataaataccaaatggggctctaggatttgggcaactgtgatagtgtgtgtgtcctgcatgtcacatgagaaagagagaggccgggatttaagaaaggtgcctcttggctgggtggcatgaactcagtcagctggctttccccaggcacctgattggccttaaacactgagtttttgtggtgtgacttgacatacatcttgggctgatatcacgtgctgtttctactggggtgggaagtgctttgaaaatgtccttgctccagtggaactgtgagacatatctaaaaagcttaaggctaatatgagtgatgctaaaaggaagtcctgcttatccaggtaagcaaaagcatactctaggatagcagtgctcctgtaacctgcatggcctatttttcttttccaggtggtatgcaggcagtcttgttcatgaacattgatgtctgagcatgtgtgttcaaaattcagtgttgttaatcaaataaaactcaccacaaaacccgaaggatatttaacaatagatgagataggtttggcggagatgggtcagaagacagaggaggtcctggaggcagcagtagaatgtactttccaatcttactggtgactagagataagacactagtagcctgtttactccccatccttatttacactggagtgagaatgatatatgtcagatcagtattggatgcgatgagggagaatgaagagaaaatattgactctgaaaaatacagacaagaggaggcaaagttgaaagtaatgtaaactgcttaatcacctgcctttctctctttccaccgtcatctctttctacttgacatgttcctgcttttgcctctggatggttctatctctcatcccctctcagcctgggtccacagagaaaagcaggaagcagcctggcatggcagtggagggagccttttccagccttcctccagcagaagtgcgccctctcccctatagggagatagggcaccccaggcttcagaaagcaagggaaagatggtacttcatcatgtagcttttcttaaggggttggagggaagggctcccagttccggagagggtccatgtgccagccaccctgctgaatgccttatgttaggggggtgagatctcagatgtgcacaggtaccaggttgacttggctgagcttttgggactgtggtagccaagagagggcagactcctgaggggacagagagtgctcaactccaactgatgggcactgtgtgggaatttgagcccagggtctcctgcttttccaagagaacctggaaatccaattttgaaggaagtctgttgatgtttaaatgctcacaacagtttaaatactgtatgggccaaaccaaacataacacagattttaacacagtgtaggctggatttgttccctgtctcaatgaccctccccctctacccccagcctgggccaccagttttccacgtctgcatgtcacaacctattttatttaattacaaaaccaatagtatgtgggaatgggggctggggggttggtacagtataaagctatgtgagttgtagatacacttatgtatgttgggcaccttggtgggatccataccctataagaaaaccatagtcttgggtcagagtcagggctgctacttaaatcagttccttatccagcatgctggatgaactcatcagttctctgtaagaagtaaaaactacaagcactctttaaaaaaaatgaaaatgaatgaagagaaaaatagacttattaaattctttaatttggaagactgggtctcgctatgttgctcaggttggtcctgaactcttgggctcaagcgatccttccacctcagcttcctaagtagctgggattataggcatgtgccattgctcccagcactaaaattgactttcttgatgtacagctctctcaatttgaacacatgcgtagatttgtgcaatcactggtatactcaggcaacagaacagttccatcacccccaaaagtctcccaggaaggctgattttaaaactctaactggaatctaagtcattctgcttggggctaccttataccctgactttgaagaccctaaaaatcagttgagggtgggagggttgaccagaacatgaaacttgggttcccagccattggtggggaactgtttcataatgagcaccctaccatacctatataacaagtttttgcttcttcctaatacataccttctgctccagcctgggtcgtcttttcactatcccctactagggttgttccatttagcaactaaatgtataggatgcccagtgattccatggggacatatttatattaaaatattatttgttgttgatctgaaattcacatttaacaggacattccatattttatctggcaagcccatcctcttcacattcatgccacattctcatgtaagttcaaaacctactttctctgtgtttcaccaaagggtgaaaatactctttgaaaatactctttgattttattacacttaatcttagccaaaggccaagaagcgattgtatgctttgattttaaatagtagcatgtttatagggagatagggcaagtgttggaaggataagagtgctttctatacacataaatggattttcaagaaatgttttgtgaccaactggttttatcctttccagagaacaagaaatgatctaatatgtgctcaaggaaggaggacaactggatttcagaaattggttcatgttacagcccctcctctaccctttttctctggcctgacctttgaataatataagtctgaaaagactaaacaaagagattgctcaaactggatgagtttaaaaataacattggaatgctagccttcagcaagccatatatcttatactgcactgagcaggacagtgccctgtggtgggtagaagatgagtcacacagtgatcacaaccagatccttcccagcctggatactttggtggagagtggtgtgatggctgatttatttgtcttgtttgtttgttgtttcatttttccattttactagtgtgatttcagaatcacaaggaggcaaggaggaaaattgattttagatagcagcttcagaatgaaaaatgagtggaaattccacttttcggtctagaccagggaccagcaaacaatagcccgtgggccaaattcagcctgcagcctcttttcataaggcctatgagcagtgcctggtttttatatttttacaaatttgaaaaaattcaaaaaaggatcttttatgactcatgagatttgtatgaaattcaaatgtcagcatccataaataaacttttaccagagcataaccatgcccattcatgtatgtgttgtctatggctaagtttgtgctataatggcagaggtgaataattaaaacagagactctatggcctgtaaagccaaaaatatttactatctgaccatttggagaaaaactttgccaacccctgctttctacatggcgtatttcaatggctgtatttgcgatgaaggctccaggagccttttatctaaagaaatcactattgcctcattgcttacagtccagaacaataaagcatctcagacatccttttcactgttttctgggcttaccatgatgagaggttttgtttaccgaagctggcatgtgagttttgccgctgtggaattttctcattatatcctttgctatctaagccaactgcatgttgttgttgttgttgttgttgttttttgaaaaccagaaaatctgatctcttagggttaacagtttggcccatctgaaataagtccatacaattaaaaacatttctttctattgacagggactgagggttgagggaaagcactgcagattttccaggtgtatttttttttttttttgctccctggattttgcctgaaccctcacttttctctttcagggaactttaagcacacttagtgaaagactaaaggtcagagagcacaccagccacattccctgagtccaagcagggagccagagaggagtggtttctggccagccttccctgttcagttacctcatggaacccttgggaccagggccttgatttacaaatagagtggccactaggtaaaagttgcccatggccagtggtagcaggatcgaccctagtgtctctgaatcattaagtacttcctttctgccctcttccatttcttactcaaaaacaccagctacaattttgagtctggtctgcctggaaatttccaaagggactttggtgccttaataaatattttcaaattgctcaaggttttggaagatagcagagccataattgtgaaatcgggttaaagaatgattgctgcagtacttgcgtcggccctgtggccatgctgaagtggacagggttgtggacactcacaattgctcactgcagatggacagcctttgcttttctggtcatacatatgcttgatcctgaaattctctagatgggctacttctgagcagctgcttggagaatgggaagccaaccctatagtgtaaggtttcttaactgaagtaccattaacactttgggatagataattttctgctgtctgtggggccgatcttttgcattataggatgttagtggcatccttggtctctatccattaaatgctagtagcacaccccactcttcattgtgacaatcaagaaggtctccagacattgccaaatatcctttggggaaaaaaataacccctttgaaaatcactgatgtagtataacataaaggttacctgaccaaatgtacttcccattcttttaccattagggatttatccctttaagtcttcactctcatcattagggattaatttctttaaatgtcaaagtcttttttattttctagaatccctcacgacaatattgatttaactaacctgcacgttgtgcacgtgtaccctaaaacttaaagtataataaaaaataaaattaaaaaaatggtaaatccttaagcttgggatggcagatggttttcagctcctatgtgaactctaactgatagaaagtgtccatctatagtgccgccgtgggaagatctttgaagctgcattttaggtgttggagaaaggacattaagacagattagagctgtcttccatgggcaagagatgagggagttggcatacacgtgtaaggaaccttcttacctaacatttctgcggagattcactatagtcaggccttaggctggtgctgtagttcagccttactgctgagccctgtgccagggcactgttcacacaaggtccctgtagccttgtgtatttgttagggcaattttccagcaggttttgaggaaagggcaccttttctagatcacagagtgccatatgggcgagcagaggtgctgtactctgttgatgggaatagaagtcagggaacaaaaagagaggggcaaagaatataacttcctgtctgtctctcctgcctgactgtaaacttcttgaggccaatgactatgtcatattcaccattatctactctccgcctgtcacaacacattttgcatagtgtcaaagcaagtttagtgacttttagcagagttcttgttctgtatcttggactccttagcagtcttgtggaacctatgggtcgcttttcagaatagtgcttaaatgcacaaaataaaatatttaggattaaaaatataaccaatgaaatttatatatagtcagcaaaatattagaaaactgtgatagataatgtgctttgattgattgatgtacagtcagcaaaatattagaaaactgtgatagataacatgggatttgattgatgtacagtcagcaaaatattagaaaagttaaagataacatgcttttttattaagtaaaatctagtggcagttctaatacttactctaattgcaaattattggtgaatgtaagtgatattttgagctgtctccaacaactgtaatgttatataaaaagtctgtgattcctactcctaataaagtcatggtatattagtccaatctcacactgctataaataacttcccctgagactgggtaatttgtaaagggaagaggtttaattgattcacagttctgcatgtctggggaggcctcaggaaacttacaatcatggtggaaggggaagcaggcacatcttacgtggcaacaggtgagagagatcatgtgtgtaggagtaactgtcaaacacttataaaaccatcagatttcatgggaacacactcactatcatgagaacagcatgggagaaactgcccccatgatccaatcacctcccaccaggttctgcccctgacacatggggattatgaggattacaattcaagatgagatgtgggtggggacacagagccaaaccatatcatataggtactaatgatctacctggggcttgtgcttacattcataactgaaggcggtgctaaatgttagctagggggtggtaaaaataacctttagctgggtaccctaaattctgtcttatccccaaacgccctgaattctcacttctttcttttgtaactgggcccctgctctgatggtttcctcctttcctttgcctgatgctacctcttttaccttcttggggttcttccccagcaaatttttctaggttctttcttctgcattcactttccatctctctcagctgggttgtgtcctttggccgctatctaagttctcactccgcttagcatgggaagggaagcttctaggcccagcttggggttaccctgagcttcagaggagagagggaggttggcacatcacagatactcactgaatgctttttgaatggaaacagttgctttgccaacttcaccttttttatcaggggctcttcttggattcttggactgtgtttgagatcagttcactcttgatatctcccctccgcatggaaagcatccacaaatttccagctagagcatgaacttgcaatttggtttgcctagatcctggaagtctacagagttagaatctttcctggttctgaactcagaagcagcagtgagcagtgggactgctgggacctttaccagcaatcacccaccacatgcaccagcttcaagcagctctgcagaagccgtccgtcaccctccccgttgcacaccttggctgtgaaccgccagggcaggggcatgtgtgggaagcaggcggcctgcagattcattattgctacaagtgaatttcataataaacaaacaaaaatgagccatctctagtttagttccctttgagcatataggccatcaggtcccaaaatgttcagagttgggttagtatctgtggctttcaccaggtaaacacatcagtgttcttcctaatttggactgttgtggcttccctagttcttttttcccctagattgttataaaggttctgtattagttttccagggctgttataataaagtgccacaaattgggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgtccaaatttccccttttcataaggacaccaatcatgttggaatagggcctaccctaatgacataagttgatgacttctgaaaggaccctgactcagaaatatcctgaggtactgggggttaggacttcaatatatctttctggggacagggtccttgcatgctgtcagatgatacctgcatctcgcagtgatggtcaagcgtaccctactctgcttctggctatggcagtagaaattgtgtcccaggggaatggctaaggggcctgtaaacaatgggtgccatatgccattaatggctcaaacctctgccttgtctacacactcatgtatcccataaccctctgtctcctgtcaaagccttttatcaggaaaggcatagaaccacatttcacgctaaggcatgagtgttaaacataccctcacctagccagttaaaaacattgggcaaagctgtaaactacatcacaggagttcaaaatgtcaacagagctgcccccagtcctgtctgtgtttttgcttaggacccagtgttgtgtcactactccccattgataataaacaaaacatgcctcatatgttcacagttatttagagtttacagaattctctccttctatcaatttgtttgtgcctgaaggagcaggaaaggtattattttctgcattttatttcagagaaaacagaagctcagctgagtaatttgttcaagatcatccaggctgtggccggagcccacatcatccatgtctctatgtcagctgtctttccactgctccaagccacctgccctgctgccctccgtttcccctccaggtcactgttgtgcggaccatgcaacccgagtctcaaagactcacggatccccttgctgtgctctaggacccagtcctagcacctcctaacctccccaagagggcaaaaagcagcctaggtctggtgagggtggccaaggccagaggattctgttagtatgcagatcaaaggaggagcatgggcaaagtgacaaggtttgtgatggagcagaacagtgtcaggaagtgatgtgaagctcagcgtggctcgtggatgttgagaagtgaggttgatgggcagggggtgctggaccacagaagaccaggtgttccaagtggggcaaagatgtggtctgtgagaggctgagagccactgaagacctgtggtttatcagagactgctgtggtggcagagtggaggcaggatgaggcagggagctgctccaggttcctgactgccggtccctgccagtgctggtacattcctcaaggcttctcagtggctttccattatttccatagaggggtcacctttagttttggggagtttatttttgagatggggtctcactctgttgcccaggctggagtgcagtggcacgaccattactcactgcagtcttgaccacctgcgctcaagtgatcctctcacttcatcctctcatgtagctgagactgtaggcatgcaacacgatgcctggttaatttttttgtattttttgtagagatggggtttcaccatgttcccaggcttgtctcgaactcctgggctcaaacagtccacctgcctcagattcccaaagtgttgggattacaggcatgaaccaccgcgtcggccaccattaggtttttaactgtttaaggcattctttttatactgaaacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactataagcttatttttagggaaagctaagaattcagtcagagccactcggattccctattgcctgccatacagaatgtgctgttggtggagagattgatgggcagaaatcctatgtttatcacctgattgttacccagcacctcccatgtgccagtataaggtttactgatttgaaaagaggatggagatcaacacaaacacacttttaaatcagaggagcatatttcaaggcatttatatttaagaactaattttagggccaaagaactaatattgtaagagcttctgtgattaggtacttaatatatactactgttatggtaagtgtttagcaaatactaccgcatttaatggaaacaataatactctgttagaggaattcttatcactgttttaacagaagaggaactgttaacttgaggaggtttaacgttagcccaagaccgggtagctgagtccagattcaaactcagatctgtctggctccaaacccatgcaaatgacccctccgggtttggcaattaaacgactcacatgttgccaccctttgttcctatgtatcactaattgatcatggaattatttcttgctcagctcagatttgacctcaggatcctttcaacacaatgctacaggtagccactgctcccaactgagcaatggtagtacttgaagtagcgtctacctgtcatcttagctttatctttctctgtatttactcaaaatagaatctttaaatctacaggggtttgttgttgtttatttctacagatgtatttgtaaccttttattgattaaacaattgtaagaaatggagtattcaatacaatttccttttatagtcactggaaactctgcgtgctttaatagaggatcctaactgccttggagggaagaatgacgtcttaggactcaaagccttgatacaggcaactggcttatgtgtcagtgtggtagtgatgagtgggagatggggaatcagcctgaagaactcaagctgtatagcagtaaaactttcaattagcccagtctggttaattacaactggatggtgagttggggttgggggatgtggtgggaaggctaaagaagcaagataacagggtagatttgggggttgcatacatacacaccttcagttgccgtgaaacatttcagctcagcagacagacctgttgtcctaaaagtatagcaccatgtggggctgtgggtccctccagggagaaaggagttccttaaaagcaaactcagacaagagaatggggaagatacccccagggatagtggtgaagggagaacctagaacccagccttgcaggaggatgaggtagaaattggtccaggaggaagtctatggacaatatctaaaactggagcatcaagaaatagtaatagaaatatgttgcttagaaaggtggattccagatgattgagctgaaatggagttggacagtcacaatgtatggaaggtagtgcaggtgcatcaccaacacagattcattcgataaaattaaaatgtttttgttttactttcaaaaaaataaatagcaaaaaagcaagctcaggccagtggtggctggtggcctgtcagcatggagcatggaccttagccacaggccagggctttaaagccaggactccaggacctgggatgggtcattctgaaagctgattatcagaatgctcaggccagagctgggccagctgcccaggtgttgatatgtgtgtgtgtgtgtgtgtgtttgtgtgtgtgtgtgaagggctgagaactgcatctactaacatactccttgtgtgatgttagggttagtgaattgacctacagtggtacttggcctgcaggaaggggataaaaatgggcatcatggtaagaagttgggccagcaagcagctctagtctcacaaagccttttcctggactaatgagagggaccatggggaggggtgatccccccaaaatcaaccagatcaagttcctgatgaatgggcaatttatgactgaccagctggacacaaaatgccattgaacaacccaaatgaacaacacttctcagtcaaaatgctgctttggagagtctgtgtatgcaaatatacctcatatattcttctcactgtgggatggagcaagaaggccctgagcgtgtttctctaaaaatgcatagcaataatcctagtcttaattttagcctcttctgggcatctgaaatggggttgctacagttaaaataatgctgtataactaacatgatattgggtattgaggtcagagcagggctggcttcatcagcacgtgatttctgtagtcacataggttccccactttgttaaatgctccatagccatattgaaattcttaataacttttggaccaggagccctgcattttcattttgccctgggccctacaaattatgtagccagcagtgggttgtcataccccagagtcccagacaccagccagacatttgctgtgttgaaattatataggggaaaaatataatttagagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggaaaaaaaaagaaacactaacacattaaaatgtacacattaactgtaagatgcattgctatttcagtaacattataatgcgagaggaaacacaatagcatatcttagaattgacgaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggccatcctgaaagtccccaccttctcccaggtagctccagagaaagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatagaagttagttgttttcccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttatttacccctaccgagttttctaaatcagtgaatcagtattttaaggaataaatcttaggcacataaaatgataggaataaaatatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgggcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagcggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaaaggaaatttcacaaaggcttttacattcgtgtaatccagatgagaaatgaagatagggggcgagcaacaaagttgaaagacccaaattgattccggaaggacttgccaagtttctataatgcctcattagctgcttatgtggcagggagacctgggaagagcaataactcttttctaggttctcaggttagggaatgagattttgacgtggccaatatgatcttatatgtccatttatgtcttttaccttatcattttcttttaccttatcatggacagagtggccccccagaagcacaggatgcaagacaacacacatttcagtggctgctccttctgcatacatcattgagctctgccaagggtttgaacacacacacacgtaaataaaggcctaattatgtgtgtgtgtgtatgtgtgtgtgtgtgtgtgtgtgtgtgtgtattatatgtattaagctctttttcctttctccatagcactgcatatacaaagatcagccaccctgagttgaaataaactgtcatgatctgtttggcattgtgagatcaccactcatcataaaataagctttttaaaatgttaaaattgaagtgagagcatgagcacaaagaaacaaggaccagaaggtgtttataatcatgaaaaattgggaacaattcaataggaaaacaggaaaatggttaaatatgatatgttcggagtatggaatatgatgcagcagttacaagtagtaaaatagatcagtatgtactgacatgaagaaaatagacttacacataccttatgtaaaggaggtgaggaaaaggaacaatggtcttttctgtattattagaatttgaatatcaaaattggattcatatattacttatataattaaaaaattaagttagtcagacttagaactctttgaaatctaatttttgaaagttaatttatgccatctggaggcaaacatgccaatgtgattgaagtttcagtggtaacctgaatcctcagtctcgttgcacatttactctgaagacattctcaaaagagaattggagaggaaatccacccagtgtgtcccctcatgtatgtctgtctgggatgctccagtggtgagatgccgtcacctcagtccattgtgttagtttattgcaatgttctagggttcagtctcagccccattcctgccaactgttagcttaaggcccttgggcaaaggagataaaattgttcagggccaacagatctcagagtttcttggaaccttaaaaggagatgacccaaacatttcttattcaagatgccaccagctccagtcactcacagtgacttgccacaggggctggtgatgttagctgcttccttggcgtctgagttctggcttgtgagcagatcttatgcccaatacatcagaaactccatgtctccttcagttgtagtcgttgggagaatccatgggttgactggagcctaaggaaagcaccaaaaagtcactagaggcactggagtggatatgaccttttcctttgaacagcagtttgcacaacatataccggtggctttgtagatctggttttcattaccatttctgtcctggggcagccatggaagccacctggatatttcaattagtgcagcaagctggaattcatttactttagagtctactgcctgaagcttctcccagctgggcacccaactacgcccaggaacttctagatataacacagcatcctgatttcagtctaataagtagatctattttagtcttctcaatttccagtcattttgaaagtgctcccctgtccccataccaggcatgggttccattcccaacttctatcactgtcagtggaggtggcagccttgtgagctgccaggtgggaccaggtgcaacccacagcaaggccacttgatgtctcagtctgtagagtaggtgcttaataattgtctttgacgagttaatgggtgcagcacaccaacatggcgcatgtatacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactatagagcctttgtaactgagctactggggtctacctcatttcagaatccctcagagtccatggtgtatccattcatgcattcattgagcaaatattatgtacctgttctgtgttagagaatatttgaagtggtgggaatatagtggtgagaaaggcatgtttctgccttcaagacatcaccatatgaaagatactctgggatggatggagggtgttaatagaaccccagcaaattgacaaggtggctccccctgtgtcctctggctagtaagggactggtggctccatgaaacagggagctgccctgtgctgcccaaggctccagccctgcttcctcctcatctcccccctggacgtgactctgcctcatggggagcccattctcttagggatctttgtaaactgatcttcttgtgtcaaaaacatcaaatgcctcagattccattgcttataataagcactttgggaccaaaggaattttttgtaatgaaaaaaacagtttttcataagttaatgtttttcctttgagacctggatgcccttctcttattcatccactgcccatgcagctaatcagatttgaagggtaaaataataccagacttatcattgcatgttacatgagaaatgtattagttaggagtctggggttctaaggcatagagacagcatgagctagctcaaggaaaaaggggagggaattgttataagggcacaggggtgccccacagaatcgaaaacagaaatgtgactaggcctaaggaaagcgtcaaaaagtcactagattttttttctctctttcatctctcttcccatcttccccatccatctatccatccatccatccatccatccatccatccatccatctatccatccatctctctttccttctctccttcccagctcctgcctctgtatttcttcctccttttttcttccaactttcatttcaggttcaaggggtatatgtgtgcatttcttatatgggtaaattgcatgtcacggggggttggtgtacagattactttgtcacccaggtaataagcatagtacctgaaggtactttttggacctcacccttttcccaccttctaccctcaagtaagccctggtgtctgttgttcccttctttttgtccatggtatactcagtgtttagctcccacttataaatgagaacatgttgtgttggtttttggttcctgtgttagttcacttaggacaacagcctccagctctatctatgttgctgcaaaggacatgatctcattattttttatggctgtgttgtattccacggtgtatatgtaccacattgatgtccaccattgatgggcatttgggttgattccatgtctttgctgttgtgaacagtgctgtgatgaacatatgtgtgcatgtgtctttatggtagaatgatgtatattcctttgggtagatacccagaaatgggattgctgggtcgaatggtagctctgttttaagttctttgagaaatctccaaactgcttgccatagtccgcctctgtatttcttcctccacctagcttcctctgctttctggtccatgaggtcaatcaaatagggttgccccatagtgtctaagttttcatgtcaccagcccagccacatcagagagactctcgtcagatcagctatggccagaggtcatattgttccatagtggttcctggatgcagattaacttccagcgaaaagggacacattttgagcaggacagacatggccaaagctatctaatatgcccaagtctacacacacagacacatgcccaaatccctctcatggctacacatccaaccagagatggtcaaatggaccctgccctgaacccacatgggaggatatggttctgacttgagctgcaggatcccagggcttgtgttgaggtgggaacagccctggacctgagccagaatactggggctccagtcatggcttcaccattaaacaactctagagtcttaaacaagttcttagcctgtctgagtctttattttctgtataaactgggagtcacagaggcagctttcaattatttaaaggaccactttatgggagggggataggtgtgttacctgtctagtgttggaaggtgaaaccacagtggagaccacagagtggcaatttgtggctggagatacagaagaaccttctcccaatcaggctgccccaccatgttcaacctgcctgccttgcagagagttggctctccctgttactgtgggaaatccaaggggtctcagaaaacatctacagaatggagatactggcccatttcctagcaggattatctgtgtttgtctgggggtgaggggagtaaatagaagtttgagtgctacatacaaatgtgtattttttgcattgtaatcttaacaaacagaaagaagtattttgctccagtttgtatattctttcaaagcctttgaaccacactttatttttttagacaggatctcactctggcgcccaggctggggtgcggtgttgtgatcatggctcactacagcctcaacctcccccagctcaggtgatcctcctgcctcagactcccaagtatctgggactacaggcacataccactatgcctggctgatttttgtatttttgtagagacagggtctcactgtgttgcccaggctggtctcaaactcctaggctcaagtgatcctcccatctctgcctcccaaagccctaggattacaggtgtgagccactgtgcccagctgaagcacactttttagtgtgtctgccacaagggtttccaaggccactagctggcagaaggataaggtggaaatgtaaatgacatgcccctctcttcatgaaaacaatgtcagttgttcctctcagtccccaccataacagtttctgaaattctttctcacctccttcacttatttatcctttctgctccctgctagactgctaggggtggggacaggagtgatgtctgatcaccactgcctctgtgaccataacctctgatactgtcatttcttctttccaaagtcttggctatcatttgaggagctgagacaataggatagttctgctttcacagagcatattagcaaataccctgtgtgaggccctaatgacatatttggccctttccatctttggggctgtaatattccctacagatggaccctttggttaagtctccttatgttgcttttagttttcatcaatctctggttggtttttagaactactaaatggagccattaggtcattcaaaaacaggcagatgtatgtatgtttgtgagccatgatagggatccagaaatatttacataattttcatctattaagagatttaacagctgtgtctgccatgtagttactttaaaatataaaatgcaaggtcagatctcttggggatactgttttgtttttcttttcttatgattgctgttaacgatgtcatgtttaagtaaggaaagaaggttttgatattcctctaagagttaccagcctgtggaggagttgtgctccaagaggatcgaaggcttagaattcaaatgtaaaagtgtttaccttcttaggccagtcatctgatcaacacgtaatgtagctgaattagtacacatttccaaagaatttacgaaacaagacaccttgcaaaactagcagtcaaataaaacagaactctaaaattgaatttaaagtacagttttgtctggctagccatatgtagaaagctgaaactggatcccctccttacaccttatacaaaaattaattcaagatggattaaagacttaaatgttagacctaaaaccataaaaaccctagaagaaaacctaggcaatatctcattcaggacataggcatgggcaaggacttcatgtctaaaacaccaaaagcaatggcaacaaaagccaaaattgacaaatgggatctaattaaactaaagagcttctgcacagcaaaagaaactactatcagagtgaacaggcagcttacagaatgggagaaaatttttgcagcctactcatctgacgaagggctaatatccagaatctacaaagaactcaaacaaatttacaagaaaataacaaacaacccaatcaacaagtgggcgaaggatatgaacagacacttctcaaaagaagacatttatgctgccaaaagacacatgaaaaaatgctcatcatcactggccatcagagaaatgcaaatcaaaaccacaatgagataccatctcacaccagttagaatggcagtcattaaaaagtcagggaacaacaggtgctggagaggatgtgaagaaataggaacacttttacactgttggtgggactgtaaattagttcaaccattgtggaagacagtgtggcgattcctcagggatctagaactagaaataccatttgacccagccatcccattactgggtatatacacaaaggtttataaatcatgctgctataaagacacatgcacacgtatgtttattgtgacactattcacaataggaaagacttggaaccaacccaaatgtccaacaatgatagactggattaagaaaatgtggcacatatgcacaatggaatactatgcagccataaaaaaggatgggttcatgtcctttgtagggacatggatgaagctggaagccatcattctcagcaaactatcgcaaggacaaaaaaccaaacaccacatgttctcactcataggtgggaattgaacaatgagaacacagggacacaggaaggggaacatcacacaccggggcctgttgtgggggtgggggtaggggggagggatagcattaggagatatacctaatgtaaatgatgagttactgggtgcagcacaccaacatggcacatgtatacatatgtaacaaacctgcacgttgtgcacatgtaccctaaaacttaaagtataataaaaataaataaataaataaataaaatacagttttgttttgtatcatgaatattgttgctacttgggaaaaacatgtttaatcaggcactaaaggggcagctgaagtgtttgatggtgattctcaaagggattcttggacccctcaagagttttagaagatagtgatgctagtattttattatgtataattatactgtaaaatacatttttgatacattataattacttctgtttatgacttaggtagtttttgccttgcaaaagggagatagggaaagaaagtttacttaaataattggaagcaaagggggaatgaggagaaagctaatgaagatgtgaatatttgtgaggaaaattgcctgtaagtgtgaatagggtgtgaatggagagtggatgtgtctggcagcacctcttcttattcttatcatcttactggggtgattgaagttgcaaacacatggcccttcacttcttttgtaaacggacataattgatccaacacagcatgattgctttctagtgcagcaattttcagaatactgccttctcaaagatatggttctcctgattgattatgaaatgagataaaaatataagtccttggtttaataagtgatgaacaagcccataaaatactaggtttttacttttgctagagtaatctactaagtgagttattaagggcctttctgaactcaagttagtgtgtcaccatagactctaattagtctgaggactctaattagttctgctaaaaagtctcactgctattcggtgacaaagctcctataatgtggcatgcatgtaggcagttgtagtttccaaaaaagaaagaagtaggtggagcataggatgctcaaagtagacaatgatcaaagacttttgagagtcatcagtctaggaaagttattctcaaccctggctgggtatcagaattgtctgtagtgcttctaagaattatgagttatggccagacgcggtggctcatgactgtaatcccagcactttgggaggccaaggcgggtggattacaaggagtttgagagcagcctccccaatatggtgaaaccccttccctactcaaaatacaaaaattagccaggcatggtggggtatgcctgtagtcccagctactcaggaggctgaggcagaaaaatcgcttgaacctgggaggcagaggttgcagtgagccgggatcgcaccactgcactccagcctgggcgacagagtgagactccgtctaaaaaaagaaaaaaaattatgagttgctggactgcatgatgatctactgaatgagaatccattctccccccagtaaacttttcctttatctcctttatctcattggcaggcactcattcacaggtccactcaagacagtcacggacaaaaggaaacaggattgtgaggatttagccccatggggctagagcactgctactgaaaaaaaaccaccctaactatatttgcagctttacggtgtgtaaaacttcagtttaaaaacaaaagggaaaaaaggtctctgccttcaaagattataagctattcattcaaaaagaccaaacattgtaagaaataactggataattaatccataaagggcaagagaagtagagccagcttttattgagtacctgcctacctgtgtgctgtgtgctgtgtgctgggtgagtactttatatatgtcacttcctttaatcctcattttaatcttcagaggtcagtagtgtcactggcattctacagattaaaatactgtagttgagggaatttaggggatttgaattgcatttcctctctagaatggggtgagacagaagtggtgtccttctttcaggcatctaggtttgtttctttggggtgtgtatgtgtgtatgtttccatgtgtgtggcagcttaccaggctatgtcccaattaataaggagatgtatcatcctcattccagtttttcaaatgtgacttgaccaaaatgcattctattcctattctttgagtttatatgccagaaatggagtgggcatgtgtgtcttctcaggactaatccatgcatgaagctctttgaatcagcacaatattgtacagcctagttgcgttctgttcatcaagcatcggtcgatgatttattgacaatgcaaacaagtggtctgttcatgtgagttcatgatgatttgtgagtgcttcctgcccatctgctctctcattttaagtgtgctctgtaatataaaaatgatagtcatacaataattctattggggtagatctgtaccactacccagagatatttgtttgacttttactattattttacaaaatgggaatttctttcacaaagaagatgagttcattgtactttggctttttgtaagagaaagtgaatgttgtgacactgacatgaataaatgaattcatgttttctgatcccgtggaaaggaaagaatagaataatatcagcacgtggatctcataatgaaaggggagtaaagtgagtcttcagaaacagacttaaaataagctcaattcattgtaattagaaaatggatcttgaaagggccttgccaaaaggcgatgatgtgatgttggggtgtagaagttttttgacagtggactcttttatcacagaatgtgaggtgaggcagaggaaatatgattcatgttatagtgctttagttattgattacataggagtttgctttctccagctcttgttcatagctgctaactggcatacagaggaaatattgtttacttatttaaataatttttaagatagtgaaaattctgtatgtttggttaaattatacttggttgtttgcataggctgtctctccctgagacgctcacctcacttctctatgggtcagcgaaacacataccctgtgtaatcacctcccctataaaaccccatggcaacctcttccaacaattcatcctttgcattccatccaagtatgtcttgttatatccatagcatttagtgcatttattatttcctctcctgctttcctctactagattttgagagccttaaggactagagagtgactgattcatccttgtttccccagcaccctggagcaaagagcccagcacatagtagttgcttgtggtgaatgtaattcagggtgtcttaggactatcctgctcattatgaatagaggataaaaacagatttctaagttctccatctgccataaaattctgggaagaaaaaatatgaagtattcctttctgcacacacagaagtcttccattttgcaattttctatctagtctgctgtcctttctctctcttctttatcagggctacacatcctctctcctggccagagcgtcatttgaggcgtgcttatgcagttctcattgtcttcaattaaggtttgggactgagattaccagcttggcttggtaaccctgttcacttattaaaaaatcagtcgatccttcatttttatgaaaagatgcaatgcaaaataaccttgatttagaatttaatgaggctgacatttaacctgagttcagttaggaagacaaacaaaaaacacagacaaagttgagagaaggaaaataattacctacttgaatagtgtgggcaattctccatccatatgccccaggagaatatgaggtgggagatgcatgaattacctgaaatttcttttagcctctgtttatgattttagtctttcaagatgcaggtatgtttttcaggccttgtggtccccaaacacaaggaaactttctttatctgatggtcaaaagaagtgacgacctagtccttagtaggagaaaaatgtgcctgcatggactctttgtgagacagtgttgttggatactttatgaacattttaagggattctcatgagtaattttgattatagacgatttttactttatgcattgactaggaaccaaatgcaactttcttagagagacacaaaattcattgtccaaatagaccatagggtcagcaggctttgtaaacatgttttgtatgtgcctaggggttgagagcaggggcgggagaggttctggtccgttcatcaaaccaggggctggtgttaatgtttgatcaacaaaacacatgtaggcctaggctctgatctaggtccaactgccaacatagccttttcatgcctgcctttcctacttcaggtagagagaggagaaaaaacctattgaggaaaaaagaaagaataatattagcccaagcagtggttctactcacttaaggagaatggagtatgtttatttaattttaactgaaaagtcctggccaatatttctaagcctggcttgggataacagaatgaatggccttgggggagagggaggagaaagaagatgactgattttagtgtctgctttatggtgtgtgctgtttaatcctcatgacaatcctaagtggaaggaagaactccccatgttaccagtgacgcagcggaagcccaggtgctactgaaggtcacgcagtcagcattgacgaagtctacactagaatccaggcctgacacaacccaaagtctgtattttttccctctgcagtctcttaaaattggcaaaaggtaaaccttcatgcgaccctagatttgattggaacagcagatttaggggtcatgcaacaggagaatgagtggattataagtttttgagtccccagatctttggggagaaaacccaattctgttgaagtaggagctgttcaattggaggtgagatttttagtagggatttctaatgcattcttttttcccattgatggttgttaatacttcccctacacacacacacacacacacacacacacacacacacacacaagcataaatagggcacacgtattctcccatgtaagggctgctgtcccttctccctcccacttatagcgatgtgtgcctctctgtagctgaaggttgccttgtattaggacactgactgatgagtactccccaccagggtccggagagtgtgcttcattcacctttcagcctctcacagttctggcacaggggagataaagatgttgatggtttgaggtgctttttggtaaataacataggcaaacacttgacacccctaggctaccacctgtcctgttgtgtggatacctattcagtgaagccagataacttttacaaatcacaatgaatacatcctcagcagagccagttgcctgagggaggttactgaatcttctgggagtcgtttgcaggcctttagacactgggctcctttctggaccatgcccaaactagtgacagatgcagtcagagtagcagaataaggaagtctaaagtcacccaagcctcttagttcttgataattgacatgtccagcatttcttgaccatcagtagaaaatactaaactttacagtacataaaataatcaattcattcctctgatggggcaactatttaagtcagtatggaactctatctttctgattgctgcattagtccctttttttttgtttattttgcttcttagtagaaaagaaaaatctaaaagattctcattttaagtgacttgagctatcagttaaattttaaaagccaattattttgaagcagtagagccttacgaattctaaagtcacacactggaagccaaactatctagagtataaatatttccttttgagggggatactgacagattcttctattttatcccaattccagttcctgacctccactcacagacagggaggcaaggggaaggctcactaattggcaaggctggacaagcataaaggattcagtgcataaagaatcaagcttctgatcctctcaagaggtcacacgcagagtgtctatgtgctggacagctttggctgtacacaccagaagtgttccaggcgtaaggtttttggcaagtctcgttgcctacgttcaagtcctctctgagtcgcttactagtgtgtaaacatagctgagatatataatgtttctaagcctcagtttcactgtctgtaaaatggcaatgacaataactgtacccacctcacaaggatgctgtgttgtgaggtgtgaacgagccatttgtgtcagaacatagcacagtgctgggctcacactaagcattccattcatgtcagctactagctctttggaacttttcaactttggtccctagggctacattaaccctctttcctgccagacaataatctgaggttggttgctgctttcagaagaaacagtgtttgaaagctaagaaaaatgtacctagaaatctaatttctaatttcattgtcatgccttaacagaacacccagatgccttaaaagacttttacaaaatgcaaatttctgatccagaaaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcgtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttttaagatgtagttctctggctaggcacagtggctcacacctgtaatcccagcactttgggaggccgaggcaggtggatcacgaggtcaggagtttgagaccagcctgaccaacatggtgaaaccctgtctctactaaaaatacaaaaattatctgggtgtggtggcacacacctgtaatctcagctactcaggaggctgaggcaggagaattgcttgaacctgggaggcggaagttgcagtaagccgggatcacgccactgcactccagcctgggcgacagagtgagcctctttctcaaaaacaaaaaagaaaaaataaaacatgaagttcccaaccatgtgctgtgtagtgagcaccatggtggccctgcagtgtacaaaggtgaattggccatggtgtgtgttggcatggagctcccagtccagctaagaatacccttcagggccaagctgactccaccctgtttcctgaggcccagtcagcggtcccagcttctggtctgtgggctcacctagtttaaagacccccttgagcctcaaaggatgttcgaagcatgattcagttggggagttattggtcaacatggtgggacaattcttcactgtgtgggactgccctaaacagtacagggtacttagcatgtctgccctcccaatgctgagtaccagtggtgctccacagtcactgtgacaatcaagaaaagtaatgattgccacatgtttctgaatacccctgacctctggggaataatactgccccaagttgagagcctctgtccggtttaggtctttctcctcagtccatacctctgctacctccttaagggaccagttccctccaaggggcatgctttcttagaaaagtcatttgatggccgggcacagtggctcacgcctataaacccaggacttcgggaggccaaggcgggcagatcacctgaggtcagaagttcgagaccagtctgaccaacatggtgaaaccccgtctctactaaaaaaataaaaattagcaggacatagtggcatgcacctgtaatctcagctacttggcaggctgaaacacaggaatcgcttgaacctgggaggtggatgttgcagtgagccaagatcacaccactgcattccagcctgggtgacagagcgagactccatttcaaacaaaacaaaacaaaacagaaaagaatgtcatttgacagtgtacaaagtttatatattttaacatacaaatgaagttgacatggtatcaaccaaagggaaagaagggccattttgtaacaggcagaaaccagttgggatttaagaagcattttaattacccttactttttttctataaaggaaaatacttttatttctttcactgatgtgccggtgagagtcttagcaggcttgcctttgtaggtaaatatgatggcacttcccaatcatcatgtattgggatgtgaagttgtgtggagtctgaggctgacccctggtagtgtgaggaccttgggggattgccttggaaaatacagggtccagcccaaggctctggctttcagggtcgggggttgagatgaatttgtcacagctccgcctgagctcaccacactgggaagtcaaacagaggcaacagcttctgtttgctaagtgttaccacatgctaggcactgtgttgagtatggtgaaggacctcttaaatcttcagaacaaccgacgtttcagcattttacagctgcaaaaactgagtcttagcaaacatggtcttagagccacgagaatggacctgggacttaaatcccaagtctagagcctggacttgaccacagcagcatccagcttctcacccatctttcgctcaattcatccctttaatcatttattttaggattcagtttgattcccccaatctcaaaactttcaaggatgaacaatacttctcacacaaacacaccttctaccgaatgccaggaggggtctgcacttagattcctcagctgtcacagtgccattgagtctgaggctgcctgactgcttggttgtggttttttgacacctggcatttgtgtttaacagccccagtggttgagaagcagaggggacccacactggcagaggtggagggaaagaggagagggtgtagggaaagaggagagggtgtagggaaagaggggagggtgtagggaaagaggagagggtttagggaaagaggagagggtgtaagggaagaggagagggtggagaggtagaggggagggtgggggaaagaggggagggtggagagatggagaggagggtggagggatagaggaaagggtggagggatagaggggaaggtggagggaaagaagagagggtgggggcggttccaagatggccgaataggaacagctccagtctacagctcccagcgtgagcaacacagaagatgggtgatttctgcatttccaactgaggtactgggttcatctcattggggcttgtcggacagtgggtgcaggacagggggtgcagcacattgagcattagccaaagcagggcgaggcatcgcctcacccaggaagcgcaaggggtcagggaattccctttcctagccaagggaatctgtgacagacagcacctggaaaatcgggtcactcccaccctaatactacgcttttccaatggtcttagcaaaaggcacaccaggagattatatcctgcgcctggctcagagggtaccacgcccatggagccttgctcattgctagcacagcagtctgagatcaaactgcaaggcagcagcaaggcttggtgaggggtgcctgccattgctgaggcttgagtaggtaaacaaagtggccgggaagctcgaactgggtggagcccaccgcagctcaaggaggcctgcctgcctcagtagactccatctctgggggcagggcatagctgaacaaaaggcagcagaaacctctgcagacttaaatgtccctgtctgacagctttgaagagagtagtggttctcccagcatggagtttgagatctgagaacggtcagtctgcctcctcaagtgggtccctgatccccgagtagcctaactgggaggcatcccccagtaggggcagactgacacctcacatggccggatacccctctgagatgaagcttccagaggaatgatcaggcagcaacatttgctgttcagcagtattcactgttctgcagcctcggctgctgatacccaggcaaacagggtctggaatggacctccagcaaactccaacagacctgcagctgagggtcctgactgttaaaaggaaaactaacaaacagaaaggacatcgacaccaaaaccacatctgtacgtcaccatcatcaaagaccagaggtagataaaaccacaaagatggggaaaaaacagagcagaaaacctgaaaattctaaaaatcagagtgcccctcctccaccaaaggaatgcagctccttgccagcaatggaacaaagctggacagagaatgactttgatgagttgagagaagaaggcttcagatgatcaaacttctccgagctaaaggaggaagttcaaacccatcgcaaagaagctaaaacccttgaaaaaagattagacaaatggctaactagaataaccagtgtagagaagtccttaaatgacctgatggagctgaaaaccatggcatgagaactacgtggcgaatgcccaagcctcagtagctgattcgatcaactggaagaaagggtatcagtgatggaagatcgaatgaatgaaatgaagtgagaagagaagtttagagaaaaaagagtaaaaagaaatgaacaaagcctccaaggaatgtgcgactatgtgaaaaaaacaaatctacatctgattggtgtacctgaaagtgacggggagaatggaaccaaattggaaaacactctgcaggatattatccaggagaacttccccaacatagcaatgcaggccaacattcaaattcaggaaatacagagaacgccacaaagatactcctcgagaagagcaactccaagacacataattgtcagattcaccaaagttgaaatgaaggaaaaaatgttaagggcagccagagaaaaggtcaggttacccacaaagggaagcccatcagactaacagtggatctctctgcagaaactctacaagccagaagagagtgggggccaatattcaacattcttaaagaaaagaattttcaatgcagaatttcatatccagccaaactaagcttcattagtgaaggagaaataaaatcctttacagagaagcaaatgatgagagattttgtcaccaccaggcctgccctaaaagagctcctgaaggaagcactaaacatggaaaggaagaaccagtaccagccactgcaaaaacatgccaaattgtaaagaccatcgaggctagaaagaaactgcatcaactaacgagcaaaataaccagctaacatcataatgacaggatcaaattcacacatcataatattaaccttaaatgtaaatgggctaaatgctccaagtaaaagacacagactggcaaattagataaagagtcaagacctatcagtgtgctgtattcaggagacccatctcatatgcagagacacacataggctcaaaataaagggatgggggaagatctaccaaggaaatggaaaacaaaaaaaggcaggggttgcaatcctagcctctgataaaacagactttaaaccaacaaaaatcaaaagagacaaagaaggccattacataatggtaaagggatcaattcaacaagaagagctaactatcctaaatatatatgcacccaatacaggagcacccagattcataaaacaagtccttagagacctacgaagagacttagactcccacacaataataatgggagactttaacaccccactatcaacattagacagataacgagacagaaagttagcaaggatatccaggacttgaactcagctctgcaccaagcggacctaatagacatctacagaactctccaccccaaatcaacagaatataattattctcagcaccacatcacacttatttcaaacttgaccacttggttggaagtaaagcactcctcagcaaatgtaaaagaatagaaattataacaaactgtctctcagaccacagtgcaatcaaactagaactcaagattaagaaactcactcaaaactgcacaactacatggaaactgaacaacctgctcctgaatgactactgggtacataatgaaatgaaggcagaagtaaagatgttctttgaaaccaatgagaacaaagacacaacataccagaatctccgggacatatttaaagcagtgtgtagagggaaatttatagcactaaatgcccacaagagaaagcaggaaagatctcaaattgacaccctaacatcacaattaaaagaactagagaagcaagagcaaacacattcaaaagctagcagaaggcaagaaataactaagatcagagcagaactgaaggaaatggagacataaaaaacccttcaaaaaatcaatgaatccaggagctggttttttgaaaagatcaacaaaattgatagaccactagcaagactaataaagaagaaaagagagaagaatcaaatagacgcaacaaaattgataaaggggatgtcaccaccaatcccacagaaatacaaactaccatcagagaatactataaacacctctacacaaataaactagaaaatctagaagaaatggataaattcctaggcacatacacccttgcaagacacatacacccttccaggaagaagttgaatccctgaatagaccaataacaggctctgaaattaaggcaataattaatagcctaccaaccaaaaaaagtccaggaccagacggattcacagccaaattctaccagtggtacaaggaggagctggtaccattccttctgaaacgattccaatgaataggaaaagagggaatccttcctaactcattttatgaggccagcatcatcctgataccaaagcttggcagagacacaacaaaaaaagagaattttagaccaatatccctgatgaacatcgatgcaaaaatcctcaataaaataccggcaaactgaatccagcagcatatcaaaaagcttatccaccatgatcaagtgggcttcatccctgggattcaaggctggttcaacatatgtaaatcaataaacgtaatccagcatataaacagaaccaaagacaaaaaccacatgattatctcaatagatgcagaaaaggcctttgacaaaattcaacagcccttcatgcgaaaaacactaaataaattagatattgatgggacgtatctcaaaataataagggctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtacatttagaaaaccccaaatctccttaagctgataagcaacttcagcaaagtctcaggatacaaaatcagtgtgcaaaattcacaagcattcttatacaccaataacagagagccaaatcatgagtgaactcccattcacaattgcttcaaagagaataaaatacctaagaatccaacttacaagggatgtgaaggacctcttcaaggagagctacaaaccactgctcaacgaaatagaagaggacacaaacaaatggaagaatattccatgctcatggataggaaaaatcaatatcgtgaaaatggtcatactacccaaagtaatttatagattcaatgccatccccatcaagctaccaatgactttcttcatagaattggaaaaaactattttaaagttcatatggaaccaaaaaagagcccgcattgccaagtcaatcttaagccaaaagaacaaaggtggaggcatcacgctacctgacttcaaactatactacaaggctatagtaaccaaaacagcaatggtactggtaccaaaacagagatatagaccaatggaacagaacagagccctcagaaataataccacacatatgcaaccatctgatctttgacaaacctgacaaaaacaagaaatggggaaaggattccctatttaataaatgatgctgggaaaactggctagccatatgtagaaagctgaaactggatcccttccttacaccttatacaaaaattaattcaagatggattaaagacgtaaatggtagacctaaaaccataaaaaaccctagaagaaaacctaggcagtaccattcagcacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacagaatgggagaacatttttgcaatctgctcatctgacaaagggctaatatccagaatctacaaagaactcaaataaatttacaagaaaaaaacaaacaacccaatcaacacgtgggcaaaggatatgaacagacacttctcaaaagaagacatttatgcagccaaaagacacatgaaaaaatgctcatcatcactggccatcagagaaatgcagatcaaaaccacaatgagataccatctcataccagttagaatggcgatcattaaaaagtcaggagacaacaggtgctggagaggatgtggagaaataggaacacttttacactgttggtgggatgtaaactagttcaaccattgtggaagacagtgtggcgatagctcagggatctagaactagaaataccatttgacccagccatcccattactgggtatatacccaaaggattataaattatgctgctacaaagacacatgcacaggtatgtttgttgtgacactattcacaatagcaaagacttggaaccaacccaaagtccatcaatgatagactggattaagaaaatgtggcagatatacaccatggaatactatgctgccataaaaaaggatgagttcatgtcctttttagggacatggatgaagctggaaaccatcattctcagcaaactatcgcagggacaaaaaaccaaacaccgcatgttctcactcataggtgggaattgaacaatgagaacacttggacacaggaaggggaacatcatacactggggcctgttgtggggtgggggtaggggggagggatagcattaggagatatacctaatgtaaatgatgagttaatgggtgcagcacaccaacatggcacatgtatacctatgtagcaaacctgcacgttgtgcacatgtaccctagaacttaaagtataataaaaaaaaaaaagaaaaagggtggagagatggaggggagggtggggggatggagaggagggtggagggaaagaagagagggtagggggaaagagggtagggtgggggggtggagggaaagaggagagggttgggggagagaggggagggtggggggatggaagggagggtggagggaagaggagaggatggaggggtagaggggagggtgaagggaaagaggggagggtgggggatggaggagagggtggagagaaaggagagggtgggggggtggaagggagggtggagggaaaggggagggtggaaagatagaggttagggtggagggaaagaggggagggtggggggatggaggggagggtagagagatagaggagaagttggaaggatagaggggagggtggaagggtagaggggagggtggaaggaaagaggggagggtgagggggatggaggggaagttggagggatagaggggaggtgggaaaaaaagaggcctggagctggtgttaggaggccagggtctaaaccccacttgaaaacctacctggtggatgacatgcacagactctctgggcctcagtttcccattcacatataagatggggaggcctttatccacttccctaagagggttgttgtgacaattcagagcagtgttagagtccaaagtcgggtgaatgcccctggggagtgtacaggaccatcctttatagtgtgagtagaaagtcttagcatttttattttttactcaacaagaaattaggctttacaaatatttgatgtatggatggaccatgacatccacaatcagctgcgtgttctgggcatgtcctcaaagaaagaagggactttgcaaacgggaaggggttgggagctctatcctcattcattcccttgcagcctttgtgatgtttgattgcaatttgccacttctggtgaggcgggtacgcagaatacattatccagcttaaactcaacaaaccctgtttcaacaaactgaagaagtggcttaaaaagttttcatgaattaaaagctaattaaaatctataatgaacaatatccacataaaccaaaaaatggcagagttaacacttcactgggaagaagtttttgttgtcgtcgttgttgaatcagccccagtaagatgtgaaaaaaaaaacagactaatgatatctgacaagaagtcggcccaagaagttcaaaattatcaaggtcaggtgcagtggctcatgcttgtaatcccagctctttgggaggccaaggtgggaggatcacttgaggccaggaatttgcaaccagcctgggcaatatagtgagattccatctctactaaaaatcaaacagttcggtggctcacgcctgtaatcccagcactttgggaggccaatgagggcggatcacctgaggtcgggagttcgagaccagaccgaccaacgtggagaaaccccatctctactaaaaatacaaaatttgccgggcgtggtggcgcatgcttgtaatcccagctactcaggaggctgaggcaggagactcgcttgaacccgggaggtggaggttgcggtgagccgagatcgcgccattgcactccagcctgggcaacaggaatgaaactcggtctcaaaaaaaaaaaaaaaaaaaatcgaacaattagctggatgcttgtagtctcagctactcaggaggctaaagaggatcacctgagcccaggactttggtgctgcagtgagctatgatggcactaccgcactctaacctgggccacagagtgagcccctgtctcaaaaaaaaaaaaaaaaaaaaaaagaagaagactttttgaattaaagaaagatttacatctcctctcattaatagcactattgatttttatttgatttaacacattatttcattgttattacaaattatgtgttttaaatgcctattttgatgtataattctataatgtacacttagttcagtagtacatgtgtattacttgtatttatcatgtgtgaatatatatatatacacacatggtatgtgctcaaaatattttacagattagagtatgtgaaaaaaatttgaagaccactctgcataataaatgtgcaggggctggcccatgagacatgttcagtaaatgcttgtttccatcctctttctccctggaaataaagtcgatagtgtgtgtgtggaccttgcttattaaaggaaagtggctgatttgatttctggaacaaggtgcatctcaaactagctggcagcactacctcggcctggccccatcccagctgttcacaccgagttccagacatttgtaggagcccggacgaggccagctggctgcctatcagtggccttcttctgtcagcactacacagttgtcacggctcacatccaaccgccagacagccaagaaggagacgccaagatttaaatctgcagttcctgacctccgcaaccacacccgattctttggttggtcctagacaaaaacaacggttttgcagatttgggttctctttctcaaactgccttttgatgatttatttgtgagatatgattgctcctcttgcaaatcagagctggttgcagtagctaactaacatttattgagcgagtagtatacccaggcttcagctaagtgctttctggaattatttaattttcacagcaaccatgtagagtaagttctgccactggcaccactttacagataagcgaatggagacttagaaaggttaagtaattttactagaggaacataaactaacagtgaaagtgagaaatctcagagtctcattggtctgacagctatgtaaggaactgaggggatgtaccattgcaaatcgtcaaaatggaaataccccaaatgcaatgcaggactctggatgcgattctggaacaaagaaagaacacttgtgggggaaaaaaaatagtgcaacccagagtctttatttaacagtattgtatcaatgttaatttcttagttttgacaaatgcatcctggttatgtaagatgttaggattatgggaagctgggtaatgaatagatggagagtttctgcactatgtctgtactgtttttgtaaatgtacaatgattccaaaataaaaggtgtatttaagaaacagaaatgccaagtgtatatgtgtgagtacacacgtgctctcacatgtgcatgtgtacagttgtgcatatgtaagtctttgtgcatatgtaagtgccccttgctgcacaccccctgctgttctgtgtgtgctgctccactcaagcccctgggacttacatggatgtcagcgagaaggaagcctacacaactcacatgtgacatgcccgccatgctctcgtcatacctcacctgtgctgtagaacccctgggtcacaggtggcagtcttgttcccccataacaaatgccagaaaatgatgtgtgtgtgtgtgtgtgtgtgtgtgtgcatgtgcacacacgcatgcacgcacacacgctctggtaggggggtttcaggaagtcattcgtgaagatgcagtgtagcatccagaataaaataaccaatttacaccttaaacactcttctccagtaaggccactacagctgcctctgcttactaagtgcatttgaagagtcctctgctttatccgtactctatcctcctgaaaagaggcactgacctgaaagggaagcccaggagcttctaggcccagacttttgctttgtttctcaccatgtgctgtgtcaaaactgagagaatattttgatcaccttttagctaagagctatctcctgggcagcagcttaaggctagagtaaggacatttcacagtttaagagagagcagtcactccgccaaatggctctgaggtggccacaaagtgcttgacttgcaaaaaattgctccattaactagattcagggattttcaggatttatgggctaggctgtgctaatattactgtggtgcttctcagtataattgctagaggcctccagtgagcagaggaattgtgtgttcagtctgtcctgggtgacccttactgcgtagtcctagggagacaaagaaaacccactcaatccaggaggctacagaaatgatgtttgtggagatctcagtgggtatctaatctgtaacctcagggggagaactctagctggtctcagtctttgctggaaacagaacttactggatgtgtgtgtttactcactcattcatttatttgtttatttatttactgtgacagggtcttgctatgttatccaggctattcttgaactcctgagctcaagtgatcctcccacctcatcttccaaagtagctgagattacaggtgcatgctaccacacccagccatcattcatttacttattgagtgtctaccatgcaccagatgcccaggttaagcataaaggatatagagcaggacaatcaaaaagtctcagattcagaaggaggagatggataaaaaccagcaagatctaaagtagataatttgattatgataagcacaaataagcagagaatacattgatgtgatacagagggccatgtggggggcagtgtgattcctttagattgggtgaatcagggtgatggcttttcagttgacattggaagaatgaggaggaaggaggaagaagtggcagccgggtaggacagcaggtcttctctgtcccccgagttcttctgatgtcctgcacagaaacctgaggggtagagtagcaaaggagaaatccaagctcaggctgggaaagaagctcatggcaccaaggttagggcttgtgataacagggacctgcttcaagagaaagggaggtgggtggcagattggtctcatggctgccacccacataattctaaaggtctcccaatgggagaacagccaccctggtaagtgtccagcatcatacaaggagtctctgcccattgtgactcttgcttgagcccccacacttagccctcaccaagctgtgtgatttaggattcaggtgttagaacggagaaggcaccaggcctactgcaccatatcaatgaagcctttgctttggggaaaacagagctgggtacaaataccagtgccacccattcttccctccatgctctggacattcaacccatctgagccttaatcccttcatctgcaaagtaaggaccatgcagtcttcctggtagtgttgtaaggctcagatagaataaccagacagttccaggtgcatatggcactcagtgagaatccacttgctttatcctccctcactcccttccttcctccaggaataaagagtacactagttgaagaatatttctttgccttccttctttagcagctccaatcccagcctaacagcacaatgagcatcagatgtgcttttttgatgtttgaaatttatagtctctgttgaatgttggccaggacagcacttcgtcatttgaacaatttccattttccacaagctctctgtgattgatgacctaaccaggcacatggcattccgttccaccagcaatgtggccagtggggagatggctatgtcagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacgtatagggagatctgacagatagaaggggagaaggcaatgcgatcaccactaggtagaggttagagggatgcacccctaagtcagggaatgccagcagctgccagaagcttaaagaggcaaaggatgaattgtcccctagagcctccaaagggagtgtggcactgcttatgccttggctttggacttctggcctccagaactgtgagagaataaatatctgttgttttcgatgggcgtgatggctcacgcctgtaatcccagcaccttgggaggccaaggtgggcagatcacaatgtcaggagatcgagaccatcctggcgaacacagtgaaaccccgtctctactaaaaatacaaaaaagtagctggccgtggtggcgggcgcctgtagtcccagccactcgggaggctgaggcaggagaatggcgtgaacccaggaggcagagcttgcagtgagccgagatcgcaccactgccctccagcctgggcaagagtgcaagactccatctcaaaaaaaaaaaaaaatctattgttttaagccaaccagttcgtggttatttgtgtagcagccctagaaatgaagacagcctgcgagcaccttgccccacctggctgtaggtgacttttggtgccaccatttttgactcttgtggataaagagcagactatattctttttataagtaagtccaccttttacagaaaaattaatagccaggatcatggttttagaactcatagaatacactcctctcatcctctcattctttcccccacccattggcttataaacttgttcctatgaaataagtcagctgagttgagtttgtaaatgcatcttgaataaatgtgttgggtggggtcacaaacatgcagacacctgctggtgagtgttactgacctgcactctgaaaggcccctatattgatgatacttcttaatctcctatggctcttcttcagccctgggagcaggggagtgcagacttttgttcaacccctttcacagatgtgcacactgaagtcccagtgtgtccagtgacttgctcaaggtcatcagcactgtctggtggagctgggactcgaacccagtcctcctgctctcagctgtgggaaatggagacagcagttgccctggaagatgtttcctgtgctgcgtgtttgtggttgtctcaggatttgtgagacttactgttttcttgtgtcccctgtccctgtgacttatctttgtgcccactcagccatcaccacttccaacacacacccacacctgtggagagaatgcagcctcctagagctcatgtcatggcaggactgagggaagtagtcagttcttggtgctctctaatagggctctgaattgcagcctgggccgtgcccattcatttatgtattgtctatagctgcttctgtgttacaagaattgacagagactgggtgtggtcgctcacacctgtaatcccagcactttgggaggctaagacagaaggatcgcttgagcccaggagtttgagatgaacctgggcaacatgatgataccccatctctacaaaaaaaaaaaaaaaattagttgggtgttgtgatggaggctgagatgggatgactgcctgagcccatggggtcgaggctgcaatgagctatgattgtgccactgtctcaaaaaaaaaaaaaaatgttgacagaacaagttgattcaattatagacttgagtagttgtaacggagactataaagcctaaaatatttatagtgttaactttgataggacaagtttgccagctcctgcactagaggataaagattaacaggattgactccacatagaggagaggagaggaaggggcaaggatggaagcaaggagggagaagggttagagagaaagaaagagggaggggggtcactcagagacttcacaaagtatgttatttcctaaaaactgtaatgcccagtatctagtgattacctgtggcactgtcagccttctgcctgggaacaggaatcttgcaaagatcaaatgcagggcccagagccccaggactctgcattggcattcgtcagtaagttttgaaggaggcagacatctcaaaaccatcctaagcataaggcacccagctggtgatttgaagatagccatcttccccattactagttggcctcactttaaaaaatgttgtttcttggatagcatttttctttcacaagttggtttgctttcacatgtcaaaaaacaaaaccagggctgggcgcggtagctcacacctgtaatcccagcactttgggaggcgaaggtgggtggatcatctggggtcaggggtttgacaccagcctggccaacatggtgaaactccgtctctactaaaaaaaagaaaatacaaaaattagccaggcatggtggcgtgcacctgtaatcccagctactcaggaggctgaggcaggagaatcacttgaacccgggaggcgaaggttgcagtgaaccaagattgtgccattgcactccagcctgggcaacaagtgtgaaactctgtctcaaaaaacaaaaaacaaaaagcaaaaacaaataaacggaaagagagagagaggagagagagagagaaacacataccatttgccatatttgtggtttctcattcttgcgctatttttttaaacctttcattacattaggcctttatcagatattagcactggttcttcagttttccccctgatcaggaacttccctgaaataaatgctggtaagatcgtggaaagttcccaggagaaggatagaacaggtgtaccccagggaggctgagccagtacagagagacctatgggtttcacgggccctcagtagaactgatttcctctccttgtctcaggttgtcatcagccactgagcaagaccgaataagggatctcgtgaggctttggagatggatgcaggatctgttgcctgcgattcaaagctggtggaggacttgcttaggtcatgttaattagtttttctcagctctcaccaggtgtcattcatggaggttgcataaaagaaactcatacccagggatgagctttttcttaaatattacctttctgaattttgaaatttagtgtagcattgagacatttaaacacatttttgaagcacaaaacttatttatcctagttcaaagccagatttggtttgacctgtcttggtggtgttttctgtggttctgagatccaacccccaacttcgtcccttttgacctagtttatcacccatgtccttgggttgaaaatagtagtgtaatcctaagagaaggggcctgaaaggaagggaagagaaatcagatgtcagctggtgaggatgagaaatactgcaacaagggagcagcattgacccttgagagctacatgctaggtagagtcaagctctacttgccctaagtcaaaaatatcattgacttgtggctaaagcccagactttgaagagcaaagaaagcaaggatttaactgcaaaaatagaaaagtggctgacccaatgctgaggcttttaacaaaatttaccaaatagtttatttcagactgagaaagaaagagctcaaacaagcttaagcagcagcaaatgctatcagcctggaccatgagattgcatgtgccctgcagtgatcttccaccttgactgacattaaaactacctggtagtggccgggcgtggtggctcacacctgtaatcccagcactttaggaggccgaggcgggcggatcacgaggtcaggagatcaagaccatcctggctaacacggtgaaaccccatctctactgaaaatacaaaaaattagccaggcatggtggcgggcacctgtagtcccagctgcttgggaggatgaggcaggagaatggcatgaacccgggaggcagagcttgcagtgagccgagatagcgccactgcactccagcctgggcaacagagggagactccgtctcaacaacaacaacaacaacaacaacaacaacaacaaaaaaaaaaaaacactacctggtagtgtttacagccttgagtgcccagaccaataagatcaaaatctctgaaggtgaggcctgggcttggtgctttttgatgatcctcaggtgatcttaatggtcttccagggttgagcactgtggggaaaattgaggccaagatgtggaggcatctaactggctcgtgcatgttaagaactggatgagatgggaagccagacattagaaataatggggtcagggcaccacttacatggtattaatagccagaggtcttgaatcttcctccagactacagtgaagagagatacacatgttatctacctggtgatagataccaaagggaagcaaagtaccacactgaagcaaagtaccatggaaggactgctccccacttttgatgcatgataaagaccaacctgcctgcatgaagatgatggtgcacttctcctgaacttcaccatcatgatcacagtcaaagccagtgatgatggagtataatcacaccagtaaatgaagttcccctgctgtcttctgactcacttctaagtggcctggaccctggtggttaagaaaagtaaacccccaaagcagtcagtcattgtcggtttgctaacttgagcatcctgaaattaaaggactaagtactttaactgggtcacctctattagtgggtaaaaagctgtgtggtctttgttcacttccttaaaatgctgctatacgtgatggcaagcaacagaactagccacgagaaagcaacatggaaaccactgaagtcaagacttaatcctacctggttccccatcaataggtaaaacaaagtggttctgagcacaaactctgaagccagatgatcagcttttaaaaaaaaaataattaaagaatatttatttatttatattttattttagattcaggtggtacatgtgcagatttgttacatgagtatattgtgtgatgctgaggtttaggcatctaataatcctgtcacccaagccatgaacatagtacctgataggtagtttttcaacccttgatcccatcccttcctccctccttttggaatgcccagtgtctgttgttcccacctttgtgtctgtgtgtacccaatgtttagctcccacttacaagtccatgttgctgcaaagaacatgatttcattcttttttatggctgtgtagtattccatggtgtatatgtaccacattttctttatccaatacactgttgatgggcacccggttgatttcatgtctttgttcctgtgaatagtgctgtgatgaacatacgagtacatgcccttttgatagtatgacttatcctttgggtatatatcagtaataggattgcagagtccagtggcaattctgttttcagttctttgagaaatctccaaactactttccacagggcctgaactaatttgcactcccaaaaacagagtataaatgttcccttttctctgcaacctcaccgacatctgttgttttttgacgttttaatagtagccattctgactggagtgagttggtatctcattgtggttttggtttgcatctctctgatgaatagtggtgtagagcattttttcatatgtttgttggctgcttgtatgtcttttgaaaagtgtctgttcatgtcccttgctcactttttaatggggttgttttttacttgtcaatttgtttcagttcctataggttctggatattagtcttttgtcagatgcatggtttgcagatattttctcccattctgtaggttgtctgtttactctgttggtagtttccttttgctgtgcaaaagccctttggtttaattaggtcccagttgccagacggacagctttgaattctggtcttaacacttcataactgggggatctaggggcaagttacctaacctctctcagcctcagtgtcctcatctgtaatggagggataatagaagcttccccccagggttatagtgagggttgatgaggtagttcatttaaagcactcagaactgcgcgtggcacctgtaaacactcccacccccagtaccttttcacaagtactattaggatgatgctgttagcagcaattatcagcacctctcatctcaagttatattgctagtgacaaaacctttggcatttcagtgtatagctttccaatcttttccataactgtattttttcttataaaagtgagattatactgagcatactctttgctttttaaactgactatattgagaatatctttctatttcatgtaatctacagcttcatttgcaatgactgcataatggtgcagatatatcatagattatttaaccaaacacctgtggtttaatacttaagtctctctcttttttaaaagcaatgctgcagtaaatatcattaagtaaaagcactgctcattggcataatttcccctttagaataaattcctagaagtgaaatgtgttgttcaaatcgcatataaacttgaaagtgtttgctattctatatgactgccaaattatcctctagaaagattctaccaccaccagcagggaataaaaagtcagtttcccctcactatacttgacactgggtattacagtttttaaactgtaatcttttgtatttgttcttgacctaaagctgagctctgctgtttggggcttggcttctctgaacttggtgctgattcttgctttaactggagcttcctactggagcatcctaggtgggctctcactggctcaaacaaccctatgaggctcttcttagtcttctaggactagagcagggctcagccaagcacatggtgctggcaggacacttggagctgtccctataccagcagcaatcttttgtcttgcttatttaattaccttatcctaaagtacgtctttactagaaatttgctgtcctcagtgagaagcagtacctttcccttgttccctgctgaaccaccagggtcactaccagcagatcagagccacttccctgtccctgggggcatcgtcttagactttggtcaccaccaaagaggagacataagaagaagggcaggaagaggtagcattgagcaagagctctggatttgccatcatcagctgaggattctgaattaggaaacatatctatttaggtttaaactacaaaatatgcaagggttcctattccgagcctctcagaaacatccctctggccacaggcaactgtcactggtgatggttattctctcagaagatgctgaggatcagggtgtctaaggagtagctttgctttaatctgagcttggtatattacattttccatgttagcctacctaatagggtgggttcacatagaaatactagaaaacacagaaggatataaagagcaaagatgaaagcattccaaatcctaccatctagatacaacctatgttgatatttagcatgtatgcagaggatagatgctatcctgtagcatgatcatttatatgcatgtgcgtacacatgcatttactttttataaaaatgatataatactgaacatgctattctgtagtcagtttttaaaagaatgtatctttttttttttttttttttttttttttagatggagtcttgctctatcatcaggctggagtgcagtggcacaatctcggctcactgcaacttctgcctcccaggttcaagtgattcccctacctcagcctcctgagtagctgggactacaggtgtgtgccaccacgcctggctaattttttgcattttagtagggacagggtttcacaggttggtaaggatggtcttcatctccagaccttgtgatctgcccgcctcggccccccaaagtactgggattacaggcgtgagccaccatgcctggtgcccccccctttttttggggtgggggaaacagggtctcactgtgtccccaggctggagtgcagtggcacaatctcagctcactgcaacctccgcttcccaggcttaagcaatccttccatttcagcctcctgagtagttgggattacaggcatgtgctaccatgactggctaatttttgcattttttgtagagatggggtttcaccatgttgcccaggctggtctcgaactcctgagctcaagcaatctgcccgtcttggcctcccaaagtactgggattacaggcatgagccactgctcccagccttaaaagaatttatctttaatggctgtgttttatttatacattttcagtcattcattatcaataaatactgattcaggcccagtatgtgttaggcatgattctaggcaagagagagaaaccatgaatgagagacatggtctctgcccttggggagggtgtaatgaagttcgtcagttttgtgctttgtggtttctttctatgcgttatgtttttaaagtcctcttccatcctaaagtcagacaatcactatattttctcatgttttcactttttacattgcctgagtccatctagaaattgttttggtggatgaaaaattttctacttttaaaccattggaggacagcaatgaccacaaaaggattaaatcctctttccttatagacaagtgggcacaacttggctatgcagtaattctaacatcagcagtgcaaagaagggaagtacagtgttgattcttcatgggagactgatggaattataatagacttctgttcttaaggtagaaaattatcatttttttaacctgaaaagatagagtaatagtctatgataaggacaaattaccccaatatgtttttaaaacattgcaattattaacaaagtggtagtttctttcatttaaaacccccttgggccctaaagatatagctaacaagaggaaaaactgtcaaaactcttattaggtggttgagtttattttctgctcacaattgtatcatttaaaaccctgagaaactgttttttggagagcaatttgtccctattagagttttatgtgttcaaatccttgacttagcagttctgctggtagaaatccaccctatgtatggaatcacaaaagtacgtctaagatgaacatagaggaagattcattgcagtcccgtctataattgcaaacaaagcactgagaaccacctaaattatctattagcagcagactgctaaagtaagttaagctacatctgtgaatcgccatgccgtagttgcaaagaatgtggtgggattccatgtgctgaatgaaatagtaaaatctctaagatacatcacgaagtgaagaaagtaagctgaagggcaggtcttttgtgttaagaataaaagaccccaacttatgttggtgtatccattttttcctgtaggatgcataaaggactaataggaattgttgcctgaaggaacaaagctggtagggatgaggtgaagagaaagtcaaatgttcattttattcctgtgtggatggtgtgaatttttctaccctgcatgtttattacttttatttatgttttgtaatgcttactccatttatctaggcagggagattatagacaattggtgtttccttctttatacttttctatattaaaaaatgaatatagatcagaaatgttcaccagatactggcatctaagaaacaaacaaaaacatgatttgtcaaagtcagaaaaggagtgtatgtctctgtttggaattatgctaatttcttggagtttgcgttcctttgttgtcatcagaatgctgcacattgtgttctctttctatttttgtgcacactatcttgttttgtatttccaaccacgacagctatgttcagttgtgccccatcccctcccctgttctgtggcctgcggtgctgagaactgcgagcagccaatgggactgctgcttactgtgaggtccatgcagtgtccacccccgcttcctgccctgagactgcctccaggcctggcacgtcttcctaagacaggcctatcaacccagtggatccttctgccccttcctcctcctgtcctccaactttagggagccatattctgatatccagagatcctggatttagagcatctcctccattcttggtaaattgagaaccttcccaactgctgcctcatctgcagtagttcctttcagatgaaaagttaaaatgggagagaaatattttgcatttgctcttttcattagactattcgatttctatgtaaatgtcttctacagggattgaaagaaatgaatatattggttcaccagacattgctgaaggttccaacacagccttgacctatttttgtttgaaattgagaaatgctcacaaatgtaagaggcctccttttttggagattggagggatttgacatcaagatgttttgcattttcaacagctcatttgccctggatggcttttggcagataaatgtggaggtggcagtgtaataggtttcatgtgtccagagtggaattcacccagagccaaacaaaagctagtagctctgaacatgtctcttttcatggtaaagtactctggagtgagactgtttaagtttcaacccctgtttggccacttcttagctcaagggcacttcccttacagtagctaagtttaggttgtttcatccataaaatggaagattttaaagtatctacctcaaagtgtgatgaggattaagtgaaaaactgcggggcaattcttactataatgcctgacatagcaaggcatcaataaactcagttgccattattattcttaccattatggtttataccactaccatcattgggattattaggttcaaccactacacaactgaattgttgttgcatgagtaaattgcagttgtttagacaaaatcctaagccaaaaacttcgtgctaggtagaaaggaagcaccttcatttattaagtccctgcactctaccaggtgatgtgttagttccatctttgctgtatctcatttcaatcctgcagtagcattttgcaggtagttctatttcagtatttcagacggagttccaattgtttgatgcttactagccatgtgaccctgtctctttatcttcctgtgcctcagttttctcctctgtaaaatggggataatgatagtacctaactcattaggttgttgtgaagattaaacatgttaaatcacacaaaacagtgcctggcacacagtgaccactatgtaaatgtttgctagcattactttataactcaggaagggcacatgtgacagtctggaacgtgtgaagtcgttgttctccttagcactgtggaatgttagtgatgctggaggaaacttagagctaagctggcccaacctactcatttcacaggctggggatccaaggcccagaaacaataagggacttgtctaagtcactcagggagttcgtggcagagcccctacctgatacgagatctcctgactctgctcacgagacttcatggtgggaataaggcaacacacggagagggatgagatggagatcacattcttcgggagagtttgattctgttattcctgccatttgggactttttcagagtcctctaccattctgcctacctgtacagaaagtgctggatttttccaccacaaggggcttatcaatgtggtgtcataaagcgggtcttactttctcatcagagcccatatcagaccacttcccttcttggtctttagaggaaaccaaagtgaagcactcctagcaaagaatttgatgttatgaccatcaaagcaaaagtatagctctatggttaaataattacttaaagggtcacaccgtgggcagaccttaaaaaacagacttaagatataacccatatgggctataaagtatctataaaggaccctaaatggaaactctgctgtgttgtgcatttgacttggcactaataggccagatatattaactgttgggtgaaattaatgataatattgcatctaaattctatgggatgtttcttaaggttttgggtgttaaattaccccttctaaaatccagtattgaggctcgaactaatcaatgtcttctttttcttttaaaaattctcttgaccatattgtttctattacaaatgaaacatgaaggtagaaagtagaataataagttacaagaagtggagaagggagtgtgtgtagtggaggatgagagaggttggttaatgggtacaattatacagttaggtagaaggaataagatctaaggttggatagcacagtaaggtgactttagttaacaacaatatattttagattttaacatagctggaagagaggactaaaaatgttcccaacacaaagaaatgataaatacacgagatggtggatgtcctgaacaccctggttattatacatcctatgcatgtaacaaaatattacaggtacccaacaaatgtgtacaaatatcatatgtcaataaaacaattaaaagtaaataactacagaaaacaatacaaagctggcagttccttcttttacagatagatggcaagctcaagtccaaataatcagttgaagaaaagagaagttatgtagatggaaatgctggtccaaactaagggatgaggaataaatagagttgtggaattatccacttcacctggtgatgttgcgggttaaatgggtacatggctaggcagaacaatgtagaaaacctaccttacttgttcttctgaccaagccttttaaggctgtcatttaaaatggctctgagttctgtttcttagttttgtaggatcagaaaatcacatgccaacttagctttcagctacttatctacaaacccaagtgtctatttatttttcagtggatggacactgcaggggtcttagcaagtaccatctctccatttagctaactacataggaagcctgaatagaaatcaggattatgattggtgatcttgaagacagagccaggagagtgagttttaatatctgatggtgttgagatgagataactgatctcgaacagggatgtgtctgctgagcaaactcagcattacttgttagctggacaggcgattggacaaagctgagtgagcacctcttcaattttttttatgcttgattactcaggttttcagtttttagacagactatttttcttttttttcccctcagatgtataaatagcattgaatctgcagtagtgttagaaaggtaattataacccaaccatgtctgagatgacattgtgatttcttaatagaaaaagcttgttgggtccccacttgcaagttgatttttcataatttaattctcaaaatgtcaccttatttcttggtgtaacccagataaaacctaggtatcctggcaatccagtttcagcatgaagttatattcaaaggaacacaggctagttggccaaagtaatttcagtatccttactggaatcttctggagaacatcagaggggattcattttataagccacagtaaaatatctcaagattctcttttcctgatttcctggccttaatatctcagccttttcattttaaactcttgaactttaaactgtctctgacccctttcagtgctttacttcttcatctcttctttccttttctcgatcatttttccccctaaatagcatccccacccattccctttccaagtgcaactatataaaacagtctgtttctcgcagtttttcagtactttacctctttctctgattcttcatttcaaaagcctaggaatcctctggcaaaaagtcacttaaaaggtttggggcaaggaaacaagattccctttagctcacatggaaggaagtcaaagctgaattatcttcatctagcaatagaaagaataaagattgcaacgtttacaatttaatatattttctttaccctcctcttgtctaaattctgtgatctcatgatggcaagagggccttgagtaggtcttctggtcccttcccactgctgtgccctggggcgcgaggtatcagcgcaagctagaatgggggttcagtggaggaaaggaaacaccctatttctgcttctgactaccttccctgcttagcctctttccctgtctccctgtttctcacacactcagttgggacacccaccttgtccacagccacagcctggcatctcctagtgctccagttgcagcacagtcagcaggagagaagagggagtctcaaggagcaaaaaggtggaaataggctttcctaacaacaggtgcttgccatgtctgtcttctcatcatatttattgaacagaatgtgcttcattctctacgggtgctctttaacaatagtttacgtgttatgttacgaacatgttatgattataacatgttctatcatgttataatccttccagaaaatacttgccaggaaaatatataatttatagaaagtgaatgaaagtggcttgttagccttcccagatagtggaggaatctggaagtctttctaatggattgagatcacgtcattccagatgtctcttgaggcacactgccccgaatggttgctactgtcagctcattatgcttttccctggaatttccacttcccccgcctttctccccagaataagctttccatgattctttcccagaattagccttttcaactctttcctcatatgcatagcaacagtaatttatttcatgtgggttaatgtctttagcattaggacacttctggttttatggactgatggccaatgtgtttttaataatgtattttgcttctattgaagtcatgagtacaaattcgtaattcatttgaatgagggatatggacaaacaggaacacaagtggaagagagaaaaaagaggatagtacactcagagatactcagtaagcataaattacatgtattcatcatacaatattctaggctttagagatgtgtcagccaagatccttgtcctcaaggagcccatagtttgttagagagagaagatgtgtaaatagttaagtgtataaagtgctacagtgcttgaggtctaatgtagaaaaatccacagcctgtggggagggaagagaaaggagggagtgatgcaatctatttggagggaacagaaaaatcttctgtatttgtcagtactctttgagttgtaagtggtagaaacatcactcaaactagcttaagaaaatgggagatttattagtgtatataatttaggaagcctggggatggttctggcttcatgcatgactagatctgggactcaaacaatgtagtaggacccttttttctctttcaactctgcctccctctgcatgttgactttattttcttcaatgtagatgcatttcttttatgtgacttggaaaaattgctactcagaagtacatcatctcagcttaatcctagtggtatgttttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatcgattattgttagaggaagcaataagaacaaaactaagaggacatgaaccagccgggaagatcaggagactgcaagtagtctttgaggttggatcatggtagggggccatggcttgagatgaagctgtgaaatagacaggagcctcactggctatgctagggaacctgctctttgcactgtaggcaatggggagacatccttggttttaggcaagggtcggaggtggtcagatttccattttagaatatcactctggcagcagtgtggagattgagttggagaagccaagaatggatgcagggagactaataaggaaaccactacagtaatccagctggagataagttctgtaatgtgctaaagatgctaatatggaatagtctccatgtccaggtaggagatgaaggaaggagggttaaggcaatactcaaggttatagtggggaagcaaaagatgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggtgggggattgcttgagatggtgactgcatgtgtttgagtttgggggagtgactatgaatagttggcagttcagtatagggatctgcagctcaaaggagaggtagagttgtagagtggatgagaatgaaggcccgaagagttactggttttgtcctggttaagggaaggagaaatctggaaaccagtgggctatcccggtgaggagcacagctcagacctcagccatcaaacaagtatcagaaactgcaagtgagttccttaatggtgtcctatgcaaacttgttgtcgtttgactcatatctaattctgagcgtaggctggttgcctcttgtccacctagaagtgactttaagaccatcactatgggctgggttcggaggctaacacctataattccagcactttgggagactgaggtgggtggatcacctgaggtcaggaatttgagaccagcctggccaacatggcaaaaccccatctctagtaaaaatacaaatattagccaagcgtggtgacacacacctgtaatcccagctactcgggaggctgacacagggaaattgcttgaactcaggaagcagaggttgcagtgagctgagactgtgacaacagactgagactctgtctcaaaaaaaaaaaaaattcactgtgaaagggagctcagctagtcaaagaatcctgaaatagctgtggatgcacagtgggtccttgtcatggggccaggcccagggtcatcagttagaatgcagttgtaaacatgctaatgctgctgcctggttgtatgtgctaacaactgcttagttccaaattctaacccaataaggagtttcctcaggggaaatgtatgactacagcacaaatgggctcagccttactgctttcccactgttaccccttcctgcaccagcgctcttctggtccgtgtgactaaaagccaaaacaccactttgcctaaccccccagatcctattagttttgagtctcatcaattctgtttcttccatttgtccttctctttccattctgattggtacagctctaagctaggaggcttgttagttcatccatccttactgcacaaccaggtgaatggaacatcctcctaaggcacttaaatgatatttgaatccacaggtcagcaaactaggacccgtgggccaaatctggcccactacctgtgtttgcaaataaagttttattagaacacagccacactcattcatttaaatattgtccaggactgtttttgaactacaatggtagcattcagtagttgcgacagagactgtatgtcccacaaaatctaaaatatttacttttgttttataggaaaagtgtatcagcccctattaatccaccttatgtatgaatgccagattaatgttcctaaaatgccatttcaccatatcattctgtagcttagaaccctgcaatgacattgcattgtccatgcaataaaatctaaacttcatggccctccatggtatagtcctagccaatctgttgagtcattgatctctgttcctaaaggcaagccctacaaccagttagattttcctcctcattgtccctggaatatgcagtgcatttctacccttgttcacctagttccttttgcttggaatgtattgcccatttgtatctacctaaatcctactcattccttttttttttttttttttttgagacagagtctcactctgtcgcccaggctggagtgcagtggtgtgatcttggctcatggcaacctctacccactgggttcaagtgattctcctgccttagcctcccaagtatctgggattacaggcatgtaccaccacacctggccaatttttatatttttagtatagatggggtttcgccatgttggctaggctagtctcaaactcgtgacctcgggtgatccacccacctcagcctcccaaagtgctgggattacaggtatgagccactgtgtgcccggccctaaatcctacccattcttaaaggactaacatgaactctacatccttcatgaccatgtcagttacagtgatcaccaatgagcctgctgcttgagcatgtaaaggtccactgcccatactgcctggtaagttttcttctgctcagagaatggttcaccaatatgatgatgggcaactctggagtgaggactttctgatggaacaaagtcacagctgtgggaaagcctgggaatggtttggaaatgacaagacatgtaatgagaacacatgacactcaattaatatttgtggaaatcttgagtcatcagcctctcatatctatgacatacatcttggttctgtatttaaatgtaggacaactacatatcttgatagccagtgggaatgactgacaaagtccagtaagtctactcttgagagattctagaatgtagagatagcagctggaccaggaagccctagctttatcatgtgccatctctgagatggtggatgtgggctgttcccactgtgcctcacttttcccatccactgtcatatattttatggtcttgcacacactctgggattaagtaacatcaattatgcaccattgattggagttctttggtaaatggtactacattcctaaaatattcatgtgtcttactttgtcagggagattatatccgtgacttagatatcatattctagtggcttaagattatgagctaatattttgtaaggtctgggcattgcacagaaaaccttggttgtaatacacattattattacattgatttgaatagcaatggtacaatcatagccccggaaacatagcgactacataaaataaaagcttccgttaacactgagcacagcagccaggcttccgcattgttgttgtccctaggatttggctgttgtattgtcaaatgccattatgtcttatctaataagtttctccctgcatatgtgagtaaacgaaaatgctccagtatagtaaatgtctcagcaaaccactcctgtacgctttggaaacagaacattaacaaggaaactatcatgagagcagacctttctgttctcatgaatcacattcatatgatgtttattgtccacattggagaagtatagagaagaaaaatatgaagggtacactctaatggaaaggttatagtggaaatgcaaggaaaatatatccctttacaaccagcttctaggcattacctagaagtaaaattatgacaataagactaacagcaaataacattgagcacttactctgtgccaggtattgttctaggccttttacgttacatcatcttatttaatccactccacaactaagtggtttggatgcagttattatctccactttatgtacgagaagaccaagacccagggaggtagaagaacttgtcagaagtcagacaggtagtgagtggtagggctgggagttggacccggacagacagattccagatttcatatttatcgtaacctcagctgccccacccacatgaaatgctaccccaaggctagtggcagcaaatataacccatttcatttgcattgtttggtatgtccaactgggtgatttgtcctacaaaatttgaaacaacgtctgcttatttatgtctgtgattttgatcaaataaatctcacccagaatttcccactgtcttattctatggtatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaaggtaagcagctgatcccaggaacctattccattattagacatgcagatcacactccggagagctgggcagtgcctgccctgccgtgaaggcgctgccgccaaccaaaccagcctttttcattcaatcaggaaaccatctcttggcttttcttgtgaatttctcaaattcagggcattattacagcattccaatttctgcaagcataagattacagtgtgcatgtggacagggtggagggtttgtgcgtgtgaagtgtggtggctatatatagaaattggatgagaatacttcacagggtgggtgaggcagcatttcaggattgtttctcccatgcataggtgctgggtgtgtttgctcagagaccccaaaagatatatttcacggaacgttctttttattcacttaaaaatattagtatttcctttcttgatatggagaaaagggagattaaacgatgtgatctgataaaagaacaacactgtgtatttcagattattcatttattttatttgtactttaacaattttgaaagtgttctgtgagagcaagcagttggtcaaagatggctttgaaatgatttgactcagacgggtctccatggtaccatctaaaaagagagagagagagagacagcacacaagagctgtttattttttctttaaaacatgatgcacttaagcatcgtaattgattacagctcaggagaaagctctgtcactgtcacaaggaccccactggttgcagaatgttgcttttcacatgttcagagaataatgtgaccacattccaatggccagccgggagttgttgcttgcctttgactgctcctgggctttttggcaggaaaaccttctcctgcttacctcatgttgctgtgacattgcctgcacagagctgcattgctcagaggactgggtgggaaggtggtgctgactttcggggtgatgctcggtatgaattatctagatttttttcaacaagataaacctttatggctacttttcctgtccttttctagaaaacaggattgtgctaaatgaatacccaaaatgagaaccatcagcaagcgagttactgattgaaaatagcagcatgacctatatctgcttagcatgtttatcagtttttgccatttaccttaaccagagaaatgtgcttaaaaggaagaaaagcagcatgatactaaggatattgcctgtttctctctgttcatcatataaattcattgacagatctttctttgtaggagcttgctctgtatccccggtgctgttgctctttccccacaacattcctgagggaggatggagggctaaaattagtatcctcttctcacagagagggggccttaaaaacacctaatagaactgagtgaattgttcaaggtcaatctgcacagagctaggtctctggctcagagtacagtccattcagtacggtgcttgtaagagaccaacatgtactaaaacctcagtgaatttctggttaaaggtgaacttttaaataagaggaccgaatgaaaaaagagaggctgctttgggctagacagcctcactttaagctcaacgtagttctttgcttttgtattccctgaatccagtcagggaataaacatatgtcaaaacatcaagggattttttttctttggtctcccttctcatgatcctgggtgccaaataagataccaagggctcatttattgctgatgtccagtgcagtattagtatattctgttcatattacatctattcatttttttatttgtttgtttgtttgagatggagtctcgctctgtcgctcaggctggagttcagtggcatgatttcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacattgtgatccacccgccttggcctcccaaagtgctgggattgcatattcatttttcgtctatgcatccattcatccatctttccatccatccatccatccatccaatcaacagaaacaacagtagaaattaacttggtcttgtatgcggaagcagtgaggtttttctcaaggacttggaaacaagggaatcagctagttctttatggctatcttggtaaaattctcacacagttgatgagattggctatctgaaggaacacccaacactcgcaccatggcaaccttgctattgcagggcaggaggtgggtgaggtggggaggactggaggtgatggtaacttactaagtggaggtgagtgcattgtatgtctctgggaaaggcttgtgtggacagaatgagggtgagttatttgccttgaatactgaaaaaggaaagctcagaggttccaaaggtggcagtggttgtctagtactatctgcagagagacccccagctttgggaggtcctgaatttctgtatgctggtgaggtggggtcagtggtaaggtgaggagggtcctcaggccacagtgaggcccaagtgaaacttccctcaggaccttgcctctctttgttctgaattcatcctccctataattattcagttattttgatatgaggaaagggttgcctgattgaaggatatgatcactttaggcactaggaaggaatatgtttcactttaaatcaataaactggtgactgaacttgaatagcatgggactttttccctgtaatcatccagtttgcagcctagtggcctcgcccctggatggaagtacattcgtggaggttatattttcttctctgtgagcctctccaaggagtcagccagttttctcctggtagcctgttagccaccgtcagtaacagtcaccatttttttgagtgcctaacacgtgcctggtactttaaacacataccctcaataatgaccacaagacagttattactctgtcttacagctatgggaacaaactcatgaggtcaagtgatttgcccaagaccatagagactataaatgagggagcctgagagaaactcctgggctgtctgctttcaaagaccgagctctttccaggccaccgttctctttgaaagaaatgtttcctttggaataattcatttagtgagatgccagttaccatcattgctgtctctcttactctaaatatattgtgatggactccagaaaatttagatcatgtggagacatgtcacagtgattattgaagttccttgaagtagagaatattaggaaatatgtcagtaatcaatatttgtttcactaatttgcaaaatcctagatattctctaagaaaaaaatattctccttgcattagagttagttgtcatgtttataagatataattttcatattctttatataattctcatattctatgtcttaagataaaattctcacatgtggcaattatcagatagcctgtggacacttattctcatgcaatgagatgaattatttagacagattcacctgtctgtggtcaaagcaaataaatagaatgcaagatagtagttttggcattcatatatatttttagaagacttacttattgcaatatttaggaacatatagtgagcaactctacaaaatggaatatcatcactttgtatatggacttcgagcaaattccacaatacagtaaaagactaaagtataaaatggtaaaatactaactgctacatcccagtgattaggaaacctcaagatactttgaactccaggccaaattaaactcagatgtatttttaaagcatccttagctatacgtagtgtggtgtaataatttctaagcattacaagtagaactagtaagcaatttttatagctatattatttttgatgattacaaaaggaaagaatgtataatcattgcaaaaactaaattaaaaagtacagcaaaatataaagaaaaaacatatgtactctatacttaccattcagatagaacccatgcagaggtaaatccttctatacttttttccccgatatatttctgtagattaagatatgtaaccatcattcacagggctcaccaacctgtgggtaaaatgaaattatattaacattagcattggaataacattaacctttacctcttttttatgtgggttctttttaatacccatacaaaaacttataatttttataaaatcccatggagcattcttttactttaggataactgactttgatgtcttccttgaaaagaatgtctccatctcaaactcttagctattatgtttcttatacttcaatagcattaattcatctagaatttatttacagacgaggtatgcagtaggaatataactttactttttactgatgctgagctgcttgtctcaatgtgatttattgattaattcatcctttccttcactgatttaaatgtcttctttatcacctacatatttctgacttacatttgagtctaccatttatggattatttttattccattaatctgcccattcctgtgccagtattgttctcatttaatccctatagctttttaatatattgtaatatttcataagacaagaactatcattattcttttgaaaaattgtcttggctttttatttcataggaacaattatttatttttattgtttttataatgagacttgtgatgatatggatttttttaaaataaatcagctactatatcatactagagcagaaggaatttaatatttccttctgtcccttggttgaattgccagagatttgtctattttattggtctgttcaaagtcccagcacagagtaggcactgagtacctactgcaacatgaattccttggagactgtcatatttacaaaggtttgcctgacagagttggccctgtcagaatcaaattgctaataccacgtcttcaatacataaactgcctttgaattacttattcatgagcggggaaccctcactagagttttcttctaatccaagctataaaaattgtcattatatttggaagaccacagccttttcttccaagaaagctgaatgaaaaaagatgaaaggctgaattgtgaccctgtgaaatatttgttgtcaacccactaaggtcatttgctgaagagcctgaaggtatcagaagacttgctacaaagatattacagtgtctttcccggttttgaacatttagcactaattttagactttttcttgttactgggatgtgtgaaagacttatttcaaattttaaaatattgaacagataggcacagtacacagtgtaaagtaaccttagatctcctcccttgtttccatacccagagcttgaatggaagttaaaacctgatttcttctatcagaagtcttgggtcggcttctccctgggtggactgaagcatataacaaaatctcaaaaccaaaccaagatcttatttattgagagtcaagaaagaggaaggaaagagtgggaaggataggggaagagaaagagggacaggacacagataaatgactgaaaacacaaacacagctattgcctcatgctgagtttaacccactttctgttagaaaactgaatttaggccaggcgcagtggctcatgcctgtaatcccaacactttgggaggccaaggcgggcagataacctgaggtcaggagttcgagaccagcctagccaacatggcaaaaccctgtctctactaaaaatacaaaaattagctgggctacttgggaggctgaggcaggagaatcacttgaacctgggaggtggaggtcgcagtgagccaagatcacaccactacactccagcctgagtgacacagtgagactccatctcaaattaaaaaataaaataaaataaaataaaataaaataaaataaaataaaataaaataaaattgaatttagccatattccaaccatcatccactagaatagccaatatcagcttcagccagattacaaatgaatgaaagatccagagtaaaaagtaaaatcatgaaagtacacaaaggaatcacaggtgaatatttttatagtgagggtaaggaagtcttatctatgtatgacatcaaagccagaatgtgcaagtaaaaaagattgccagttatgactttataaaaataacaaacatctgaccaggaaacaacaggagacttattacaagttctcattcacctcctacttccccaatctgccccacccagcctctccagacatgcctcactcttcaccggggtcacctcaaaaagtggtatctaggctgggcacagtggttcatgcctgtgatcccagtacttgggaggctgaggtgggaggatcatttgaacctaggaattcgagaccagcctgggcaacatagattccatctctacaaaaataaaataaaaaataaaggaaagtaagaaaagtgacttcattgcagttaccttagctgtagatgaaaaagattgggttagatgatctctgtgatctttttttagctttagtgatccaagattttatatttgctaaagtacagtgtatgtgcatgattttccaagaattcctcacatgtcagcctccgtggatgaataaaagatacagtcctgactgtgagaactcaggggcaagtgggggagagagagcatcaatatggaacccaccattagaggagctgaaaaatagttttccatgttatgaagtggatcagtggcacctgatgattttgtaaatcctatttgagcaaaaaagaaaaaaggattcttgggtgatcttacacagaggcaagatagtagagtgtacctcttggcttcaaatcccagatctacagctcactcggtgtgataccatggataagtcagttaatgttagcacctacctcatgggatgcttgtgaaagttaagtggatttacatgtaaagcacataaagcagtaagagttctataagaattatcattattgtcaccatcatcacccagtactatggctgcaaataccatttatgtatatatgactgccaaattgagaatcccagtcttccatgttcaactgcttttctgacatgtccgcttagatggatgtcactttcatttagaagcctctgaaacttaacatgcccaaaatgaaagattttattttctgcttttctatcatttgttctactcttccctgtctccagttgatgataccactattcaccctttcactcaaaccaaatatctatgcattgccctaatccttccctttttctcagcccacatctaatctgttacaagtcacactgattctacctccagaatgtaccaccatgccttttgattcttctgtctctcttctgtttcaagctaatattctctgtcacttgaaccatgcaataaactcccatcacttgtactttgtaatcctgccccttgcaatgtgttcttcctattgggcttagaagacacagcaaactccttaacaaggctacagaatcctacctaatctggcccctgccttcttctccatcttcagtttgttctgccctcccaccccaacctcacttattatggtccagccactcgggcatttgttccggtccacaaacacaccaaactctgtcctaccaccaggctggtacatttgccagtccctccacctggaacacccctccggatctcagatctcagcttgaatgttcaagtcatcagagagacctttcccactttaaatgtcctcccctggtccctctttgtcacattgtcctgtctacctcttcctaggcagcatcatagtctgagattatcttgcatccttgtttattgggatgaaggcttgagtgagagtagggacttgcctgtcttcctgagctgtgacttcagggactggcagagttcttggcacctaggaaagggataagagagccactgctcctgagttggggacacagaaggagaggatggggagttcttttagattatggtgtttgaccagccattgagaaagcttgtgtattcttcaagcatttggatagtcataggtcctcatgctgtgctactcaaatcgtggtcctcagtctggcattgccagtgacagcatcacctgggaggtcgttaaaattcaaattcccaggccttatgcgagacttagagaatctgcatctccatgggtgggtcctggaatctgtgtcttaggaagttctcctggtggtccttatgcatactgaagtttgggaaactcagttcttgctttttgttttccaaagctggccaggccagtagagccagaaacagatttactttgggagttccttctgtcctcctttcagaagcccctgtcaagtttccctttgtccagctgccagctccccacctgctccttccttgtattgacttgccatgatgacattcgtttgacaaatgtgaagtttgacagtccttagcaccttgggaggagtttgagaccagcctggccaacatggtgaaaccttatctctactaaagctatgatactatgttagctatgatacttttttttgatgtatgttatttagacaataaaggccacaaacagagaaaagttttttttaattttaatttttttatttctattgagctctgcttccgctaaattctgaaacactgaggcagccaatacaagctagcacagtataggggaccctgtgctttggatggtgcactcagtatacaccattccatttggagacatgttggagacaacataagggggatctggagtcagttaaggaagccttttgaattggtgatttcccctgaaagcatgactttggagccaagtagaaaatcaactatgctttttcggcttcttaaaaatgtctaaacacctttgtgaaacaggattctctgagaccaggcccactgccttttccagttttttttctttctttcttttttttgagacagagtcatgctctgttgcccaggttggagtgcagtggcgtgatcttcggctcactgcaacatctgcttcctgggttcaagcaattctcctgcctcagcctcctgagtagctgggattacaggtgctcgccaccacacccagctaatttttgtatttttagtagaaatggtgtttcaccattttggccaggctggtctcgaactcttgacctcaggtgatccacctgccttggcctcccaaagtgctgggattacaggcatgagccaccacacccagccccactactgcctttgtctgttggagcctctcttcctggctcctcctgttgggatgttcttaatgatgtcatgcctatatcaagaaaagagatggaagtagagggacatgcacctctgggtgaccagagtcaccaggctgctctggccagagctacctgctgatggtggcagctaagttggtgagaagtgaggggctagacccttcatgtgatggcaggaggcactgtgtgaagaacagcagagagaacattccaagagcagccatttacgttgcaagaagttgtggctgcagaacatccctgctggtgtggagacagccaggactgtccatggctgcttttccagaagggtccacaccaacgccaaggcttccaggatgtctatcccccagaatcctaaggtttttactatctgtggtttggacatctttagcacaggaagcaccctgaaagtgtggtccctacccctcccaaataattagagagaaggaaagttgagaatttcccagttcatccatttactcattcattatagggaattgggctacaattccattgactgaatgaataaatggatgaattgggaaattctaggtgacacagtgaatgtgaaggtggataaaggacagtcctagccttccaggaaccagcaggctacagggggaacagatgtaaaaagaaagaatttgaggatagtatgaaagggccatagagtgtgtctcagagccagtagaggtggaaggcttctctggtggtattttacttgttctttcttaggtaaataaagcagaggccaagggaacaggatggacaacaacaatagtaaacatttctatagtactaagtatgtgtgtggcccttttagcctataaactcctttaatcctcataacaaccctctgagctgggcactgctattttctccattttacagatgagaaaactgaggctcagtgaggcgaaggagcctgtccaagctcactcagctggtaaatggcagactggttccagagctcaggctgttagccactgttcagcatggcctcttgcagtctctaccctcttcctgagagtaaatttcagagccaagttatagttcaagaaaagcaaagcaataatcattcttctacttcagaattgctaccaatgaacaatttattttgtgcctacaacagattaagtatctgaataaaaatataaaaacatgaattgattaaaaaatggcctctcataatgtgcaaaacagggtctgtcggggaaattttgagaggtttttgtggagaacaatggttctgaatgttttgtagaaagagcaaccgatttgccccaccctttcccactttccaatggaaaagaatctctgataaagctttgataagcaaccaacgtaagcaaattgtactgccctcttttacacatgattttatactatcatacgatgccctataatgtaaaaactgtacattttaatacctaccctggtggtagatgcacactatttatacagagcacattcaacaggcagcatgtcaccagtgatgcatagctgtttacgcatattgaggtgtgggggtggatcctgtctataatcactgtaagagtatagttaggaataattctatgtgaacaaactcaagtctttaagcctaattattaaaaaattacaggtcaagtaccataaatttgcctatgtgctgcaagagtaatcaaagagatctctacaaacaatgatttgtaatgaaaaggcaagaataacatcaataaaaaccatggtcacctgaacccacactgatgatgtattgtcaacacagagtctctcctggaagtgcaggaattccaggttgattgaacttgctcctgggcatggagcagggtgtctacagcaccagatgacccctggacttctcaatagaatggtgaatcaggaccattagtgaagtctaacttactaatactaagtgttggtaatttttttttgagacggagtttcgctcttgttgcgcaggctggagtgcagtggcatgatctcagcccactgcaacctctgccccccaggttctagtgattcttctgtctcagcctcccaagtagctgggattacaggcgcatgccatcacacctggttaattttgtatttttagttgacatggggtttctctatgttggtcaggctagtcgcgaactcctgacctcaggtgatacgcctgccttggcctcccaaagtgttgggattacaggcgcgagccaccgtgcccagcccagtgttggttatttttaaagactcatcagttcataataaaatgcccttaatgccgcatacaaatgagagtctatggaattgtgcatccttcgctcataagagcttcagggagtgctccaagcctccattccctggctctcagtctttagaagagttctttcctttcacctcgctcaccctgcctgatgagatcaaacgaaattctggacagaggtgatgccagtgagccagggagccaaagagccaggtctttattctgtgttaggtggcttaatagtcattgctcctgctgttcctttcgttgcttactatttctgggaagaattgttcatgtgccctgcatcctcactgtggtcccctctggtgaccactgacctgcccatgggcatggtcactggtccttagccatgatgtacagggtcagtagctgctgccgtctgccatctagggaccatataagtggaacctgaatcaaaattatcctctcacatctacctctccttgctcttccttttagggaatttcaacatgcttttttctggaactgttttcatttcccttctcaaagcagtaattgctgcctccgaaccattgacctgaaacaaaagctttttattccactgtactgtatcgtagtacacttgcaaacatgggatgtatggtttttttttttttttttgacagggtctcgttctatcacccaggctggagtgcagtggcacggtcacagctcgctgcagccttgacctacctggctcaagcgatcctcccacctcagccttcccaagtagctgggactacaggcgtgcaccaccacacccagctaattgtttaattttttgtagagacaaggtctcactatgttgcccaagctggtctacaactcctggaatcaagcaatcctcctgcctcagcctcccaaagtgttgggattacagacatcagccacggtgcccatctaggggcatatgatttttataacatttggagattattactgaagatgattgggagtcattaaagaagggagtcattgaagaagagtcttgacaatctttttaaaacactttaatatggaccagatattaggtggtcttaggaagttttttaattaaattacagttgcatagaaaaatgttcttaatttttagagactcatactgacatattgttgggtaaaatatggttgttatttagtttaaaatcatttgatgagaaacatatgggaaaatatggcaaaatgttcataattgttaaatctagatgaggttacatggtcattcattatacagttctatttttaaatttttttaataatagaaaatgatatagagataaatctccttgggtgttgatctagagggaagtagggagccatgttagtgaggaggtgaaggcagcgattcaggcagcgctggtgaggggtggagctaaaacagcaccactgcagagggagaggacagtgtggactgaaaagtatcatcttgtctgttgtcttccctcacttccacagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttccagcccagggaacccatgctacagtttttcagtgcagtaaccactgctctcctctaggtggcctttctcaatactgttaccttctcctgtacttgagaattttcttcctaaacaaagcacattgatgttgtttaaacttttccagatgacccagagttatgacacagagtactaataattttttatttttatttttaacttttattttaagtttaggggtacaaatacaggtttgttacataggtaaacttgtatcgtggggatttgttgaacagattatttcaccacccaggtattaagcctagtacccgttagttatttttcctgattctctccctcctccctcccttcaccctccaaaaggccccagtgtgtgttgttcccttctacgtgtccgtgtgttccatcattagttctcacttataaatgagaacatgcagtatttggttttctgttcctgtgttagtttggtaaggataatggcctccacctctatccatgtccctacaaaggacatgatctcatccttttttgtggctgcaaagagtactaattattgcactgggctgtaatacagcacagtgatggcttcatgggcccacaaggtgttgtgagcagcttgccccttcactaggtgctccctttgagttcttatattagctttcatctttttcctccttcgggtcaggttgttagctgttattgctgctgtagtgagtctgttttcaaatttgctgtatttggtcaattcgaaatgtgaaaactgtagtcaacagtcttgggattgaaatgaagagtgtggaagtgctgagtgagagcacctctgtaggttatgtgcccgtgctctaaaaattaactttgtattgtctgctttcactgctcagagagtggtttctttatggttctcaaccaggatctgatcacttcaatctgggagataagcgacctgtctgtgggcaataactggccaggctcacacaagagcaataatgtaggtttttacttgggagctatagccactccaggtcccaggacacctagccagagagatatgagatagggatggaaggtggtaagcatagatgccttagaaccaaatctgtccctccaacccatcccaccaaattctacctgaaatctcaccacctggagcttcatctctgtcttctgagcttatgagctctttttttttttttttttttttttttttagatggagtctcgctctgtcactaggctggagtacagtggcacaatcttggctcactgcaacctccgcctcccgggttcaagcgattctcctgcctcagcctcccgagtagctgggactacaggcgtgcaccaaccacgcccagctaatttttgtatttttagtagagatggggtttcaccatgttggccaggatagtcttgatctcttgaccttgtgatccacccgccttggcctcccaaagtgctggaattacagacatgaaccaccgcacctggcatgagctcttttaaaataaagggtaatagctaagctgctaccagccatttataaccaacagcaaattaagactctgagggcacctgtaatagtgtcactaaagggaaaagcaagccaagtaaatcccaaaggcatacgtcagcctatgtccctactttgcttaggtcctcacatgtcttaaagagctttcagagcagcttggctaaacattgtgaaggaaactggccaagaaaaagtttggagggtttgtgtgtacatatacatatgtatactcacacacacccgtgtacatgcacatgctttttcttagaatacaaaggataaaggctaaactgttaccaaccatttatatcatatacatatatatatagagagagagtaggtgttattatagacagaaggcagaaaggatttggaaaataggataaaattagttacatgaccttttctatttttctttttgtttcttttttttttaagagatgagatctcactctgctgtccaggctggactgcagtggtgcgatcatagctcactgcagcgtcaaacttctggacttaagctatcctccgacctcagcctctcaaatagctgggaataaaagttcatgccactgtgcctagcattattattattttttttttttggtagagaaagagtctcactatgttgcttaggctggtcttgaactgctggcttcatgtgattcttcccactcagtctcccaaagtgttgggattacaggtgtgaaccaccgtgtccgtcctattctgtttttcttaagtgtcactgggaaacatggtcttccaatcaaattggcagtttaaccttggcttgaatgcaaatatgttgttattatggtccaataggtggtaactcgcacttgtagaatgagccattgcgtgtggaggctagagtcttaaactgagactcagtttctgggtaaattgaccattggaaggaggtgttgtgggttaggggctggtttattattcaggtggtcatgattatactcaaagaaaagttgttaaagttctttttatcctttacgtcctttacgtcaatggaataaagagcacactcaatgtatgcaggcagtctcacccatttagagctagaatcccaagccagaggaaggaaatcacaatagcctacaggggtggatggtgaggcctggattcaggggccatttcttgtgtcttagtcatgactttgggccaaatgggcactggatgtgtgctgagatgagctgtgctccctggagctgctttctgtaggagcaggactgtggtgagcatcgtttcctctgcagggccttctgagggaggagtttcttctaccctggaagtcagcttctgcttctcttcatcttgctggcatcttctctaccacaatggttattagtgtctttaatcttcaatcccatgggaagaaagagctgttatctctcttcccataaaggacactcagtcacctaagacatttctctgtagttgaacatagcttagttctcactcacagaatgacatttgaatagttctaaaggctcattgcaaacatgagcaccctacggtgttacaaagtccctgtggattggctggcatggctctgctgatagggctgagctcacctacgtgactctaatctgcgtgttgcctgagtccactcttgtttaccctgcactaacaggctaaccatgatgctgtctctttctggcaatgggagaggtacaagagggctgagcagaaacaaggcctaggctcagactgcccacaagccatctgccaaaccaagtcaatgagcaagcccaaaaccaagggaagagacagccagccaacttttagtggaaggaacacagatcagggaagggtgaagaatggggatgaataattcagttttccaggagcatgattgttgaattgaaaactgcaagcattcaggaaaatggaccggcattagggaaactacagaaaagacatttaaaaagaaagaggactggctgggcacagtggctcatgcctgtaatcccagcacttagggagaccgaggcaggtggatcacccgaggtcaggagttcaagaccagcctgctcaacatggcaaaaccccatctctactaaaaatacaaaaattagatgagtgtggtgatggtcgcctgcaatcccagctacttgggaggttgaggcacgagaatcgcttgaacccgggaagcggaggttgcagtgagctgagatcatgccactgcactccagcctggcaacagagtgagactacatttcaaagaataaaaataaaaataaagaggactaactaaaacaatgcaagaatgcagagagaaaggaagaagagagtaagagagaatatgagtgacttcaagatcaaatttgcgatctgatctttatataataggaatcttgaaaactataagatcagatgcagaaccattaaataaaggcattttaagggaaatcttcattactcaaggcaaaacattaatctgtagatctttagatttgggccccctagtctaagtcacccccagcaatcaattagattctcctaaagagatacataaactggttgcaaactataaagtatattagtacagttgtgccctgaaggtattttcgtccttgttgttgaactaagaatagcttgaagacactgaaggaggaatagagaatagtaaccaaagaacaaggaacatttctacaaagaaagactaagggaaattgggccatttagtttagataacaaaaggataatggtatcataactcagaacttcaagtgtatgtaggatctaggccatgtcttaattctttatgtgcaggccattttgaatatggcaaagacttcaaataaagcatgcaaatttctacttagatgtctatttccctagatacctcctagaagaaagaacataatcaccttttaattcttattctgtgattctttacagtgccagtaactgtacaagaagttccaggtttacagacatgtttttttccaaaatgttatttataaattggtggtggtttggaagggcgaatgttgttcctctgccagaattattatatgtggtgcttagcttttgagggcagcccacgaagaaggaaggaatggaggaaggaaggatggaaaaatgtaactagaatattaaaccctgggcattagaatcacttgggaaggtttttaaaaataagaattaccaggcctcattctaggaaatttggatttagtgatccaagtaaggagtcctgtaatctgttttttaaaagggtgttccagataattctgttgtatggtcaggttcaagaatgattgcagtaaatggaaaaaaggatagaccataaatgaaatcccattttaatacctagaaaccccccaaggagagtgggaagtaaatcatgtttataagaaaactggcttcacacacaaggataaaggacaacccaacccttgattcagactgtttctgagccttcctactttgacccaaggatatgtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaaagcaaaatctgtagacgtttccttttttgaattttttgaatgtccacatcttctgtatgctttgcttctttttggagtgacgtattgagaaagcccaagagattgtttctggcttgggcccattgccagccattgtccgtgccattattgtgtgtggtgggtccctggaggccacatgtggacctcgggttgatactttcggagattgtaggtagttcgagccacactagccctgtttacttcatgtctgccccaagcatcaagtcttgttgtttaccttgtcactttcccacttaagattctctttcatttcactgggttttactaaagtgtttgaaatacagggtttttaacttcctttgattagtgagaaatatggggaaaatttatctcccaaccttatcagttgggggcagaccaaccccagtgaagatgagaaacttcatggagtattaaatgaaaatgggatgagctgtcacaaagccaggatgttaattctagctctgctgatcatttgctgtgtgaccttgggcaagtcttttgctctcttcagtctcagtttcctcatatcttcagtgagccatctctcgggatcttccagctctggtattctgagtttctctaatttgaggagttggttagagatctcttttctcaacagtgtacctgttccgagaaatgttactgttatagaaggaagtggttttggaaacgggtcagagtggaggaaagaggttgagttctcaaaaaactaaaggctaggtataagtaactgattcatcacagagatgactaattcatcagaacagctgtctgttctaaaatatgtcacatcaaatattcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaacactccacagtggcattccacatctgtgcacttccagccggggtccccaccccacgttcagccacatttgcagcccaattattgtttccattcttttgtttccttccaaaataaaactatatatgctatgtatacagtaaactatatagtagtgtctctatattgtgtaatatttcctgttttgtcactcccttctgggtagcggcctagcttttctgcctccatttaattcattaattttctaatttaagccttgtaatactcccatgaggtagtgatgatgatgatgatgatgaagagagaagagaagcacaggaggtgaagtaacttgctgcccccccctaaaaaaattcaatggaaggacatacaagatgaatgaaaaataattttaaaaaagtgaaagagcaagtatttgaactcaactctgcctaattctaaagcatgttctcaaaaatcccaacagaagttgttattttaagctaaatttttttgagacctctgatattgagtgaaattacactaacgtgcacctcgtgatgtaggaggagggacaggtaatgtgattctccctcctcaacctccacacatgcttcttcagaaggcggtgcatcagacgcaccatgactctggaggtgccggtcttcagcctattgtgggtggtcatcatgatggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtgagtggctgtcttgagtattgcaagatgtttagtagcatccctggcctctacctagtggcttccaggggcaccattgccctttcccagtcatgataataaaacatgtctccagacattgctgaatgttgccttgggggacaaaatctctccaagttgagaactactgctcaaaagcctggcattatgtgtattgatactaagatgagaatctcaccaccgagtagttccagaatacagaaccctaaaaagatttatgaagataacattagtgattctcagtgcaaaatgacaaagtgtttcagttacttgaaaataaaaggcttctcttatgcactgagccatgaaagtctgttcagagttaaaaagaaatagttgcttttttggtttttgcattcagtattgtgctgcttttgcaaaggcaataattttatgacagttcataaaaccatggaatcttagagtatgcataactgacatgttatgcggatcaactcctatctgattcttgaatttgcaatgaacgtaatgagtgggagtgaaaaaacagtctctccccaaagcctgaaagtgacaggaaactcatttacttgcaaaataaaacccaagtatatactggaacaactctaattattacagaggatcctcctttgggatgaaagttttgttccctgcagctcctaccctctctctggtccctgccctatcctccaaggaccacacagaaaaagccctcttcactgactgaaaaaatctagatgcttagggtttgtggtcagctttgcaagctggcacaggtaagggaggaaacactctgaaattgcagtgcagcatttcaacatttcatgtgtgttacttagcaacaatagcaggaggcctgccagatgtaccagagtcatcgtgcctcgctcaggttttgtaggatccattataatcatctcattattggtctggcaaattgggtttatagtgcccagaactatgaaaatagtagttgaatttcttccatacactgaggccatgtaagagccatatttgggaaatacatgcatttcccagccctcagaacaattgctgcaatggaaggaattctgcaaagtcaacttttttggtagccagttccaggctttttggcctatgattgccacaccccaagttttctctctacaaaaagctttgataatagtctttttccaattttaggtcaccttgcatagcccctctggcttgtaacgtggtcatttccaaccgttctacattcttgatgaaatgaaaacagcaagcttcctgttgacatactcttccacagttttcatgaattatgcattttgaaggcagcagacaagatggtgtctcagtcctttccagcgattctccagcatggaggtcttatttggtacatccatcacaagggcccggagccaagatgatctcttgagcacaatccccacttcgtgtttccccttttcactgtgtaggccacagggaagagtactgtgggacccgaggctgcttgatactcatcaaggcccgcttcctccagccttcctagcttctctttccctcaggtctaggcgtggagccctccaggacagcgaacgggtgataaaatatacaaactgtctctgattatgggattttggctccttagccaatgcatgcaaggatggtagaaaaaacactcatcttccttctactatcctaaaagcaacttccgacatcaagaatttttttggatctctcatccaaaggtataaaccttaacagtgggaaattcagaccaggtgagaggaaagggttacacactaagagatgacttaggtttgggtagtttcatcaggagaggtctgcctgcatcctggttcctgtccttgttttgggaaactctttttagcatacttggagtacatattcagttaaacttgcaaagtgaagaatcagagaatggaggcctaaatgtgattcacctgaggccacacgcagagtgaggagataccagtgtgcttcctgcagaagcatctcccacatctctgccaagcctttttatctcctttgaaacagaatctctaatggaataaaccactccagggatcctagagtcttgtgtttgttcctcctatgcagaaaggcaaaggaaaaaattaaataatatctgaataccgcccagtgcacagagagtacctgtgaaattacagggacattcagccagcaaagaatgtccccctggccagggtgcctggaggaaggcttttaagcattaccatgctgtacagcatggggctgccagcttgaccagattctagctggaaggatcaggcatctttaaagaccggtagcattcagggccattgctgggccacatggctcctttgtgcaattagaaaatgcagttccacagggtaggcagcacttagaaagccactggctggacttcacctccctttgttcccttggctagcatcttgggcaacaacattctgtacaagcatgcaccatggccctgctggcttcttggtctccacgtgcctccttcttgttggtcattaaggttatgccattttcccccattattaagtaatgtcaggtaaggtctgaggagatggagatgaagacttttacaggtcgcaggggaacactgacatgtcactcatcattttgtgtgtgtgtgtgtgtgagacagagtctcactcactctgtagccaggctggagtgcattggcagaatctcagctcactgcaacctcccatctcctggattcaagcgattctctcctgtctcagcctcctgaataattgggattacaggcacccgccaccatgccaggctgatgtttgtatttttcgtaatgatggggttccaccatgttagccaggctggctttgaactcctgacctcaagcgatctgctcaccttggcctcccaaagtgctgggattacaggtgtgaatccccgtgcctggccatcacccatcaatttttaaatggtggagtagctcccatgatggatgttatgaaagggtctatgggtgcatatgaaagggagtggtcattactactcagtccaggtaaaactccctggatggagggtgaagacaatgtggtttgagttgttaggtaaatgtttccttatcatttttcattatatgttacatttacattctgttcatccctaagatataactccttaagattacatctctcagatgtaaactccaccagagtaaggactgtcttggttacctactgtgttcatttcctgagactgatgtaacaaatttctacacgttcgtggcttaaaacagctccagaggccagaagtccaaaatcaagatactggcagggctgtgctttccccagagcatctagaggcaaatccttccttgcctctctcagcttagtgggtccagacattccttggcttgtggctgtgtcgctctaatctctgcctttgtcttcacatgggcttctcctcttgtctctgtgtcttctcctttgtctctcataaagacccctatcattggatttagggccctcctaaataattcaggataatctcttctcaagatccttaaattaattacatctacacagacccttttatccacataaggtcatattcataggttctgggggttagggtgtggacatatctttctagggccatcattcagtgtactatatctgagtgcctagattactgttttacacctaggaggttgctcaataaatagttttcaatttaatttatatgtttcagccttagtttatccataagcttgccatgaggttcagaaaccatcatttatatccagagatggtataaggcagtggttaggggcatgaacatccgcgtaatacttgctgggttcaagttcagaatctctgcttgctgcctgtataatttgaggcaagttctttagcttctctctacttcagtttcttcttctataaaaagaaataataataataataaagatcaactttattggggaggggtgactattaagtcaagatatgcaaagagtacccagaactgtcttggactttgtgcccaataggttttggcttttattataaaaataaaagaatgatatgacaatgtacaatatataaacaatctcaaattgtttgattttatcagactccctctccactttcagaaacagctgagagggctgtcactgcactgagattagcatggcattccagaactcgggcccggtaagcatccaggtccaagggtgccttggaggggtacacctcacctttgcagtccagggcagaggaaggcagggaggctaggagtgcagcactgagagagcagtggccactgccttacaaggccaagaagcgtcccatctccccaacaactgtcaggttccttcctgccctgggaacagctctaatctgtctgtttaccacctacctgccagccttcagcaggaattccaggactgctgggcctatcagctgaagtagaggatgaaaaagaacaaatccaaaggcagaagaaataggacaatatgatagatggatttgacaagaatccagaccaattgtgggcagaccaagttgaaaagcgtgagaggctagagttatctcagcaggggtttcgttttgttttgttttgtttttgagacagtctcactctgtcgcccaggctgaaatgcattggtgtgatcttagctcactgcaacctctgcctcctgggttcaagtgattctctcgtgccttagcctccagagtagctgggattacagttgtgtgccaccacacccagctaatttttgtattaacaccgtagagatggggtttcaccgtgttggccagggtagttttgaactcctgagctcaagtgatccatctacctcagcctcccaaagtgctgggattacaggcatgaggactgtacccaaccatctcagcagttattttaaaaaatgtttagccttctgatgagaacacgtggacacgtggtgcggacaacaaacactggggccagtcgagggggctgcggggagagagatcatcaggaagagtagctaacacttaggtggtgggttgatctgtgcagcaagccaccatggtacatgttcatctctgtaacaaacctgcacatcctgcacgtgtaccccagactttaaaataaaagttgaaggaaaaaagttcacttttctgctttccagttgcttatttaaaaaaaaaaaaaaaaaaaaagaagcatctggctgggtgtggtggctcatgcctgtaatcccagcacttcgggaggccgaggcaggtggatcacctgaggtcaggagtttgagcccagcctggtcaacatgatgaaaccccgtctctactaaaaatacaaaaaattagctgggcatggtggcgggcacctataatcccagctattcggaaggctgaggcagggagaactgcttgaacccaggaggcagaggttgcagtcagccaagatcgcaccattgcactccagcctgggcaacagagcgagactccatctcaaaaaacaaacaaacaaacaaaaatgcatctaagttgtctgagtgatgtcctgctcaagtccataagggacttgctttattacagaaaagtggccaaacccagtaatattgaaagtatggtccagggactgcttctggtcaggcaactgtttattaccagtctgtgacaaagacagaaattgccagtaaggtgtttagaaactttaatagcaatatgatatcccaatgggtgatcaatggacccatcttactgaatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcagctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaagaaaaagaaaaagaaaaagaaaccattagatctcatgagaactcactatcacgagaacagtatgagggtaaccactcccatgattcaattacctccccaccaggtccctcccatgacacatggggattatgggaactataattcaagatgagatttggatggggacacaacgaaaccatatcaaatattaatagagtctggcagggaggaagcatgacttcatactggtggtgagtcagaaggggcatcttcatattttaaggaaggtggcacttagattccaagtgcgtcctgtgtgcagtggagtcatatgcagctctaataaagaacattattcaggccaggcatagtggctcatgcctgtagtcccagtttgttggcagcctgaggcgtgaagattgcttgagcccaggagttcaagaccagcctgggcaacatagtgagacctcatctctacaaaaaatacaaaaattagccaagcatggtggtacatgcctgtcgtcccagctactcgggaggctgaggcgggaggatcacttaagtccaggagtttgagtctgcagtgagctatgatcatgccagtgcactccagcctggacaacagagcgaggccctgtctccaaaaaataattaattatttaatttaaatgttcgaaagaacattatgcagatgcttctcaggcttctcttcagatggcaaaatctcactggttttcaaatatcctaactgaaatgttcagttccagctatcttttgcttcatccagtaattagtttcaagtttttttttgcctctttttagatatgaatcccatgctaggtaacaaattatagtgacaggaaaatgtggatttttccataaagtttaaatattcaccactcaaccttttagcagaaagctctgggaccaacctagcataagtatagagttgagggttaagagtaagcattcttcccttcgtcacttatgtggccttgaaccaattagttaagattttgtgcctcattttcctcatctgcaaaatggaaataatcataaggtatactttggggattagtgtgaggggcaaatgagttaacatgtataaattgcttaaaatagtatttggcagccaggcttggtggctcatgcctgtaataccagcactttgggaggctgaggcaggtggatcacgagttctggagttcaagaccagcctggctaagatggtgaaaccccatctctactaaaaatacaaaaattagccgggcatggtggcgggtgcctgtaatcccagctactcgggaggctgagacagagaattgcgtgaaccccggaggcagaggttgcagtgagccaagattgcatcactgcactccagcctgggcaacagagggagactccatctcaaaaagaaaaaaaaaatagtatttgacaatgacgatagctgctgttattatcatgacccaaatgctatatttgcttcaagcaaatggaatgattctcagaccaaattttttcaccaggcatttattagaaggaggtttcatgtaattctgaattatgctccgaatcatattcacttcattcaatatgaaaagcaagtatagatttacagtttaattgttttgagacagggcaggattcctaatcacatttttagaaatgacttttgtgtctcatattgttcatctcctctatcctctcaccaagattccactgtgtttcataccagcttgttcagttgaacaaggtggagaagcccatttactgtttggattaaatttttttatcaccagtgtatgaggatttgcattaaataaattataggtaattacattaacaaaccaagaagacttacagttaaagagggcaaaaatataatttacttaactgctctatgaaatctatttgtggatttctctcttctcaaaggagaattaatcagagaacaactttgttgttattgttgttgttgtcgtttaagaaaaaaaagaaagaatgaatgaaagatcacatagtagcagtggtaccctattcaccttgcaacagttgtactctgcgcacctgccccaggttatagcaacatcaaggtcaagctcccaatatttcaagtacaaataagacttcacctgtgcacaaacatgtgcttacacacttccatcctcctgaattttctttccagactgttttacagataaggaagcagctctcaaaagacctctctcagacatttgaaaacacattttttttcagagtgctaaattcatgcttcttattttatatatgttagaaataaacacataaataataaacagtcttgcctggactggttcatgttcaattcataggcactgagtattctttattaggacatactcactattgtttgttgaattattgcacttttaagaaatcaatctgaagattaaacattaggagtctcgataaaaaacaagtctctatactttatgaagatcttaggaatttctaactgactttggaacagccatttgttaaaaaacactttcccatcccaaactccactgactccatttttcttctgcactaactctcccttcctcctcccccatatttggagcagcgtctctatgtcccattcactctcctacacctgccaaatcaccagtgactatttaggggctaagtgcaaaggagacttctaaatcctcactttcatcaactgttgagcagcaacggaagctgctgaatgctccctatttcttcttgaaacacactctctccttgtttacttgagatgacactatccttcctctgtccatctgggaaatattggtgctttgaggttcttgacttggggctcctttcttcacttctcccattctctgagtgacattgtctgttcccatggcttctgaaatataggcattctttgatctaattttttctccagacctacccatatagccaactgccccctaaccatatccatttggatccccccagacacctataactcagcatgctaaaaattcattagtcattactttctctgattgattccttttcattgattcttaatctcattgaaaaacatcaccatgcacccagttgcccaagtctgaaatcaggacattgtccttgcttcttttcaccctttcaaatcctctatctaatcagtaattttatataataaaaggattcttgattccttctacactttttctttcccacttccatgacagtagtccaggccaccattatctttcatggggattgatgcaagagcttctcacctagtctcccttcccctagtgttgtgtccttctgacctaacctctgccacccagcagaagtatctttcaaagttcatatttgatgatgctactctccagcttcaaaccctttacctgttttccttggactataagataaagttcaacttccttaatttagcttagagagtcttttatgatgtgacctcctcttacttctctggccttgtctctcataattgtgtcattccattgctgaccactccagcaactacctgccattccttggatgtaccaagctctgtctgtgtcccgttctttggatctactgtcccttctccaaggaacgttcttcagctgctctttatgtggttaactcctactgaaccatcaagtctcagctgagataccactttccctgagccctaaaccctggtttaatgtttcctgtgggcatatttaccttagagcttactgtgtcatagtacattggaagctgatttttttctctatcctcctctagcctcagctgcctaggggtaaacacactacagtgttcacccttgtattctcagatcttagtacactgccaggctcaatgggttttcaaacatatttacataaagaaagaaaacaatgacaaaagtgcagatgacatgcccatggatactctggacataaatgcttgtaatatttctctctgtaagcgtttccagtgggaagttcagcttttgtctcaattactctgattggcatgcaatcatgacaagaaactaaaggaaggagattgttttcttgacatttactgagaagtatagacaagtactgccatgaacaaacattcttgctaacaattcttgctctaaattggttgatataacatccacttgagtcaaaatgattaagtaggtatccattgagtgtcatgcatcgcaatggcaaagcattggagttacagaaaataagtaaaatcatctcccttgctcttacagatctgacagtctaggcacccaatagatgggtaaacaagtactgagagatgtcatacttgtcctcaagatagtagaaattcaagaaagtagtgaccatggaggaccttaggatttgggcttttaccccagtggtgtttggctgagttaatctttctaaaatgtattcatcattcaatcaagtgcttcttctggaggccaagcataattagagatacagagatgaaaatgacagtcattaccctcacaagacctataatctacccaataataatgggaggcaagcctttagagttttttaatttggagttttcagagatttcctgaagcttctggactgacgtttctattgtacttgagtcccatcatttgacattagaagatctccttccaagaaatatttcttaccaccaaaagacagttaactttgacttcagacagaacattctggtctgcacccagaacctttaatacctgaatcttttaaatcagtgatggtctcttcttctaaaaagtaaaaggtaaatcaaattcagtatgtctcaattaattggaagggagtttcaagctcataggaaatgaactacgaagccatgttgggatatgaactgaatggttgctattgagatggagcaaatgtacctggatatcattaggtggaaccagactggaaaatgggggtccttccttgacctcagtgaagatttggccctttcagcctcaagtagtatcccagctccagaactggacctgagttactggataatgctgtcattaggaaactgtgaccacctaggagttggactgctaaatgggcaatgtcagcaggttgttacagatactctatgcagaccaagcttatttggctcttctcagctcagccacctgttgtaaacagctgagaggggcttagctccacgtggaggttgtcactatctctggtatgttgtctctccctgggaacggacatgagtgtggaaacagggaggacacagttgattcctgctttcactgagtcactctgtccattaggagaaacagtccaggcatggccagccaaagggaggttcttcgcaggatcttctgtctctttgaagatgggataatctcaggcctaaccacagaagcagttctggagaagagtcagaatagcagattggaaacagctcacaggggcctctgaatgctaagtggagggacttagaatttatcccagaggccacagaacactattagaagtttcagaggtataataaaggccgttgtgaggttaggatgctggttcaatgtcacaattagagcaaggcaggaggtagagaagtcaagggcagactgggaaccagctgggcaggccactcattttggttgaatttggcaagactgaggaagacaatctaccaatagaggatggatgagaacaccagaaagcaaataaaacaagtcattcaaaaatcccaagatcatcgtggctgggccagagaaagaatcagacagaagcagcgcacggctctggagagttgcagggagaagcattgctgcatccgctgtctccttttctttttctttttttaaatatcagcaatatcttggatctgaatagagttctatcacagattagggtttctctttccccagggttcccaaagactgagcaggatcttattacagatgcagcgaaaagggtacgtttttcagtatcagactgacctcatctgaatctcagcctcacatctcattaactacatgggaccttgggcaagctacttcacccatctgcaaagtgggaatcaatgatatgtatctcatttggctgttgtaaatcttaatcaagttaatatatgtaaagtgtctcatcagtgcctagcgcatagtgagttcccagcttctatagcaccctttcatctttctctccttacagcatcagagagcttgtcctctgtggctcccgtttctctctggccagaggcagagcctccatgggagcatgggagggatataatcagaacagcagcattctttcattatgacgtcaattcagccatccctcaatttactgagcccctgaaaggccatacagtgagccatcattgtaatgaagtaaaagtagctggatactccaggaagcccttctagtggcactttgttaggtgagatgtgtcagcattgacttcttttgtaagtgctacttctgttgaattcaatgcgttgaaaggtggaatgcattgatgaatgtattcagtgccttggccacttctcagttagcttttagagtagaggacctcatggccacatgacagagtctaactgtcagtttccagacatttactgtgcccttggccctgcttggactttggaaatccaaagatacatatgaccgacgcctgctctgggaggaattccctgtccatgtggaacacatctatgcccttctggtccaagtgagaagagaacatgaaggagcaagtgtgcatgcccataagtgccggtccctactcagttctcactcagtcccacagatacccaggtctactttatgtaggtccttgtgttggtttctggcattgctgagatgacagaggccccagtctctggagcctcagagatttcatggacacctttttctgcttgagctcatgagccagatatcactcctggcccaggtcactgggttaccagatgcacgggtgaaagagctgctcttgagcaaagggcctgggacacacatgccggagaagcatggtgagccagccgcagggaggaagagcactttgcaggagcatgctgtgcggggtcttgctgctgcttttcagaagcaggagagccatgagccttggggttcacatcagcaccgagactggcctttggtggcagggaggatatgcgtaccgggaggggttggccatactggaccacagggccactggttgggttgttcataattgatctttggggacacttactgcaacccatttattaggtgccccctctaaagtgatgatctcaatgaagatggttcacataggcccactacttctagaaggcccgaatccctggaccttcccaaccactttttctccctgttcctgggttacatggcttagctggatatttttgcacacagcattaagggcaagtgcactgttcctttgaaaacaacaagggaacaaggagttcagtgttgtggacatttaatgaactttctcctcctaagtacacaataccaaatcagcagaatcacagctgtctcctcccagctttacctaaattcccacatgtgctacctcagttagggaactatgacttcacctgccactagatggccctccatgtgcacataagccgctcccacatagcgaacttgcatcagattttctggatttttttttttttttttacatgtagacacacatgtgcatacacaatcttaacttttaccatccttgaagccaataatcaacactttagttttccttctggcattcaaatgatagaatgtattctcattctctggaaaatcagtttaacatcagaatctacagatattcctgaatattgtgggccacaaagcacatattaagatgaatttgaatttattctattaaatagtatgctttggtttatcttataaatgctgtatttaacagacttgtttctaaattaaatttttttaaagcactggaagagaaaggaagcacaaacatttgaatagtacttgctccatggaggcgggcagtgttctgaggtattttaaacattagctcatttaagcttcataactttgatgtaggtattccatatgcatcattataaccattttatagattgaggagaaaatcagattgcagcatgaaaggtgtttagattcccttttgccttcctgtcaattttcttacctataacatgggaataaaataatccctaattgctgtgaaaggatgttgtaaactctaaagcattacacaaatgttgttattattattatgacttgggtttcatgggaatataattttcttatgtgctcaggaggcttgtgatcattcattcattcacatgaaaacatttatgcaggtcccaggtcattgcctctgcatgagacgtctcataccgagatgcctgtactatttctaaaacaaatctagtctgtcttgaactctcttatagctgagggttccagggaagttgctgtgtgctttcagcaggtaattctcccttagtctcaggatttagaaatgatggatgtggtaggacaacttcaggggtgggacctctgctgaacacagaggtggccggtgctgatttcacataagccaagccagcgggaagaggcaggctgttttttaaaattattattctggagcacgatgtactatctctgtatccaagagttcacatttcaagtggactatcagatcatctctgtgacagagggctttaattaaaagcataagtctctgggtggattttaagtggcattgtttttctttggacgttatgcaagccacttctgtgctgtaaaagggcttttaaaatttggcttaaggaaatttgctttacccctcaggctttgatccctgcgtgtgaatcattttgtatctggaggttccaatttgcagtctcctgggtgtaaggaaaattctaccctcacagaacattttggatttgaaaactgagaaatctgcatcattctcgacataatagctgttgtaaaatagaattagggctgttaagtctatagggataaagttcaccaaagaatattttaaactttagttttagttcctaaagtttttgtctccaactcccataataaatgtactgggacagtgacctacccactcaacacctgaagctcagtgttctctgcactcaggccaggtggactcagccatcgaggccattgtccctgtccagcctcccagggggcacgcatgagccagggccaggatacagatacttctgcctcaacaccatctgtaccaccagaaaagggccccaaaggcccttctcactgccatttgtaaggcaaaatgtctctattttatctaagacaggaaaaaggcagagagatgccagagagaatgcaacgactgtgcccgtgagaaaccaacagtgcagggtggcgatctacccgcagcacatgcaggatgcagcgttagatgctgactcagtttctcagccatacaggagaaaagtttcagcatttctcaaactccatgaccatccttcagtcggctaccccaagccccgttttgctgcagccgggtgagggcagtaatgcagctcagtaggttaaggggccaggctgtccttggacttcagatgatatcagttcagtccctgggacatcttaaattagggcctcaagcttcaaattcatgccttggccaacacgttaccataaatgatcacagggagaagaaacagtcaggccagggatggtggcaggttcctgtaatcccagcattttgggaggctgaggtgggaggatcacttgaggccaggagttcaagaccagcctgggaaacatagcgaaaccctgtctctactaaaaataaataaacaaataaacttttttacaaaaaagagaagaaatggtcagtttacgttgcatttccttcttttcctcaagaagaggtgccccgtggtgcctgggacagctgggccatcacatggaagtggctgagaggtgggctggaaagaagaggaaaatccagggctcccaccaaccccagccaatctctagtcactgggcaacctcaatctacttctggtcatagttttacaattttgcgggggtaggggggatggaatcttgctctgtcacccaggctggagtgcagtggtgcaatctcggctcactgcaacctccaactcctgggttcaagcaattctcctgcctcagcctccccagtagctgggattataggcctgtgccaccatgcctggctaatttttgtattttccgtagagacggggtttcatcatgttggccaggctggtcttgaactcctgacttcaagcgatccacctgcctcagcctcccaaagtgctgagattacaggcatgagccactgtgcccagcaatagttttacactttaatattgccaactttttttcagcccagcctgtgcagccacacaaatgcaaaaaggttagcttaggaagttgtcaacatcattatactataaaaatcaataaatggaaccttcttgcttcccacagtagtccatgctaagcttggcttcaccatcccttgcttggacaactcctaattgttctttatggtttcactctgtaaccctttcatacatccaaatccgttcttttcacatctgtccacatggtctttctagaacatagccaatcctatcactgacttaaagcaaacacataaacaggcagacagacaaacaagaaactcaaatggctttctgttactttccgaatcagactcattagtgtggcattcaagagccatcatatcctgagcctgatcctccctgtcactttctttccctcatgagtgcactcagataggccagtcctacagaggtcctcattcactcacttgagcctgccttgcacatttctgcatcaaagcccctttgtccatgttatcatcctagcttgaaatgctgtctgaacacctctatgccttgatcatttttctcttcaagatcctactgacatgttccaacctcctgaaatcctgccctgcctccccacaagcagagttactcagactctcttctttgcattcctgcagcattttggtcttgcaatttgagctctactgtgcactgcattgtaactattcatatagcttcctccctcatgagatgatgaatttctcaaaagtagagactgggcagctgttactgaatatagcccaacacttgcttgataatgctcgataaacatgaatgagtgacccagaacatttcaaacttcccttccaagacctgaaagactcatatttctgggtgttttaagctctgtgatttctgctctggtcacctgggccaggaactgcctgcctctattttcatttcaggcctttctctctctgccagatgccttgatctctgagccgagtataccttgacccaaagccatgatgcagccctcagcttctgagaggaaggggtagggttcagtagttgcgcctctgagaacatgacagagaacaatagcaggaagcagccaagcgggaaacaatcagcccggcacaacccatgtggaggagcttcctgattggcttgatctggtgggagcaggaactcttacaataactctggaattatcccagtgggatgacaaatttctccactgaggagaagctgtcacctggtaatgtcaagcacggaaaacacagttagcaaaaaacaaaacaaaacccaagacaaagttctcttgaggaagagcagtttggatcagttggaagcctcccagccactgccatagcaccccatgccgacctccttcctagtctctgtttcaggtacaattaagtcgtcatctctaccttccggatagatatcattctgccgtccatggctcaaaggtcagaggtgctgtttattctttggtgtccttttgggtagtttagggaaatccatgctgtaggtgaccacaagagagaatgttcccttttagaactatattgattgagcacaggctgtgtgcaaatactcttctaggcactgtggatgccatagcaatacatgctgtttctgctttcatagagcagtgatttccaaatcctgtgtatcctatggaaagaccaagccaggcaaggggtggagtgacaggagctcccagtcagctttctccttaaaccacagcagctccctttgatcaagatgttggaaaagaaaaatctaccccaaaaagaggaaatgctgaaaacatttggattgggagtggtttcatttgctcttaggcaggacacactgcagggtagcagttaatattctaggctctagctacaagcagacctgggtttgaatcccagctctgccacttactggtggaaggtcataagttgcttgaactctctcaacctcaagttcttcatctgtcaagtgcgaataacagtagtagatattttaccaagtgcaaagaattgaataatgcttacaaaccatttagcatatcatctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacacacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccatcattctggcccaattcctacatatctgtgcatcttctacttatggttttatttaggtgagaataaataagagtacctcatagtagataagaatagtacattacacacgcgcgcacgcacacacacacacacacacctggggttagatgaaattgtatatttggggaacttggggtaaagagtacagagccacacagcagttaccttctgcatcctcctgcttcagagaaagcaaataagaccagtttctttttaatctgttgtttttactaagtccaggattgatgttaatttgaatttgttcttttaagattcatttttgactgaaagaactgagccggaaggtctgcttgaggctacttccagttgagaaacaatttatgtgttcattgagacagtcatttactcaaccaacacttactgagaactttcaatgaggcaggttccttgctagatacaggccagctagatgctagaagccatcatcaaaggaagatgaaaaagtgatggtaattatcctctagaggtttgtaaactggagttagggaagggagcccaaaatccatgaatgagtgattaaaatacagtgggataaagttggtggtagaaatatgtccatgagatatggcagcaaagaagaagagcaccttcatgggaaaagtccaaagaagacttccataaagagatgatacctgagcagatgctttaaaaatgagtagtaattacccatgggaaggggaagagagagaacaagggcaatccaggcagaggggtggtatgagcaaagtcattgagccaaacaaggaaatcttcatttctgcaggtaaatgagaggctgggagtgtgtcatatccatgagctttagcagagagcccatgaggggttttcagcaggggagtgctattgtggtgtgtctaggcacattctggattttagggtgatggggctgcatagaagcagagagattggttagaaggttgttgcaggcatttaggagagagcctatactagggctgaagagaagcagctatgaaaagagatttgtggggcaaattggcttggtggctaataagacacttagttgacctggtgactaataagatacatgtacgtgatgatagtaagcgagggtcaagccagaggtgaagacaacatctaggtttccctcctaagtagaatggattaacggtggtaccagcatctgagctagagaatagggaggagcagctctatggagaaagatgagtttggtcctgtatatgttgtgtatgtggaccatccgggtggagacattcaaaatacaattgtacataaaggctggagttcaggagagatgctgaagatatagtttggatagatttaagcatgttcggtaggaattaaagcatgaggctggacatgagtagccaagaattaaatgttaatcaataagaacaataaaacaaataaacctttagtggtagagtaggagaagaggtgcccatatggagaacatggcgtcatggtctcttcatcatggaggaagagtgatcaaatatgtttttaaaaacgaagaagtcaaacagatccacaccaaagagggtccgctggacgtggcagtcatggacttgactaggagcagacgcagcagggcatgagggcagagggactgaggctgaggcatggacttgactaaaagcagatgcagcagggcggtgagggcagagggactgaggctgaggcatggacttgactaggagcagacgcagcagggcggtgagtgcagagggactgaggctgaggaggggtcaggatgtgaggatgttgaggcagtaagagatgactggccttggggaagtctggaagagggattcagcagcaactagaacaggatgcagggtcaagagaagttcacttatttttagtatggaaagagataattcttgtttattgactagcaggaaggaggcatcttggagagaggtgaagacacaggggagaggggatagttaatggggtatcctcccagatcagtctgcacaagctcaggtgcaggggtggaggcgctggccttcaacagacagtctgagtcagaggctggaggtcagaaggtgtggctggatgggactttttctcttcctagaaaaaagggacatttttagggggaaaaggagggggtttaagctattgagaaaagtactgctttgaaatgaaataatctcactttcctgtaatcaaaactctttatttctgatgaaacagactcaaataagaatcacaacaaagaaatcagtgctcagctcaagcctggaaatgatttcctacacggaaatccacttgcacagattctgatagtgtgagtcatgtgattccagatggagtaaatacacatgaaaaggagagaaaagctggtgtctccatgggctgaagcacacttatggagagagaaattttcatttatttgtatttgggcttcaatatgattacatcaccatcaataatgaaaagtgctgccatgtcccagctgtatacttagatcaagatataaatcagtccaatattgttcttttttctcactgaatatctaaatttgtatatttgaggggaaagtagaaaaaccaagccaagattttaaaaattacatttactatcaccatctccaagttacattcactatagaatcctttagaagcatgttcttgggtagctttgctttttatgcactcaacaaatatttattgagcatctgtatgtacagggaagaatgtgaggtacagtaacacaaaatatatagtcctatctcttaataagcctgcacttgggagaaggtatagatagggttgggaaggataaatatatttttaacactctaatacaaggcagagtgtaccaaaagttagaaatgctgtggagaatcagaatgaatgaacataccaggctgggttggggggctgggggaattatggaaaacattcctaaagagatgtaatttgatttgggcttttattatgatatctgttttcagacaatggagttgagagtggggagtccttcctggctttgtcaggagcagtttgaggtcttggctgaagacaggaaggcataaggctggaaaggggtgggagcagaacatggagggtgtgaacttccagccgaagaagtttgatggggtttgggaaggaggtgagagggagccaccaggaaaggatgtgagctggacctttggaattcttaaagggacccttgtcttctctgccatatttctgtctcagggatgacgtgaggaaaaaaaaaaaagaggaggaaatgggcttgagtttccactgacaccttacagtcaaggaaggccctgttctttcataaggaaaagtggaaatcctctgtttacttaagggccattaacatgttttcatattaaaataccaaatgatctgccgtgactccagatagactcatctaaataaaaggaagctgtttccttacaaattgagtcacaaaggataaatatttgtggagtgccatagaaacaaatgcgctgtcttcctgaaatgtggaaaatgaattttgtagcattgatttgcatgaaaacaatattcttcccagtgttctacctagaatattgaaatggaggtattaagatagatgatagataggacagatagattgctagagagctagattagatagatagatagatagacagacagacagacagataagatagatagatcgatgaggttaaatattcttaggatggaagaaggggtcagataatcacatctcagacagatctggaattccaggcagcaggaactaatgaagtggtctcttcagagttttaccatgggacgaattcacccccgattagtttttattctttgagtcacttctctcaagacaaagatctttgggcaagagttcagttggcctagcttagatatgtttctactccttggccagggatgtgagccttctgaccaatagtttcaccaaatctacaaggaaccctagagagacttttttcccagtggaggagctggatgttgttcctaaaagaaaagggcagagggaccctgggcaggcaaaattttcagctgcctgccaccttagcccctgtccccacactcacttctgaaccacatgtgatcagtcttctcttcccaccacataactgaaacttcaaggtcatgggtgagctctatgttgttaagtcttatttataggagcgatcagctcgctgcactgcaaggctggaaaggtgtttaaaatgtatacttaggcatgtcttggctctttctgatataattcagctggcaaaggctctggcaggaagccagacggacacaaatagcgcaccaaagagatgctaagacatgggtgattataattgtgcaaggagtagaaacttctctgctgagactttggatgtggcagagatttggggagtagaaggggggcaaagcacagttccagccaaccccatttacaggcgttgattagcagtaatgaattcacaaccttgcaattgctcatttttttttcttctgctgctgagtcatggataagactctaagctctgattagctgtgatccctaattctcagcacaattctaagagcattccttcaaattcaacaatatgtggtaagtgtcttgtattaattaggattccatgtggatgcaaggaacagagacccacaataacagtggcttaaacaagatgcttatttctttttttttttttttttttgagacggagtctggctctgttgcccaggctggagtgcagtggcgcaatctcggctcactgcaagctccgcctcctgggttcatgccattctcctgcctcagcctcccgagttgctgggactacaggcgcccgccactacgcccagctaattttttgtatttttagtagagatggggtttcaccatgttagccaggatggtcttgatctcctgacctcgtgatccacccacctcggcctcccaaaatgctgggattacaggcgtgaaccaccgcgcccggccaagatgcttatttctcccttcaataaaaatccacaggtctgcagttatgtaaacatccacaggcatgcagttaagagctgtttggtggctgtgccctgtgaattccttagggacccagacctgttccactttaaccctaaagactgatccttgtcaacagtgaccaagatggcagtttgtgcctcagctgcatacatgtgcatttcaggcaaaggatgaagaaagaactggagaagaaagggctaaagaagattctaggagctgacatatagcactttcacttacatgcctttggccagagcatgtggctacaaaggatgctgagagatgtggcctttactctgtgtggccatatgcccagctcagccacaggaatgacattgctttgagagaaggggaggatggaaattgagcaacttagcagtcccctttccacttttacttgtgctgaattcataaacatgtgggcagctttcctctcctctgagcagcaaacacttcttctgaggttcttgttttggcaggttggccagacaggcaccccacttgactgctcaactatgaaactgcagttccagagaagagaacaggtctgaattaagcaccttaagccagttggtcagcatctccttttattcggagagtagttactgagattcaaacccatgtcaactgagtagcaatgtgtttggctatagggtagggcgtaaccctagtctatgtctctcaatagtgagttatttcataaaggctcagcccatcgtcaggaatatgctggtcttgcgtaagcctttttcagaagtgttcatagggtcctgagaattttgtgagcacttctttactgcttctcttgcctcctcttttagttggtgctgagttcactgcatgaagggtcccaggagtcctctttccccttggtttttctactcctttccttttctgctctttctaccacctcctactgctggacctctttgtatctgtactccaccatggaaaataagttttgtttgccccagatcttcccatttcccagagtggagcctttataattcatgatgtttactaaacttgatctctgccctttcaagggatggaactcagataatgaaagatatagggagggatacattgcttaaatctgtgagtgggcattacgatgggcctaagtgtcccaagagggattggcttgccatgggaggtggtgagctccccatgtgtggagaagttcaagaaggtgtgaaataatcgttgggtggaggacagttcaaggacttcatgtttctggagagcaattaagttcaatggcttctactcccagtctgacctgtgcttctgtgagcttgaaaaatatatattgtgttgcaatgtgcattctttagggaatgaaggtaaaagggcaagtggtcatgggaggatgtcaaggataggggcaaagggtactggttccccagccagaccaccagggtccaaattctggctgcacatcatctctgcaaccctggacaagtcagtgctctttctgtgtatccatccatctgtgtcatgggagttgcagatttttttacttcatgggatattgtgaagattaagtattataatgtacgtaaaacactcataacagttccaagcacacagtaagcactcaataatcctaatccttatgattattattgttacatatattactgtatctagcaaaaacaatattagaattgttagtattataataattattatcatcattgatggggaaggaaaaatgaagcccacctgagttcacagacaagaccctctccaaacagtaaaacaattaaaaaccaagttgtatttgtctgtgctcctttggattcaactgaccaacacccaggcaaagggaaaatatattggcttgctttttttttttgagatggaatcttgcactgtcgcccaggctagagtgaaatggcatgatctcggctcactgcaacctctgcctcccaggttcaagcgattctcctgcctcagcctcccatgtagctgggattataggcacctgccaccatgcccagctaatttttgtatttttagtagagacggagtttcaccacattggacaggctggtctgaaactcctgacctcaagtgatccacccaccttggcctcccaatgtattggcttttgtaagtaagaagggcaaaggagtagctgaggatctgggaagcaggaactggagattgaatggcacgggtccccagcagccagcatgctctgtcttcccttctctttgtttgggccttgcaggaaggtaggctctcagcagagccttgaaggccaggtatttgagagccaggcaagtgaagcagaaggagagcatgagtgagccattgggagtggggacggaaacggcgagaacctatccaaggcaccgtgctgagctatgaagctggagggcagcgcaggctgtgacccaaaaaggccacacaaggccacatgctcctgagtgacaggagggacatgtgatatgctgggccttggcccatgctgtctcctctgcctggctcattttctcctcttttctacctggtgaatgcatccttcaaggcccagttaattcatcatctactttgtcgagtttttctcaccacctgtatcagttgagaattgcattcagctatgatcacaacagaggcttaagcccataacaagcaatctggagccaggcattccagaagtggtgtactctttccatcgtgccctctgggacccaggcaatgtctctctttctgcacactcagacatactattgcccctgtggacataggattactgctctgcctatagcatcatatcccttgcagtaggtagaataatggacccccagagatgtccacaggctaagcctcagaacctgtgaatatggtaggttccatggcaaagaggaattaaaattacagatggaattagagtttccaaacagctgactttaaaatagggagatcagtatcctggattatctgggtacactttgtataaccacaagatccttaaatgtggaagagggaggcagaaatcagaaggaggggtggctgcagggaaggtcagagagatgcaacagtgctggttttgaagatggaggaagggacccacaaggcacggaacgtgggtgacctcagggagctgaaaagggcaaggaaatggattctcccctagagcctgcagaagggaacacaacgctgccagcaccttgattctagcctggcaaaccccgtgtcagacttctgacatacagaaatataagataataaatgtagattgttgtaagccactaagtttgttgtagttgttatagcaggaattggaaacgaatgcgtctctttagcaccaggtccctgtacctggcaggaaggaaggaaaggcaaatgtcacttaagccaacgctcctttccttttttttttttttttttttttgagacagggtctcactctgtcacccagactggagtacagtgttgtgatcatcactcactgcagtcttgaactcctgggctcaagtgatcttcccaccttagcctccagagtagctagaactaagggtatatgtcaccatgcccagctaactttttattatttgtagaggtgggggtcttgtcttgccacgttgctcaggctggtctcatcctcctgggctcaagcaatcctccagcctcagtctcccaaagtgctgggattacaggcatgagccaccgcacccagccctcctttcccttttagggagttgtgtggaagtcccttcggatcatttttacttacatctcattggccagagctgtcccatggccagctttatcttcagtggaagctaggatacataatttttttcaggtgggcatgttgccatccccaaccaaataaggattctgttagtttggaagagggggagaatagatattgagaagaccactcagcgtccccaccacacactcccaggcagaaccaactattctacagcatgttgttctttcctctattattgctatttttggtttgtattgtaatttatgtgttcacatggctgtttgcattacttgaccaagaagtctcatgagcagacactgtgtctgatttatttctccatccccagtgctcagcatagtgcctgatacagagaaggtgtttgcatgaagttagatggatgaatgtctaaataaactttgaaataagagcatgatcgatgcacttcccagagcgagagttcctttctgttttcttgtgaggatgatctattggggttaggtacattttataagaccatttggccatgattgcaacctcatctccagtaaattaaacctacacagctgcagtgtgtcacctttccttatggcttattacagtttgctttttgctcagaaggaactgagcaagcaggttagaggctgttatgtgcacctgccacagcctacggatcctcaattaaccttgcgtgtaaattacacttcctgcccattctttatttttagcacagcaacatctacttggctcttccagagaagactgcattagatttcagtcatgaaactacaaaacagtggcgtctgcagcctggctgggatgactgttgttaaccccatgacactctgttccttgcgaagctgctttgccccaggactcaggttttcctgagaaagagagcagcctggactgaccacaccctcagagcctggcccaaggccacatgtgaacttatagaaaaatctgctattggatctgacataaactctccatttccttcattcattgcatttgggttgaaactcagttgttgttatcacaaaggtttcatttcgttccttttttttctctccctctctcttcgttccttctcagttacacagtatcatgacccaaatctttagcacctgaaccatatagcgcagagccttgaaacccatagggccagggcaccccgtggagacaggccagccagtgggcatcaggtcgcagagaattcttaaccacttaaggttgcttcactggaagaagtgagttactgagagacagccattttcggttttagtcagccatttttatcacgatcttgtttgttttagaatcccctgtagtgcctagctcggagtccaaccaaacaagctccataaatgttgattttgaatttaaatagatgttggggtgctcccatttccccttcactagacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccattactcagagacaactatcactgacatttttctgttttttcagtcttaattctcatgaaggtgtgccctgtttccctccagatttctcagaggattcaggattagggaagggaggagagggtgccttatgttctttctaatcgtttagctttgggtattattgggatatatataaatacattaacacacatataaatatatgtgtatatatattatataactggcatatacattattgggatatatattagtaggatgtatatatatatatgtgtgtatacatatgtgtgtgtgtgtgtgtgtgtgtgtgtgtgtatatatgtaaaatgtatacacacttctatttgacctgtaccagttcattattaccacaataatgctaactaacacgccctcaaattcagtggcttaaacccaaagtcatttattcttgcccacacttctgtgagtaggctgggtatttgctgatctaggctgggcttagctgagtggctctaatttcaggtgcttctgaactatatagctgagagccctgaaacccatagggccagggcacactgtgcctatctatgggtttgcctcaggtctattccatgtgtgttctttctgtggtccaggctgaaggggcagcagctgcccagataagttattgtcttggcattggaaggggtgcaagaggacaagctcaactgggcaagcacttttcaagcctctgcttgtgtcttatctgctcacatcctattggctaaagcaggtcacatggctgcggccagtgccaagggactgggaagtgtaacccatctaccataagcctagagcaaatcacatggtcaagattgacatcagtggcttggggaagcatgtactcttcccatggaagtaagggaggaaggaagggaatatttttgagaataatgtaatcttttttttttttttttgagatggagtcacactctgttgcccaggctgaagtgcagtggtgcaatctgggctcgctgcagccttgcagcctctgtctcctgggttcaagcggttctcctgcctcagcctctagagtagttgggattacaggtgtgcaccaccatgcccagctaatttttgtatttttagtagagacgggctttcaccatgttgatcaggccagtcccaaactcctaacctcaggtatacgcctgcctcggcctcccaaagtgctgagattacaggcatgagtcatcgcaaccggcccaagaataatataatctactgcacaccctaaatatctgctaaagtactctgtactttgagatttaaatcaaatctgctcaggccaggtgtggtggctcatgcctgtaatcacacctcaaataaataaataaataaataaataaaacctgctcagagcccacctggttggtagtatcatccagtctacacagggaacctctagtccagagctcctctactcattgaattaattcagtttctggataatgtgactgtctcgtgtgttgttcctatttcacactcatgtctctttacttactccccccaaaataatttacacagatgtgtgtagaagattttgctgaacatctggaccagcaaagaagttttacatctttatgttcgtatctctagattggccagccccctctccataaattctctttgcgtctcgcccacacacagcctctcaagttaaagcttgctgaagaattcactcttgtctccaaaattctgaaagtcttatcttggctgggccacacctttgcgcaacttagctcagctttttaaattcattcaatgtaggtgtattgagcatttgtgccctctgtctgaggaatttataatctagtaggggaaattaataatgtatgttactatttggggccagaaaattctttgctgtagggtgccatccggtgcactgtgggatgtttaccagcatccctggcctctacccactatgtgccagtaacaccagtcccacccccttgagctttggacaaccaaaatatctctagacattgctgaatatcccctgagggacaagatcacctcagttgagagccactgctctaatatatggtagacttgataagacttctgataaaacaaaataatgtgctaagaaatgttcagagggaagcgatgttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagtatgtcgctaaataaattcatgcctggatcttggtgttccttacctttcagaaaaccccactctgaactccttattttaggtctaagtctaatggccagttcccgagagcagattaaaagatggaaaaagagggccaggcacggtggctcacgcctgtagtctcagcactttgggagcctgaggcaggaggattgcttaagcccaggagttcaagacccacgcaggcaacatagtaagacctcacctctacaaaaaaaaattaaaaattagctgggcatggtggtgtgtgcctttagtcccagctccttgggaagctgaggtgggaggattgcttgagcccaagaggtagaggctgcagtgagctatgatcgtaccactacactccagcctgggtgacagagtgagactctatctcaaaaaaaaaaaaaaaaaaaaaaaaaaaaaaaaaaaagatggaaaaggaggaaggcaagggaggggacttatataggcagacacagactcagcagcaaagcttccagcacaacagaggggaaagagaccaaaagaaaaaatgaatgaatgagtgattgaatgaatgaaccaatgaataaattcagatcaaataattcaagaggcacagcaatctagagttttagcaagagaacatttatcccttcattcttcctgaagacattgctgcatatcagtgccatcctactctgccaatatatgtaatgtttaacaaggtgggggatgtggagaacactttagatcccatgtggtaagagttgctcaatggttaggaacagggtctagagtcagagcacctggcttgaatccttgcttcaaggctctgtggcactaaagcctgctttactaggttacttcaccttgccaagccctactgatctcatcggtaaaatggggattccctactcacagggtcattgggaagtttggataaaataatccacatgaattcttagctcagttcctggcacagaataagtgctcagtaaatactggtggtaattattatcatttcactgaaagaatatggctgttgagactttccccaaatcatagctgcagctgctattctggaatatttccagagtctcctggcagtgctgaaatttcccttttataaaatacataggatggctgtgaaaattgaggaaagttccaaaaggcaggggcagttgcatctgtcttcttcatttcccttctttttggcagtagaatccagaccacagagggagaggacaccaggctcccaagggtactggccaccagctatttcttggcaacatacttcctttgagcaagaatggccctttactttttgaccaacctgagagagcacttactctgagccggtcaggagaatatgaagctattttccttctgatgttatgtcctatgctatgtaaatataatctccctccaaataagaaaggtgcacatgcatggtgttggcagggaaacatcgaaacatattgcatagtggtggctgtgaaccagtggaggcagtgctgtgttgatttcccttgaccaatgtctgcccagtggcagagctggaaacacaagatgctgtgtaatgtaaaaccttggcctggctcctcagcgtaatgtaaaacaaaggctgccaggaaggtacaaatcgcccaacaggaaggagctgctctcttgcccgtggatggcaggacaataaagtaacttgtcctttgtttgtgtgttttccaggctggagcaagaaatacaaacgctagaaagtgaagagtcccagatatctgccaaagagcaaatcatcctagagaaactgaaggaaacagaaaaatccttcaaggactttcagaaggtgaagaaaaccaaaacgatttctcaaagttatttccatggggaagtagggcctagcaaaatggtgctaactgggaaacaggccagtgggcattgatgagaaatctgagccacgaactctatgaaatgaggggcagatgtgtgaggaccaggggccatcctgaagctaagcatgacatatctttgggtgtgggaccatctggcctgctgcaaggcatagggaagagtcattagattaccccatctgcctgctctccggatccctgatatgccttgtgcctgaaaagccttctcttattggactctagaattctaaaaccaattctgatgaagcagaataaacatgctctttgtggctttaattatagtttgctttttgagtctttcattataaaaaggccagaagcaacaccttatgaagtggacaagaattccaaatacaaagagtgtaaatacatgacattttactgtatatagaaacagatggtgcctgtaatcccagcactttgggaggccggggcgggtggatcacgaggtcaggagatcgagaccatcctggctaacgtggtgaaaccctgtctgtactaaaaaatacaaaaaaattagccaggtgcggtggcaggcgcctgtaatcccagctactgaggaggctgaggcagaagaatggcataaacctgggaggcggagcttgcagtgagctgagattacgccactgcactccagcctgggcgacacagcaagactgcgtctcaaaaaaacaaaaacaaaaaacaaagacaaacaaacaaaaaaacaggtggtgccgtgtatcaaagagtagagtccgtaaaaccagtaggctctgaacaaacatctcaggacctccctccattttataactgtttctgctgtacctatgagtgacagaaaagcaatctaatgaaatcaatttaggatgggattttctgatatcattctccagcatgaccaaggatatttgctagatcattgaaataaatctctattgggagaaatttagtataaattgggaattataattttggaattctaaataaattgtccagaagaaaagagatcgttgcgtttccccagcacagtcaaattctgggctggggcatgggagaaagatgggttaagtctttaaagatgggaaaagatgggattgtacccccacatgtagagtaacgctctgccttgtttttgttcctacagggtttctccagtacggatggaggtaagtgctctctgccccgactgtagatgaatgttttaatcctggtcagcttagggggtttcattaacaggggcttaaggaagaggtactgtgttgatttgtaaaggcatcagaagaagtagcagcgctggttgcaggccactgaggaggtccacattccaagccttccctgcctctcttcttcaggaactatctcttggctcactgtttctcctcttacaaaattggcctggctcttctccttcccattagtcccaacactcactgcttgggcctctcttgaaaggtacccagcaaagaagagtactaacatcaggacctggtcccttgtagggatgagcccatttgtcttggtggttaggtcctcaggttgaaacatacgtgagaagtttaagaaatttggggaaaatatttggtgtttgggaaacctttctacagcctctggattttctttgctttctctctctctctctctgatcagacaactgtcgtttctttcatagaaacagggctgggcaaaaacttccctccctgtgtgggatagttggttcagagcataggaaggtaggagtggggtcctggcttcctggtggcaagagcaggtctttcaccttctctaccttccctacctttcctctgtcctctcctctccttacctggactgtggggatgaacttgagattgtgtacttctcacccttcaccttgctccctatcctcagctgcaaacccatgattcctactttcatttggccctcagctagacctgctttacaatgcagggacttgttggaaagaccagatattgtctgctcccctggctcttagaaagtcacattctagggctgggtgtggtggctcaggtctgtactgccagcactttggaagactgatgtgggaggatcccttgagcccagaagttcaaggctgcagtgagctatggtcacaccagtgcactccagtctgggtgatagcaaggtcttgtattaaaaacaaacaaaaaaggtcaacctctagactaggaagatgatcaggagccaggataagaattggcatcagtgttttcccagcgtcatttggaaatatacggggaaaggtttaaaaatgtgtttctctggattagtcaaaggtatttgcatgaaggatagttctgactttggcaaaacaaacaaacaaacaaacaaacctgtgatttttaatttttttttcccctagcaagagacctggattttgtctccccaggtgatctttaggaaggtactaaattaaacttcatgctctgagtacatgtaggcagggccaagtcatgtccaagctagcaaggactctaggaaaagcggacctacaatacttctaggaagtctctatggtgtgaccaagtcagggcacttgttctgtgctttgggggtggggcacggattgaggaagtggccttggggaattgtgggtacagcatggggaggatggcaggcttccctgagtctgggaagacctgaggcatgccacacaattagcaataatacagtgcatgtcaggctgggatgaagtgtgggacactgacccatgaacacctacccaaagagtgcatgtcggccttttatgctttcactttttttttcccttcccttctcaaatcaggaatttccctagacatctctctgatacttagggaagggaaagaccctgtatgtcatgttcctgaggagtctgtgtggggcatggagacctgtcatactctgtgacttgttaacaagcaaaaatgcagccgcatcataaactctcaccacctctttcatttttacctcaaacttctttcattttcttctgcattgcttcccattgttttcacttatccacctaagccatttgtagaggtggtaagaagcctagtcataactgaaaagagcctgcagggaaagttgcccacagactccatcctccaggatgggggagctcaggcttaagaggatgcaaaagtcttagggatctcatttcttgggaagtggcccagggaagagtttccgtggtcttacctgtcaccctgcattataattcctgccatctgtggttatcaccaagcctgggtgacctctttatctgtcataccacatctattagcaaagaaagaagtttgaaggcgggaacacatacatcccagaatgtgattgatgtatatagagtcacaatgtggtgaagcacatcccagttgagggactttgggatgtctctttatcttctcattcttcaatttcaaaggccccgagttgccaagaccctcttagaatcatccaacttgctacaaaaaactaaccagatattattatagaacaatggtgacttaagaaacacagttaatttctgatgcgtgcagattacagaatccaggtccagttaggattatgtaactatacagacactgcagataagcagcaaaagcatcccaactcgtgaggtgctatgagatagctgctggtgtctgtgtgtgtaatgaccccatctcaggtaacctaagtgtgtccctctatgcatggcagaggaaatagaggtaccgtactgctggatcaccagtggcttttgattgcatgatagcctgggcaatcaagaacaatttattctattcttgagtagaatctcctggtcatatacattctgacacccactctcctcccccgccaacacacactgttgttatatagcagaacgctcatctattgggtgggttggttttcactgtcttaggcataatgtcttgtacacctataaattgcatatagtatatatctggtgctaattctgttctttacccactgaggagggagctgatgcaaaactcttgccagaacaggcaaaggaaaatgtctgtcctgggcctatctcagtccttggtgtatgatatggatcttcttaggttcccatcccataccagtctgtggtggcttagagcgtttcccacatcaaaaccttcataccagttattcgcaaacctcaatcttcagttgcctgtaagttatgtgtttgtttgtttgtttatttattttgagatggagtttcactcttgtcgcccaggctggagtgcagtggtgccatcttggctcactgcaacctccacctcccaggttcaagccattctcctgcctcagccccccgaatagctgggattacaggtatcagccaccgcatccagcctaagttatgttttaagaagagttttcatcaatttgtttctctggctttagctgtttagattcttcatagctactgtaaatatttcagcgggattagaactaagaagcagcactcatctttaatttctactctataagttactgctttccaccttctctgtcagtggggagaatagtgttagactattctgactttggcaggaagagggcagcttattaattgaggccacctgaagaagtttttcccattgaagttttggcaagcctgtttgttactctttgtgctggcctatcagacacttcctgtctatataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcgattctcctgtctcagcctcccaagtggctgggactacagacacacaccaccagtccaaatttttgcattttagtagagacagggtttcaccatgttggccatgctggtctcaaactcctgacctcaagtgatctgcctgcctcagcctcccaaagtgttgggtttacaggtgtgagctactgcgcccagcccattcccttatctcttaacagaagccatgtagcccaaccctctaagtgctgtagacttcaagcttgtagccagtaaacatctggcaaaggtaactccatcatccattcccatctggcagggagctatctcctggaggaggctgagacataagccctgggaatcacatgttctttcagatggaaaattccctgtctgtaagtagtttttttttttttgtttcttttttaaactgctaaaacattgagtatgcagacacacatgtgaccagtccatgagatctcacatgggctccagcctccatcttatttgaatgcagaaagtcaaattcaccaagatcccattccacagatttctggaaattatcagtgaatcttggaagttctacaaatctgctctggtcatcccttctttcctaaactgaccctctagtcctagattactgcttcactcttcccacggacaattgtcacccacctgcccctaccccctcaggactactgacctcaaggtgctgctctttctagttctgccttgtgctgctttggggcacagacccttcctacagccttccacagtgggaattaaaggaaagagaagtctgtgacctaagtttaagaatcatggaggtggctcacgcctgtaatcccagcactttgggaggccgaggcgggcggatcatgaggtcaggagatcgagaccatcctggctaacacagtgaaaccccatctctactaaaaatacaaaaaattagccgggtgtggtggtgggcgcctgtagtcccagctactcgggaggctgaggcaggagaatggcgtgaacctgggaggcagagcttgcagtgagctgagattgcgccactgcactccagcctgggtgacagagtgagactccatttcaaaaaaaaaaaaaaaaaaaaaaaagagagagaatcatggaggtgcagttcaacatggagaataatgcacaacttcagacatgtggcttcactcacagcccctgactcaaatccaaaaccatcttcagggggtccctgcaggctgctttccagccatctcccagcccaccatcatctcaaaggctcaatttccttccttgcagtgaggggtgccttcaaccatgtctgccttatccaggatccaagctccaacacatataaggcacctgagagggaaagcaacttgagcctcactccaccctaagtcctgctgttctaatcttcctttctcattccttctccccaaatggttaatatggaaaaatctatttttttttttttgagacagagtctcactctgtcacccaggctggagtgcagtggcacaatcttggctcactgcaacctccgcctcctgggttcaagcgatcctcctgcctcagcccctctagtagctgggactacaggtgcatgccaccatgcccagctaatttttgtatttttagtagagacggggttttgccatgttggccaggctggtctcgagctcctgacctcaggtgatccacccgccttggtctcccaaagtgctgggattacaggcatgagccaccgcgcccggcgaaaaatctgttttcttagcgatactctacctttgcctatgaacataatggtctaatgtcaatacattctggattgttcagactcatttgcaagtcagaaaagggtctggttggtctagaactgaactaagcctagtccagtgtgtgtttgcaatcctcttcagcaagaaatgaaaaagaaagctgctagaatggaagcagtacgagtggggatgcagaggaggggtcagtgatgagaaatgcggaggattttgaacagaggcagaggctattgaacagattggataccagcagggggaagagtgaagggtgctgctgaggatcccaggtgaactgcagtgctcgtgagccaagatagaggacaggagaagcagcaggtgagcagagatacaaggtccattttgcacatgttgagtttgaggtgattgtgggatattcagtatagacctacagtgagcagttagatgtaaccattgatgactgatggacgttccaggattttgtgatatggtcgtgatgcaaggaagggatcacatctcatggtgcccagctttccggaatcttcctgctttcactttcccacttctttctggggtgtacccagatttgtcttgtcttacctcaggggtttcctcctttcctctgataccttggcatgcttgctaatgttcatgctccccatgtctcacctccctaaagaggcttgtcgaggtatttgcccaagcaaatctaatgggctccttcttttacatagcaacattccctgcaactgggctaatggtgggctcaaggggtattgtcatttagaatctcaggactttctagctgaaacaccagcctgcagtattgaaaacatgagatcaattctgaagtctgtttatttgttgtaatgcatataaaattggtcttttgaatgaatcaggctcataaagctatattgccagttcagggaatgaaccccataataatcagacacagaaagctttatttccggttcagagaatggatctgtttttcagtactgtttaatgtacatttctagttccatgttttctatttgtcaatcccaccaagttgataatggctcccacaagcccatctctgaatcttccccccgtccctgaactcattgtcctcctagaatctagagatttctgatgactcttctaatacatagagccatcctggggcttgagctctctggccaggatccctcctgcctcagctactctgctgaataccagtcactgggcaaatgcttgtctttgtttaccctgatcctcctgttcagtggccgcctcagcggtccattatgtagggcagacaagctgctgtctcggcagtgaacccattgggcctcccaacactgtgactaattgtattccctgttctctgctaccagatgcagtaaattacatttcctcccagcttcccgacctgccaatcctctgttcacgaacagcagaaccatcacctgggcaggacgggaccagcagagcggctggtaagtcctggggacctttggacgctaggatggtccaaggggcttgcatttcactgagctttattaatgagatgagtgccctgctatccttacatagggggagctcaccttcagcccagcctcagatgcagccttcacagtggccacacaaggcaggcaccggccccagatgggtaactgaggaccaaatgggaaggagttctgaggaaatcatacggcatttcacctccgacttcgggggagtctttctttggtgtttgtggtccttatatctgtgtttattctcaaagttaatctgtattctgcctccagggattttcattttcctcattggaaatatacaaattgagagagccatccatgatggaagctggatgggaaatattttcaaagcctgtggtatctttacagaatcctttgggaattgtgctatttgtatattatgaatacatatattcctaagtcttcccatttctggaattatttcttagccactgtggtatatttgggaggaaaagaagcaatttaaagcacacatgttacttgctaatgtgtctcacaattggaaattttacaaataatatatttatgagtgttgagtgtagggagaaccatgctttgctctgcttaatgcagacatgcctcagaaatcagaactggaaggatgcaagcaataaatctgtacacgaacccttatgatctacacagaaatgtgctgagggctgggggttaaatggaaaaatgaattgcccaaggttgcatggttagttacaacataggtgacttcaaatatgagtatcagattctgctttgcatattctaggtaagtgtatgtttaaaataaatcacataatggcagattttttaaagtaaaacaatcatggatgtttaagccagaggatatcttttatataggccaacctgaatatttcatgaagcaaagaatccctacttattttaatacaaaagtaaaataaaaggcaagtaagaattaacatagttgtcacgtccactggctaatttaaatatctgttgggcatctctgtaaacatcttagcagattacttttatgtacagactcacagagtcctagagatggttgggactgtaagtggtatctggtcaatccagagccagttccacatcttcctggacagtgacaggatggataaacaggaacctgcaacctgcagttatgcttcaaaggactcactggcagtcactttaacattggactctttaagtactccagggtacacttctgaggtacacttctgaggtcaacttaggtaaaatgtgtttaagagtgacaccccttccctctggttattagagacatgggtgttgatggctcctgatagttgtgggtaaacaacttctcaggtcctctgcacaagttcctgcacttcaaaggacacaggatatgatccaacatatggatcagcttatgggagggtagggacaatgtatgagaaataattttaagagacagaaaaagaatttgagcagtgtgggtagtcaaagagtttaaagttcaagagtaacacatgaatgtgattgtagtgctgtgtaagcagcaatacacattattaccacaacccagctccctttatctttgaagatcctgcaaaacatgattttaaaagccaatgcattttcaaaagtataatgtgatcagaatctttttcaaagtaattttacatatgtttctgctgattagttaagagttaatttgcgtaaatgcatctactgtgggattacatataagcagagctatggaaggaattgtatttgttacgatgaactcctttgtccaggctgtttagggaatgggatgttcagattcatgatcaattatggttaatggtgactacacagagcatgtgtggcttaccaaccaagggtactcactagaattctcctagatacagtccatcttgctttaggaatgtccttttggaaatttatataacctcagggacattttgacaaatgtcacttgtcattactgagtagtataacaaatatcctggttgtttggcgtttggaaggtttgggactctgtataaatgggaatttatttagaatcattgcttttcagaattaggagacatctattccaatcctttatccaaacattgaatccttaacatagcagccctgtgaagaggtcctcaaaccctggtcacacacctctgtgattcatgtttaatcttcctccaagtttcccattccatctctggttggttctgactattgggaaattcttcctctgatggagccatcatttgtctgccttcatcatccacccacttatccttatcctgcaccctggagctactcagagcacatctaagttctaatttcccttcaagtgtagaaagtcactgttatttcctgtttttcccagatcctcactctaaatcccctttgtgctcacagtcccagtctctccagctggtattgagatgatgagattgcctttagacaccctccgccatccctgtccctcccctctgcacgctcttcacttggttgctagtcttcttgatgtatcatgctcagagctacccaatgccttcagagctaggctgctcacccccaaaatagagcacgacgctgcagaccacatggctgactttgctggcaatgtggcctttcagcttcagttttgaaaggcctcaaagtcatttcatgtgtgccactgctcagcctcactccgtttatccatagaattgttgtttctgagtcatttcagttgaaatgttcagtctgtttcccctagctatacatatactacttcacctgttcatacatagaaggacctacagaattcttttgttttttaatctcgaaagacaaaaataagcatgagctatgcacttttctgtcctttgtagatttgctatgactattaaatttcttcttgttagattgtctctcaagaatgttgcgggtttcatggaggcactgaggaaccacagcaggaagtgggggaagggaatgatgtcatgggatttgacagggctctgacattccctcccatttcaaacacgcgcagttcctccatcctcatgtttacatattgtgtttccacatcagatttcacttgaatctaggcctcaacaagttttgaatgtagaaaaccctcttctctattgttagggtctttgtagctcatgattatggtatcctcatagcctcactttgcttctcagtttagtaccccctcaaatctgaaaaagcaatcttttattattttttatcatctcattgctaaaaatgttgcatgttggaaccaaagtcagagccctgtggcacaccattagagatctcttggccctcaataaccctaaattgacatctttggggtatgatcatgcaaccactaacaagttaattgtcttaacacccaaggcacatgtttctgtgtagtccacaggaatataagggattttgtgataatccaaatactctggatcttttcaaatgcaatttgcctattctttccagagaccttgaacagaaaagaaaatgagattaatctgcatagtttctgcttgattaacccatgctggctcttagtcatctctggtctttgaagattaactttagaatttagctagccatgatgtcaagctccttcgatgtagtttagaatcccctcattctcatttttgaaaatcagacctttgagtgtcagcttccagcacctttcctgatgttcaagattcttgagacaaattcaacaagggaactgggaccctgatcccaaagcactgagagcctttatatccctgcagtgctatgttattttccaatcttctctgctcatctgggcttcacttccctttctgccactttctttctggcactttacaggctgaaaactctccttcttgaccaaaaatagaagcaaaatcagacacaagaaattggcttgcctttattatccatcaacatcacacccttgctgacttatttttgttactactgaggtgtcttggaaaaacaattgattcacagaaatttttgatcactgttttttttggggggagttacaattttttattgatacataataattgtacatatttatggggtacatgtggtattttgatacattcacacaatgtataatgatcaaaaaagggtaatgaggatatccatcatctcaaacatttatcatttctttgtgttgggaacattcaaaaatcttctagctattttgaagtagacaataaattattgttggctttagtcaccctactctgtattgaacattagaacttattccttctatctaactatatttttgaagttggagattgtgctttcggatgagagggagaacccattctgaattaatttcctcatttttattgtcattggcatcacaatagccatttttacatttccagcccaaagataatatgtgaacacatatttatatgtataaccatttgctcgaagggataagactacccatatgtgtgttcattcaataagtcaaccatgtgcattgcttgtctatcacatgccaggtgcaatgccaactcctggatgtttctgttactgagatgaccctgaccccccatggatgacacttatgatctgcttctctcctactgtactttacgcatcactgactcgtgaaccacgcagggtgttcacagcaccataaaatatcaaatctggataactttcattgtacaaatgagaaaatgaagccccaaaatggggtgtgatctggataggaattcagatcctatctttctccctcctcccatctccctgactaatgacagcggaacatgtggtgcttatattttagatgtgggctctcagcctgttcctcctcccgtaatcacagtgagtgaaagaaagtgagctgggaaaagcctgaatcaatgattgaactttccatcctcctggaatagtcttgttttgtatgctcttggactgatgctcaaatgtattcatgtccattgctcttcccgccttgcttgtgtcggttactcttgttccctcttctctaggctccctacagcccttgcagttgctttcactctgccaaaggtgaaggcaacaggcaacacaggcatgtgtagagccagggggataagtctgaatcagaaccaaacattctctgctcctcagacccatctctctgggccctgcagagcaatcgcttctctgctcaaaactaccaccttggtttttaggtgggcaccttccccagaggcctcacactccgctccacacctgggtgttttcagaacctagagactggaattctcaacctcaacttaatgtctctactccttcagggcgtttccctattgatgaaagaattattagggagcaagaaccaagaaaaccaaatgcggaggcccaaaatcaaagtatccatgcagtcattcatctgtatccctttgaataagctagcaacattcgttcttactctctttaataaaaagagcatattaaaataaaataaaataaaataattcttaaaaacagcatattactcagctgtctcgctggcttcttggaaggagtagcaaatatgctttatatactccaatctcattgtcatcagtatatagggtttggaaatcaataattaaatacataatttaataaaaacatacttccagatttcagccagcctatcagtgaaacttccattgaattgtcttctatttcttttccttcttccccaggtccttcatccaggaaaatttccagagctttccttcaaatacttttctgtatgtccatgtatgtttcaagatttctttcagggctccccagaaagccctcacccctcaacagcactccctcctcattttttaaataagatgaacaaaggcagcaagccctttgaccctcatcattatacaaattgtagtgtacctctgacatggagaagctggagagaagacagggcaggttagagagtatgctctgtgctttgtggttagagacaaagggatgaaaagtgtgagaggccattggtataaacttttggcagcaacaggaagtagaagagtttttaaaatcttgtgcatcaaaaataagacattgcactgaaaacgtaagtcttatgttcctattggttcatatgcactctagttcatgcttttgtatattattggctgagaactgaagcaaaatataaatgcttactcataaagatgacatttaaacattcacacctcttgcatggctttctaaaaggcctagataacattctcatatatgtatccatgaaaacgaaatattgcctttgggttaagtcagagcttctcaaagtgttcgcctttgttctctttactggaggaaagagtgaatgcagaaaggaatgtagaatcacactcttaagtgtgatttgtggttcctctgaagccttatgttttatctaggaaaaaaatacatatgcattttgtgacataacatatctaagtttattttattataaaattatattaaaattcttaaaatattctatgctcatattctaggaatattggaagaatagtgtacaacatgtaaatataaataggtaaccctagtaaaaccatgtcacatgtggttcagtcccagagccatatcacatttaaagaactacagcttaaaattgcacaccaaaaaaccattaagaaggtgttctgttctttaactatttctcctgaaggatattaaaagggaccttggccgggtgcggtagctcacgcctgtaatctcagcactttgggaggctgaggagggtggatcgcttgaggtcaggagtttgagactagcctggtaaacatggtgaaaccccatctctactgaaaatacaaaaattagccaggcttggtagcatatgcctgtaaccccagctacttgggaggctgaggcaggagaatcgcttgaacccgggaggcagaggttgcagtgagacaaagtcgcaccgctgcacttcggcctgggtgacagagtaagactctgtctcaaaataataataataataaaaaataaataaaagggacctaatttatatctccactaagtaataattctcatattcacttttctttcctccacatatcacctgctctaaagcatcatttaccaccacaaaatactccttctctatgcatatttcatacagtttttactctctttcccactaaactccttctttctcatttgtgtattatgtggatatacttaacctttccagcaaagaacttttcatcatcatctctcctttcttccaggctctgattctagaacaggcaaagattaaaatgacagaaaattggaccaacaatgatcagcattctcattggtgggaagagggagagggatatctgtaaacatccccatgttaataatttgtatttttatcctatcacatatggatataaaaatagaaatattttgttccatattctgtattgatcgcaggccagtgtgtggatttgttcacagataactgaatgtttgcagaataataagatattgtacctacaaactaacaattattactttccttatttataactgtgtcccatgagtgtgttaatagtgataagatatattctaatcccaaactgctttttaaaataagtgttatatttcaagaacaggcttttggagtccatgcaaattttaaatgcctattctattcttctgatggcacattttgtgagaaatcaggaactaactgagataaatgtttatttggatacacagtcattgtgtgtgtccatgcacctctatgacaaatgctggttggcctcccattgtgtcacttgaagaaacttgagatctttatgctgaacaagtgaaactttcaaaatggatctgatgaaaaccaaacatgggattttgtttcataatctttttagttaagtgttaaccaggaacagagtgtatcttattatgcaagcagatggaacaatatcatcactgttattttttcaaacaagttcaaacattaattactgtgtgtaccatttcattggtgtcatattatacaaagtatttgttactagattacaacaaccatattagactcttgaattattagcctttgtttgagagatgtgtatattgggtacctgctatacaaatggctctaaggtaggtgctgacagggagggggcatcatggataggtgttgggcaagaaactaaccctcaaaagatcctaaaaatctatgaagctgatgaaacattcccacagataattatacaactgagtggtaattgttaagagccttcagagaagtttagaaaaagtattgagaaaattttaagagagggatgacttagagatggaaggatcaaagaaagcttatggaagaggaggcagttgaccttggcgttaatcaatgggccatatttggatatgtagaaactcaaaacaaagacatttcaggagaagggaatcttaacaaaagcagaagatatttacgtctgggatggtgttatttggttgtgctaaatggaaaaggagcactagaacatatggttgaaaagatagtttggatcttcttaacacagggaacttattcagaaagaggtagggactcaagacaatgacaagcagatgggctagatctctagaagtttggaggagcaacagaaggctatctaggcagagggacagcaggcacacagatgagcagccgtgggaggaagttgagtgtcctgggaatagtgagaagtcgttatggccacaatgtgtaaagaatgagagagcccacaagacaaggctagaaaggaagtttgcagacacatcctgaagggaactatatgccatgctggggagtttggtgtttattttctaaagacacaaggaaccaacagagggtttatgactcaagtaactgtgggcaggatggagcacaggctggcaggggtcggcaaaatttttgtataaatggccagattttaactattttagactttgtggaccatatagtctttgtcacacattaattgttttctttctcttttctctttccttcccccatcttttcctccctctctttcttcttctccttcctcttcttttttcttccttctccttccccttctcttcttcttcttcttcctcttcttttttttttttttttttttttttaaagaaacaaccctttacaagtgtaaaaccactcttagctcctctggccatacagaaacaggctcaggctgtctttggccctctggccacagtttgcagtcttctagactagagcaagaagacagaagtgttaggtaaaataaaaagcaaggctgttgtgcagagagcagaggagggcctggactaaggccttggtgacagaaatggtggtgaggagatggatgagatatatctgaagtagaatgatttactgtcagtgagtgtttggctgtaagaaagtaggaagaaaagaacaagtcaggtgtgattctcaggcctgtggcttgagagactaggtagcagtgctgctgttatttggcatggagactgtggaatagttttgatagaagaagctggagtcagtttggaagctgctgagtttgatgggttcgtggcacatccagataaagggcacctggagcctggtggctctatgggcctgatgcacagtttcttcccatccaggaagactgtgaagaaaccagtttggaagtatgaggtgtcacaagagtctataggacaggaaagagctgtccttagcaaccccagactggcagcaagagttgggatgaattagaaaggatacaagactgagagacaggggcaaggggagggggagaccaggtaggaagctcttccaacaatctagggaagaggaagtgaatgtcttacattgaccagtagcaatggaacaaaaagaagacaacagatgggaaaggtattaatggaacaaaaagaagacaacagatgggaaaggtattgtgggcagcaggacttggcactctgtgcatggaagatgaaagaggccttctgcgatcattgtcttcaaattccagtgtcctatgtgatgttacttctgtcttgttcttttcttagttcttattttaggtacctagtttagtgactgaagtactcacagggcacataatatgaatgctcccatgctttttcaattgttgaaaatattctgttgtatagtacagtggaggatagccatgacccacctatgaaaacctttgtggaaatgtagagaaaacgaaaacacttgatgaaagaggttttttcatttatttaaaattttggacctggaacacattttaaccaagggtttgtaaattgtctgtcagcctgggaagccctcagtcaaggtagtttgcatgttgccagcctccatgaaattcttcacactaagatctaaagtctcttgtgcccttattttagcagatcttccttaaatgtgtgagtgccattgagatatagcaaccgtgcatctgtcttccaagtgcattaaactgctgtgttacaatacagatataaccatctttattcacagtgcgcacctcactctaacactcaagatgcttggcagttagaatagaaagggcacaaaacctttttttttgtctgtttggcaattaaccattcactggctttttttgttgtaacatgcacttcctttctcttgttttcattcaagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttcttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatcta

SEQ ID NO: 1214 - DNA, 392215 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgttccaggggctaaaactctgtcagggctcagctaggctgccttttcttttctatgtctatagatggagacccccaagggcgcgctttggactgaggatttgaatgtggaagattggcttaaaaaaagatgcttgctgctgggctttggggaaggactaaacagaggcttggggtggggggacgactccaggaatattatgaccgaatgctcaggcatacgttggcttcatagcctggagaaccaagagaagggtgacctgaacggtggctgccatcctctctgcggaagctgtcctcctgttaagtggaaaaccaggagtcagcgactcagccagccacgcggtagaacctcctcccagaaaccgggaatgttagttttcccttctctgtttgatattgacaagggcactggcacaagccaccaccctggaggtctggggacttcatacaactgggtcctggttataatattccatgagagcctccttcttatggtgtggagtatctgaaaacctattttcagcctacaaaggagtagtcagttttggcaaagttcgtaggcactttcagaaaagtgtacccatgtgcatcttgggtttaaaaaagaactctctgagactgcctagatttgagcaatcttaacacagtgttgccaatgatccacagatgtggtatttttactggagccaccacagctggattatatatttccttcgaggatgagggaatgattactgctgccgtatgaaatagtaacaattaaaaaagaaggtccgttaacatattggcataaaagaatctccagacattcttccacctaaatacatttgtgtttttcagttcggaagttctctggaaacacatataaatttgttggagaaatagtgtgtaatgttttggaaccaaagtatattaaagcgttttccaaaacctttttggacagattcttcattgggaaaatgcacacagacccttccttttttagaagcatttgacatggtctccaaggctctgagaccctctttctcaaacgcctcaaatctgaaatgtcttggagacttcaccactgaagtgagagagatgtttgctggcaatattgaaatgccatggtttgcctattaggtaatctttgaacgtggtgctctgaactcagaaaggttgtttttttcttctttctctttccccctgtgcatgtgtattttgatggtttgtgaagttatttgtggtttctaaagttggtggcaaggcagcatggccagtgtgtcatgaacttgataagaatggtgatattgagttaatggtgccatgtagctggtgggtgttttgtgtgaactggataataggctgctttaactgttgatgcagtggctgttcccattggctgctgctgaaggcttccaacagttgtcacattttctgcctttgcacaaccagctttactggatgcctgaggaacagctgaactccatgaaaggacttgctttccaaacatggagccagtagctgctaacactggggtacccttttccaagtgcggttgagtaatcccagcagaggccaagtcgattttccaagaaagatctaggcaaatctttgggaattctcttgagcatataagaatacacacaaatactcacttgtgcctcttcagttattgaagaattgagtttgtcctgtgtatctggggagctgttgattattctcatgaatgtgcacctaatacagtctgccctccctattcatgggttccatatccacgccttcagtcaatcttggattgaaactattggaaaaaataatagatagctgagtctgtactgaacatgtacagactttttcttgtcaccattccctaaataatacagtataatcaactgtttacgtcgcatttacagtgtattaggtattataaataatctgaaaatgattaatgtatgtgggaggatgtgagtaggttatatgcaaataccatgctattttatagggacttgagcatcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggtaaatggttttatgctatgctttggtctagtgcctactcttctgaattctgcaaaccctgactctctcatcactttcctggagttctcaggggaccctgaggagatcacaagcctgcccccagaacctagcactcctgaagtctctctggagatgtgagggaagaagacaataggtcctcacatcttcacttacttgggcttctctctcagaggcagagaatcgactgggattccagtctgcagggccttgggcagtctttagtctgggtctcagctccttcatctgtagaatgggttcatgagttctacctcctgggctggttgtaaggtttagttaggatggaggtgaagcacctggcaggtagctgtcattggatggtgttgagcagagcccttagcttttgtctgtattgctgtcttgtcctgtggggggtcagaagcaacatctctgaagtggaatgtgtattaatgacttttttttttttttagacagagtctcactctgtcacccaggctggagtgctgccatgacagctcgctgcatcctgaaaccatcctcccacctcagcctccccagtagctgggattacaggcatgtgccaccatgcccagctaatttttaaattttttgtagagatggggtttcgccatgttgcccaggctggtctggaactcctgacctcatgtgatcctcccacctctgcctcccaaagcactgagtttagagacatgagccactatacttggtctgaacagctcttttttaatcccttccttcaactgactgaaagtcagggccctgcccagcatcactttctctaactgctttagacagaggcagagatatgacttgaggattcattcatccatttgttcagtaggtatttacagattgcctcctctgggaaggtattggcaacactgaaaagttggtgtccccaggtttcagctgcctgaggctgaaacctttatttcaccttttgcacataatttcttgaaggacagatgtcctgatacctaagatgcttgtcacatgaacatctgtggaatatccgcccccaccaacaaaactgaattaaatacttagaaactacagtgctttaatggaatcttccatttggatccaggaactaatcaatgagaaaagatgactcttatcctaatttctgccaaaagaagagcaagtccatctttgacaatgatctctacactcacatgctcctttcttctgtagggatactccccaaactttacatttagaacatggtaaaaagcctctgaaacagcatgagtgagaatggtaatcccagggactaataacaacaattgccatttattgaatattgttcattcagaaaggcacggtgtgaaatactttttgtttttcacctaacgttatttatagtctaatggaagaaatagaaaagcacataagcagttactatccaggagtactatgaaaatgagcatccaggaggaacatgtaaaccaatctcagagttgtgaaacaattccccaaaaagaagacattagagtaagtcctgaaaattgggtaaaataaaatataaaataacatcataaccttcccaattaccaggaggcatttgtttattcgttatttgattattatttattcaggacatttagtgtgagaaagggaaaggcaaaagcatgaagaagttaagtcagtagctaaagacacaaactcagagtgaacactgaaatgcttttcagcatgtattatctcattgaatcctaataagaagcttatgaggtaggcactacagtattactcatattttataggtgaggaggttctagaactggtctaacattaaactgatagtatcaaagccaggatttgaatgctgcccgcagcaggccattggagcctttgctttgactgctgccctgagctgccacccaagatggcggcagcgtctcgcacttttcccatgagcacactgtgcaggtggtctcagcagcctgagtgtgagccacagactgattccattgcaatgggaaagcttgagacaagccaggaggcctacctccttttgagagtctttcaagcctggattcagtgcatagaaatacccaacataaaatttaatggaacgagtaacattcccatggggaagaagctgttgtgtctcagtggaaactaaccttgtgggagggtgctgttatgtctgcacattggagaggaagatagttttctttgggcatgagtgaaaataagtaaatgttatataaattgtcttgggtgaaactcctaagagccacgtggacaaggctcaggctacaccagggaccagcatgagtatgtttatatatgtgcggaaataggaaatgctaatctaacctatgctgttctttagggaattttgtcatttaattagaacccactctgtgaagtaataaaaatgatctttgcatttgtgcagtactttataatttatgaaaaccttgtatatgctaccttcttcctgaggtgtgtagagcaaatcttatacgctttacaggtgagtattcagagctatccaagcttacacagatagaggtggaagagttgtagtaaatcccagcctctcctgactcccaattcttgtattagtccgttttcaccgtgctgataaagacatacccgagactgggtaatttataaggaaaaagaggtttaatggacttatagttccacgtggctggggaggcctcacaatcatggcagaaggtgaaaggcacatctcacatggcaacagactggaaatgagagcttgtgcagggaaactcccctttataaaaccatcagatctcgtgagactgattcactatcacaagaacagcatgggaaagacatgtccccgtgattcaattacctcctaccatgtccctcccacaacacgtgggaattcaagatgagatttgggtggggacacagcaaaaccgtatcacttgtgttagtggtacatccagccttggaagggtgctttgatacgggctgaaactgcaactaagatcctgctggactaaaatcttctggctgggaggagaggagtgagcttggatgtgtctctatggaatatgcccttgttaggatttcactttcggcctctttcattcttgaaattctcaccaaggggtcagctagtgagtttatggctttcatctgattctattctcagtcctgcatagacctgggtatacgctgttggcctaggctggctgtgccgtgggcttacagagaagtgctcattggcttttcgttggattcgcctctccatgccttttcttgcctgggagcattacagccttgagtaccaggcttggagtgtggggccagtggccaaggaggccaccaccctgcttttggtccaggccttttaggccgacctgcacagcatgggcaaaaagtccttgcaatgatttacatactatccagtccagcttcccaaggatccctcagaggggttagagactcaaacccaagccctgtagaaacaggcactgtgattcatgtggggaccatccccatccatgttccttgtggacttgtgttattggtatgcagctgtcagagaactggagaatttaagatcctggtcattcatctgttatcttatatctcagagatgcagatgacaccctgcttctaaaattccatgttaaggcctaaaaaatcatttgcgtggtatattggtgctgaggaagggttcaacttggctgagtctgtgaagctgcccactggataggtgacactttgggcccatgcagggtcattgctgtgtctgggagtgccaaggcaggccttacccagcatgcataagggtcacacacctccctgctacttatttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctatatttctttgggggctactcaatgctttggggtcactgctggcccctttgaactctccacatttcaccactgatcccatttgggaatgttgatgaacttgcttggcagtaagagttggtcattctgtggcatgaaattgactgagacagcagatggacattgatgcacagagacggtggtcccaagggctgtcattgtggtggggtagttaccagcatggattttggtgtcaggaagacctggcgcaagtcctggcctttccgttggtatctgtatgatgtcactgtaccttggtttcctcacctgtaagatggggctaatgatcatacccacttcagtgtcttgttgtgatggttcttttagaggtttcttgggaaatgctcagagacagcatgcattaagcactcacaaactttcctatttataataagcaaaccaacaaatcataacttatgcatctttaaacagaaagtgaacacaaagagtgaaaggagaattttgttagccacagcatttttgtcaaactaggaaattagataaatactaggaaatcagataaatgttgtaactcctgagttttcaatgcatgaagatagtattaataataaaaaatggattatttgtagtaagcaggagtagtaaactcaacaggtcagggggccagcatgcaatgtaaatgagggacacagattgagtcgaaagtattggtccctagagagcagatgccacctctcagttaagatgcagttaatttatgccttgtgagaacgtgggtcttatgttgttacatcaactcattttcaagagaagccagaaatctgatttttaacatgtgagatctcccacttaaaaaagaacagtattaactagtttaaaaactttaaaaagattggcagtcacaacacaattccttttgatcaagaggccgacattttgtgacctttagatatagacagagctttgaactttacaggatgctttccttatgcattgatttatttggatttcataaggatactgtgaagtaagcctatcagcacccctgagatatttcataatgttgtaatatcgggttgcattttcaccagagctttgtgagtttggtgtccagatgtttggatcattggataaatggtgcttatttgcgatatcttttgacattaaatgagcccttgcaaatcactgacattattgaaactcagaatactcacatctagataggtaattgctctctaactcaaccaaaacaaatctaaaccacatcaagtcagcaccttaatttgggaaattcctcttattagaaaagaatctttaagaacctatactcaaggtatgcaaatctgaaatgcaaacctgatatgaagcccaagcctaactcatgtcagtcaggatgtttgagttgatcctgatttattattagcctcaagtaatggacattgtagggagattctgctgggctcaggactcatagtagcagcaactgccatttgaccgatgtttttgtcatatatggtatagaacagtaattctcaaacgttagtgcattaggatcacctggagggttccttaaaacacagattgcaagagcacactcccagagtgtctaattctgtaggtctagggtgatgtggcctgagaatttgtatttctaagaagttcccagctgcaactgctattctggggaacacactttgaaaacgactggtgaagtgtaggagatcaatagtaaaggaagattatgacctgggtcctgatgtgcatcacatgcccattgtgatatgcccaggagtttgtgtggtgtgtatattctgaagaggtgaaatagaataaaaggccaaatttagtcttgattaatgagagccttaaacatagcccagtttggaagtcatgcaagccgggtgcggtggcgcactcccatagtcccagctacttgggaggctgaggtgggaagatcgcttaagcccaggagttcaaggctgcagtgagctatgatcactgccactgcactccagactgggcaagagtgacaccctgtgtaactgtgtccttctcacattacactggctaatcaagaagaggtctttgcttatctcgggaacttgctttaatctatttaaataaagtgagatatctgttggttacttgacaacaccggtttggaaggtttgcccaggattggctgggcaggttgagagagtttgcctgggattgactgactgaaactatgggctacaaaattcccttggggaggccttagaggacacctcagtgagataagaagtcatgcagtagagaagatatccagcaacaccatgacagccccattgagagaggcttgccatacatatgatggtgtatagatgaagacatcaaatagcagatcagcccatcaagcctggtggccccttctccagcctgcaggtgctaattcgcgatgtgattgcttctcacgtgggcaactccaataggatgccaggagaagcagcaactgatgttcatttacttaatgatggttaatattttatgaagccagtctgtgtatatgcaagtatgacttgttattggcatatcaaggacaagtttattcttccaaggatgtcatgcaggcttccctcacttgtctttgtaccatgcattttttgagctaacccttcatttttggaaggattctgcctcaccggatctcttgtatatcttaaaacacaaagcacagaggctgcactgtacaggatgaggcctaagagaacgtggagactgtaggggatgggccacacagcatggcggagtttgtagaggaaaggttgctcataagtgctctgggtttgggagaagaccacacagctgagatctatttctgacaggaaatgccggcaggagcagagggtggtgtggggcagtgcgtgttggagctacagtgcccttggttaattattatctcagtatttctcattagtctcttgttgaattaaaatgctcaaaaggagattattaaatacacacagaaagggagacagactgacagacacagagacaagactacaccctatttacataatgcttgaacatatattaaaaatactttggattactctttgaccctagtatcactgtttctataggatcatataagtttagctagaagaaaagaatagagaatctgtacctttcttttgcataagatcgaaggggaaagaaaagccatgtgaggcccaagataaaagccccagctgtagatgaaaaagctgtgggccagacgtcggaacacatcttcctgtccatcatttcccttgtggaagcctatttcattaccctgcaggcttttaggctctagacagctttgcaataccaaatatcttgaaggcatttgtaaaacctactcttacttttttcctggaaaaaaaaaattatactggtttacttactattctaggtgggtgggatttttcccccctctgctaaattataaccagtcatctaagtattcactttatttttaaattcagggctgaaacttaaaaccttgagggttaccaaaaaatgttattcttaagagaaaaacatgcttgaaaacttaacccctttggtggcaggcaggggattttctttgtctgtgtttgagtgctaatgtcgacaactttgaggccaataaataccaaatggggctctaggatttgggcaactgtgatagtgtgtgtgtcctgcatgtcacatgagaaagagagaggccgggatttaagaaaggtgcctcttggctgggtggcatgaactcagtcagctggctttccccaggcacctgattggccttaaacactgagtttttgtggtgtgacttgacatacatcttgggctgatatcacgtgctgtttctactggggtgggaagtgctttgaaaatgtccttgctccagtggaactgtgagacatatctaaaaagcttaaggctaatatgagtgatgctaaaaggaagtcctgcttatccaggtaagcaaaagcatactctaggatagcagtgctcctgtaacctgcatggcctatttttcttttccaggtggtatgcaggcagtcttgttcatgaacattgatgtctgagcatgtgtgttcaaaattcagtgttgttaatcaaataaaactcaccacaaaacccgaaggatatttaacaatagatgagataggtttggcggagatgggtcagaagacagaggaggtcctggaggcagcagtagaatgtactttccaatcttactggtgactagagataagacactagtagcctgtttactccccatccttatttacactggagtgagaatgatatatgtcagatcagtattggatgcgatgagggagaatgaagagaaaatattgactctgaaaaatacagacaagaggaggcaaagttgaaagtaatgtaaactgcttaatcacctgcctttctctctttccaccgtcatctctttctacttgacatgttcctgcttttgcctctggatggttctatctctcatcccctctcagcctgggtccacagagaaaagcaggaagcagcctggcatggcagtggagggagccttttccagccttcctccagcagaagtgcgccctctcccctatagggagatagggcaccccaggcttcagaaagcaagggaaagatggtacttcatcatgtagcttttcttaaggggttggagggaagggctcccagttccggagagggtccatgtgccagccaccctgctgaatgccttatgttaggggggtgagatctcagatgtgcacaggtaccaggttgacttggctgagcttttgggactgtggtagccaagagagggcagactcctgaggggacagagagtgctcaactccaactgatgggcactgtgtgggaatttgagcccagggtctcctgcttttccaagagaacctggaaatccaattttgaaggaagtctgttgatgtttaaatgctcacaacagtttaaatactgtatgggccaaaccaaacataacacagattttaacacagtgtaggctggatttgttccctgtctcaatgaccctccccctctacccccagcctgggccaccagttttccacgtctgcatgtcacaacctattttatttaattacaaaaccaatagtatgtgggaatgggggctggggggttggtacagtataaagctatgtgagttgtagatacacttatgtatgttgggcaccttggtgggatccataccctataagaaaaccatagtcttgggtcagagtcagggctgctacttaaatcagttccttatccagcatgctggatgaactcatcagttctctgtaagaagtaaaaactacaagcactctttaaaaaaaatgaaaatgaatgaagagaaaaatagacttattaaattctttaatttggaagactgggtctcgctatgttgctcaggttggtcctgaactcttgggctcaagcgatccttccacctcagcttcctaagtagctgggattataggcatgtgccattgctcccagcactaaaattgactttcttgatgtacagctctctcaatttgaacacatgcgtagatttgtgcaatcactggtatactcaggcaacagaacagttccatcacccccaaaagtctcccaggaaggctgattttaaaactctaactggaatctaagtcattctgcttggggctaccttataccctgactttgaagaccctaaaaatcagttgagggtgggagggttgaccagaacatgaaacttgggttcccagccattggtggggaactgtttcataatgagcaccctaccatacctatataacaagtttttgcttcttcctaatacataccttctgctccagcctgggtcgtcttttcactatcccctactagggttgttccatttagcaactaaatgtataggatgcccagtgattccatggggacatatttatattaaaatattatttgttgttgatctgaaattcacatttaacaggacattccatattttatctggcaagcccatcctcttcacattcatgccacattctcatgtaagttcaaaacctactttctctgtgtttcaccaaagggtgaaaatactctttgaaaatactctttgattttattacacttaatcttagccaaaggccaagaagcgattgtatgctttgattttaaatagtagcatgtttatagggagatagggcaagtgttggaaggataagagtgctttctatacacataaatggattttcaagaaatgttttgtgaccaactggttttatcctttccagagaacaagaaatgatctaatatgtgctcaaggaaggaggacaactggatttcagaaattggttcatgttacagcccctcctctaccctttttctctggcctgacctttgaataatataagtctgaaaagactaaacaaagagattgctcaaactggatgagtttaaaaataacattggaatgctagccttcagcaagccatatatcttatactgcactgagcaggacagtgccctgtggtgggtagaagatgagtcacacagtgatcacaaccagatccttcccagcctggatactttggtggagagtggtgtgatggctgatttatttgtcttgtttgtttgttgtttcatttttccattttactagtgtgatttcagaatcacaaggaggcaaggaggaaaattgattttagatagcagcttcagaatgaaaaatgagtggaaattccacttttcggtctagaccagggaccagcaaacaatagcccgtgggccaaattcagcctgcagcctcttttcataaggcctatgagcagtgcctggtttttatatttttacaaatttgaaaaaattcaaaaaaggatcttttatgactcatgagatttgtatgaaattcaaatgtcagcatccataaataaacttttaccagagcataaccatgcccattcatgtatgtgttgtctatggctaagtttgtgctataatggcagaggtgaataattaaaacagagactctatggcctgtaaagccaaaaatatttactatctgaccatttggagaaaaactttgccaacccctgctttctacatggcgtatttcaatggctgtatttgcgatgaaggctccaggagccttttatctaaagaaatcactattgcctcattgcttacagtccagaacaataaagcatctcagacatccttttcactgttttctgggcttaccatgatgagaggttttgtttaccgaagctggcatgtgagttttgccgctgtggaattttctcattatatcctttgctatctaagccaactgcatgttgttgttgttgttgttgttgttttttgaaaaccagaaaatctgatctcttagggttaacagtttggcccatctgaaataagtccatacaattaaaaacatttctttctattgacagggactgagggttgagggaaagcactgcagattttccaggtgtatttttttttttttttgctccctggattttgcctgaaccctcacttttctctttcagggaactttaagcacacttagtgaaagactaaaggtcagagagcacaccagccacattccctgagtccaagcagggagccagagaggagtggtttctggccagccttccctgttcagttacctcatggaacccttgggaccagggccttgatttacaaatagagtggccactaggtaaaagttgcccatggccagtggtagcaggatcgaccctagtgtctctgaatcattaagtacttcctttctgccctcttccatttcttactcaaaaacaccagctacaattttgagtctggtctgcctggaaatttccaaagggactttggtgccttaataaatattttcaaattgctcaaggttttggaagatagcagagccataattgtgaaatcgggttaaagaatgattgctgcagtacttgcgtcggccctgtggccatgctgaagtggacagggttgtggacactcacaattgctcactgcagatggacagcctttgcttttctggtcatacatatgcttgatcctgaaattctctagatgggctacttctgagcagctgcttggagaatgggaagccaaccctatagtgtaaggtttcttaactgaagtaccattaacactttgggatagataattttctgctgtctgtggggccgatcttttgcattataggatgttagtggcatccttggtctctatccattaaatgctagtagcacaccccactcttcattgtgacaatcaagaaggtctccagacattgccaaatatcctttggggaaaaaaataacccctttgaaaatcactgatgtagtataacataaaggttacctgaccaaatgtacttcccattcttttaccattagggatttatccctttaagtcttcactctcatcattagggattaatttctttaaatgtcaaagtcttttttattttctagaatccctcacgacaatattgatttaactaacctgcacgttgtgcacgtgtaccctaaaacttaaagtataataaaaaataaaattaaaaaaatggtaaatccttaagcttgggatggcagatggttttcagctcctatgtgaactctaactgatagaaagtgtccatctatagtgccgccgtgggaagatctttgaagctgcattttaggtgttggagaaaggacattaagacagattagagctgtcttccatgggcaagagatgagggagttggcatacacgtgtaaggaaccttcttacctaacatttctgcggagattcactatagtcaggccttaggctggtgctgtagttcagccttactgctgagccctgtgccagggcactgttcacacaaggtccctgtagccttgtgtatttgttagggcaattttccagcaggttttgaggaaagggcaccttttctagatcacagagtgccatatgggcgagcagaggtgctgtactctgttgatgggaatagaagtcagggaacaaaaagagaggggcaaagaatataacttcctgtctgtctctcctgcctgactgtaaacttcttgaggccaatgactatgtcatattcaccattatctactctccgcctgtcacaacacattttgcatagtgtcaaagcaagtttagtgacttttagcagagttcttgttctgtatcttggactccttagcagtcttgtggaacctatgggtcgcttttcagaatagtgcttaaatgcacaaaataaaatatttaggattaaaaatataaccaatgaaatttatatatagtcagcaaaatattagaaaactgtgatagataatgtgctttgattgattgatgtacagtcagcaaaatattagaaaactgtgatagataacatgggatttgattgatgtacagtcagcaaaatattagaaaagttaaagataacatgcttttttattaagtaaaatctagtggcagttctaatacttactctaattgcaaattattggtgaatgtaagtgatattttgagctgtctccaacaactgtaatgttatataaaaagtctgtgattcctactcctaataaagtcatggtatattagtccaatctcacactgctataaataacttcccctgagactgggtaatttgtaaagggaagaggtttaattgattcacagttctgcatgtctggggaggcctcaggaaacttacaatcatggtggaaggggaagcaggcacatcttacgtggcaacaggtgagagagatcatgtgtgtaggagtaactgtcaaacacttataaaaccatcagatttcatgggaacacactcactatcatgagaacagcatgggagaaactgcccccatgatccaatcacctcccaccaggttctgcccctgacacatggggattatgaggattacaattcaagatgagatgtgggtggggacacagagccaaaccatatcatataggtactaatgatctacctggggcttgtgcttacattcataactgaaggcggtgctaaatgttagctagggggtggtaaaaataacctttagctgggtaccctaaattctgtcttatccccaaacgccctgaattctcacttctttcttttgtaactgggcccctgctctgatggtttcctcctttcctttgcctgatgctacctcttttaccttcttggggttcttccccagcaaatttttctaggttctttcttctgcattcactttccatctctctcagctgggttgtgtcctttggccgctatctaagttctcactccgcttagcatgggaagggaagcttctaggcccagcttggggttaccctgagcttcagaggagagagggaggttggcacatcacagatactcactgaatgctttttgaatggaaacagttgctttgccaacttcaccttttttatcaggggctcttcttggattcttggactgtgtttgagatcagttcactcttgatatctcccctccgcatggaaagcatccacaaatttccagctagagcatgaacttgcaatttggtttgcctagatcctggaagtctacagagttagaatctttcctggttctgaactcagaagcagcagtgagcagtgggactgctgggacctttaccagcaatcacccaccacatgcaccagcttcaagcagctctgcagaagccgtccgtcaccctccccgttgcacaccttggctgtgaaccgccagggcaggggcatgtgtgggaagcaggcggcctgcagattcattattgctacaagtgaatttcataataaacaaacaaaaatgagccatctctagtttagttccctttgagcatataggccatcaggtcccaaaatgttcagagttgggttagtatctgtggctttcaccaggtaaacacatcagtgttcttcctaatttggactgttgtggcttccctagttcttttttcccctagattgttataaaggttctgtattagttttccagggctgttataataaagtgccacaaattgggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgtccaaatttccccttttcataaggacaccaatcatgttggaatagggcctaccctaatgacataagttgatgacttctgaaaggaccctgactcagaaatatcctgaggtactgggggttaggacttcaatatatctttctggggacagggtccttgcatgctgtcagatgatacctgcatctcgcagtgatggtcaagcgtaccctactctgcttctggctatggcagtagaaattgtgtcccaggggaatggctaaggggcctgtaaacaatgggtgccatatgccattaatggctcaaacctctgccttgtctacacactcatgtatcccataaccctctgtctcctgtcaaagccttttatcaggaaaggcatagaaccacatttcacgctaaggcatgagtgttaaacataccctcacctagccagttaaaaacattgggcaaagctgtaaactacatcacaggagttcaaaatgtcaacagagctgcccccagtcctgtctgtgtttttgcttaggacccagtgttgtgtcactactccccattgataataaacaaaacatgcctcatatgttcacagttatttagagtttacagaattctctccttctatcaatttgtttgtgcctgaaggagcaggaaaggtattattttctgcattttatttcagagaaaacagaagctcagctgagtaatttgttcaagatcatccaggctgtggccggagcccacatcatccatgtctctatgtcagctgtctttccactgctccaagccacctgccctgctgccctccgtttcccctccaggtcactgttgtgcggaccatgcaacccgagtctcaaagactcacggatccccttgctgtgctctaggacccagtcctagcacctcctaacctccccaagagggcaaaaagcagcctaggtctggtgagggtggccaaggccagaggattctgttagtatgcagatcaaaggaggagcatgggcaaagtgacaaggtttgtgatggagcagaacagtgtcaggaagtgatgtgaagctcagcgtggctcgtggatgttgagaagtgaggttgatgggcagggggtgctggaccacagaagaccaggtgttccaagtggggcaaagatgtggtctgtgagaggctgagagccactgaagacctgtggtttatcagagactgctgtggtggcagagtggaggcaggatgaggcagggagctgctccaggttcctgactgccggtccctgccagtgctggtacattcctcaaggcttctcagtggctttccattatttccatagaggggtcacctttagttttggggagtttatttttgagatggggtctcactctgttgcccaggctggagtgcagtggcacgaccattactcactgcagtcttgaccacctgcgctcaagtgatcctctcacttcatcctctcatgtagctgagactgtaggcatgcaacacgatgcctggttaatttttttgtattttttgtagagatggggtttcaccatgttcccaggcttgtctcgaactcctgggctcaaacagtccacctgcctcagattcccaaagtgttgggattacaggcatgaaccaccgcgtcggccaccattaggtttttaactgtttaaggcattctttttatactgaaacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactataagcttatttttagggaaagctaagaattcagtcagagccactcggattccctattgcctgccatacagaatgtgctgttggtggagagattgatgggcagaaatcctatgtttatcacctgattgttacccagcacctcccatgtgccagtataaggtttactgatttgaaaagaggatggagatcaacacaaacacacttttaaatcagaggagcatatttcaaggcatttatatttaagaactaattttagggccaaagaactaatattgtaagagcttctgtgattaggtacttaatatatactactgttatggtaagtgtttagcaaatactaccgcatttaatggaaacaataatactctgttagaggaattcttatcactgttttaacagaagaggaactgttaacttgaggaggtttaacgttagcccaagaccgggtagctgagtccagattcaaactcagatctgtctggctccaaacccatgcaaatgacccctccgggtttggcaattaaacgactcacatgttgccaccctttgttcctatgtatcactaattgatcatggaattatttcttgctcagctcagatttgacctcaggatcctttcaacacaatgctacaggtagccactgctcccaactgagcaatggtagtacttgaagtagcgtctacctgtcatcttagctttatctttctctgtatttactcaaaatagaatctttaaatctacaggggtttgttgttgtttatttctacagatgtatttgtaaccttttattgattaaacaattgtaagaaatggagtattcaatacaatttccttttatagtcactggaaactctgcgtgctttaatagaggatcctaactgccttggagggaagaatgacgtcttaggactcaaagccttgatacaggcaactggcttatgtgtcagtgtggtagtgatgagtgggagatggggaatcagcctgaagaactcaagctgtatagcagtaaaactttcaattagcccagtctggttaattacaactggatggtgagttggggttgggggatgtggtgggaaggctaaagaagcaagataacagggtagatttgggggttgcatacatacacaccttcagttgccgtgaaacatttcagctcagcagacagacctgttgtcctaaaagtatagcaccatgtggggctgtgggtccctccagggagaaaggagttccttaaaagcaaactcagacaagagaatggggaagatacccccagggatagtggtgaagggagaacctagaacccagccttgcaggaggatgaggtagaaattggtccaggaggaagtctatggacaatatctaaaactggagcatcaagaaatagtaatagaaatatgttgcttagaaaggtggattccagatgattgagctgaaatggagttggacagtcacaatgtatggaaggtagtgcaggtgcatcaccaacacagattcattcgataaaattaaaatgtttttgttttactttcaaaaaaataaatagcaaaaaagcaagctcaggccagtggtggctggtggcctgtcagcatggagcatggaccttagccacaggccagggctttaaagccaggactccaggacctgggatgggtcattctgaaagctgattatcagaatgctcaggccagagctgggccagctgcccaggtgttgatatgtgtgtgtgtgtgtgtgtgtttgtgtgtgtgtgtgaagggctgagaactgcatctactaacatactccttgtgtgatgttagggttagtgaattgacctacagtggtacttggcctgcaggaaggggataaaaatgggcatcatggtaagaagttgggccagcaagcagctctagtctcacaaagccttttcctggactaatgagagggaccatggggaggggtgatccccccaaaatcaaccagatcaagttcctgatgaatgggcaatttatgactgaccagctggacacaaaatgccattgaacaacccaaatgaacaacacttctcagtcaaaatgctgctttggagagtctgtgtatgcaaatatacctcatatattcttctcactgtgggatggagcaagaaggccctgagcgtgtttctctaaaaatgcatagcaataatcctagtcttaattttagcctcttctgggcatctgaaatggggttgctacagttaaaataatgctgtataactaacatgatattgggtattgaggtcagagcagggctggcttcatcagcacgtgatttctgtagtcacataggttccccactttgttaaatgctccatagccatattgaaattcttaataacttttggaccaggagccctgcattttcattttgccctgggccctacaaattatgtagccagcagtgggttgtcataccccagagtcccagacaccagccagacatttgctgtgttgaaattatataggggaaaaatataatttagagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggaaaaaaaaagaaacactaacacattaaaatgtacacattaactgtaagatgcattgctatttcagtaacattataatgcgagaggaaacacaatagcatatcttagaattgacgaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggccatcctgaaagtccccaccttctcccaggtagctccagagaaagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatagaagttagttgttttcccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttatttacccctaccgagttttctaaatcagtgaatcagtattttaaggaataaatcttaggcacataaaatgataggaataaaatatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgggcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagcggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaaaggaaatttcacaaaggcttttacattcgtgtaatccagatgagaaatgaagatagggggcgagcaacaaagttgaaagacccaaattgattccggaaggacttgccaagtttctataatgcctcattagctgcttatgtggcagggagacctgggaagagcaataactcttttctaggttctcaggttagggaatgagattttgacgtggccaatatgatcttatatgtccatttatgtcttttaccttatcattttcttttaccttatcatggacagagtggccccccagaagcacaggatgcaagacaacacacatttcagtggctgctccttctgcatacatcattgagctctgccaagggtttgaacacacacacacgtaaataaaggcctaattatgtgtgtgtgtgtatgtgtgtgtgtgtgtgtgtgtgtgtgtgtattatatgtattaagctctttttcctttctccatagcactgcatatacaaagatcagccaccctgagttgaaataaactgtcatgatctgtttggcattgtgagatcaccactcatcataaaataagctttttaaaatgttaaaattgaagtgagagcatgagcacaaagaaacaaggaccagaaggtgtttataatcatgaaaaattgggaacaattcaataggaaaacaggaaaatggttaaatatgatatgttcggagtatggaatatgatgcagcagttacaagtagtaaaatagatcagtatgtactgacatgaagaaaatagacttacacataccttatgtaaaggaggtgaggaaaaggaacaatggtcttttctgtattattagaatttgaatatcaaaattggattcatatattacttatataattaaaaaattaagttagtcagacttagaactctttgaaatctaatttttgaaagttaatttatgccatctggaggcaaacatgccaatgtgattgaagtttcagtggtaacctgaatcctcagtctcgttgcacatttactctgaagacattctcaaaagagaattggagaggaaatccacccagtgtgtcccctcatgtatgtctgtctgggatgctccagtggtgagatgccgtcacctcagtccattgtgttagtttattgcaatgttctagggttcagtctcagccccattcctgccaactgttagcttaaggcccttgggcaaaggagataaaattgttcagggccaacagatctcagagtttcttggaaccttaaaaggagatgacccaaacatttcttattcaagatgccaccagctccagtcactcacagtgacttgccacaggggctggtgatgttagctgcttccttggcgtctgagttctggcttgtgagcagatcttatgcccaatacatcagaaactccatgtctccttcagttgtagtcgttgggagaatccatgggttgactggagcctaaggaaagcaccaaaaagtcactagaggcactggagtggatatgaccttttcctttgaacagcagtttgcacaacatataccggtggctttgtagatctggttttcattaccatttctgtcctggggcagccatggaagccacctggatatttcaattagtgcagcaagctggaattcatttactttagagtctactgcctgaagcttctcccagctgggcacccaactacgcccaggaacttctagatataacacagcatcctgatttcagtctaataagtagatctattttagtcttctcaatttccagtcattttgaaagtgctcccctgtccccataccaggcatgggttccattcccaacttctatcactgtcagtggaggtggcagccttgtgagctgccaggtgggaccaggtgcaacccacagcaaggccacttgatgtctcagtctgtagagtaggtgcttaataattgtctttgacgagttaatgggtgcagcacaccaacatggcgcatgtatacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactatagagcctttgtaactgagctactggggtctacctcatttcagaatccctcagagtccatggtgtatccattcatgcattcattgagcaaatattatgtacctgttctgtgttagagaatatttgaagtggtgggaatatagtggtgagaaaggcatgtttctgccttcaagacatcaccatatgaaagatactctgggatggatggagggtgttaatagaaccccagcaaattgacaaggtggctccccctgtgtcctctggctagtaagggactggtggctccatgaaacagggagctgccctgtgctgcccaaggctccagccctgcttcctcctcatctcccccctggacgtgactctgcctcatggggagcccattctcttagggatctttgtaaactgatcttcttgtgtcaaaaacatcaaatgcctcagattccattgcttataataagcactttgggaccaaaggaattttttgtaatgaaaaaaacagtttttcataagttaatgtttttcctttgagacctggatgcccttctcttattcatccactgcccatgcagctaatcagatttgaagggtaaaataataccagacttatcattgcatgttacatgagaaatgtattagttaggagtctggggttctaaggcatagagacagcatgagctagctcaaggaaaaaggggagggaattgttataagggcacaggggtgccccacagaatcgaaaacagaaatgtgactaggcctaaggaaagcgtcaaaaagtcactagattttttttctctctttcatctctcttcccatcttccccatccatctatccatccatccatccatccatccatccatccatccatctatccatccatctctctttccttctctccttcccagctcctgcctctgtatttcttcctccttttttcttccaactttcatttcaggttcaaggggtatatgtgtgcatttcttatatgggtaaattgcatgtcacggggggttggtgtacagattactttgtcacccaggtaataagcatagtacctgaaggtactttttggacctcacccttttcccaccttctaccctcaagtaagccctggtgtctgttgttcccttctttttgtccatggtatactcagtgtttagctcccacttataaatgagaacatgttgtgttggtttttggttcctgtgttagttcacttaggacaacagcctccagctctatctatgttgctgcaaaggacatgatctcattattttttatggctgtgttgtattccacggtgtatatgtaccacattgatgtccaccattgatgggcatttgggttgattccatgtctttgctgttgtgaacagtgctgtgatgaacatatgtgtgcatgtgtctttatggtagaatgatgtatattcctttgggtagatacccagaaatgggattgctgggtcgaatggtagctctgttttaagttctttgagaaatctccaaactgcttgccatagtccgcctctgtatttcttcctccacctagcttcctctgctttctggtccatgaggtcaatcaaatagggttgccccatagtgtctaagttttcatgtcaccagcccagccacatcagagagactctcgtcagatcagctatggccagaggtcatattgttccatagtggttcctggatgcagattaacttccagcgaaaagggacacattttgagcaggacagacatggccaaagctatctaatatgcccaagtctacacacacagacacatgcccaaatccctctcatggctacacatccaaccagagatggtcaaatggaccctgccctgaacccacatgggaggatatggttctgacttgagctgcaggatcccagggcttgtgttgaggtgggaacagccctggacctgagccagaatactggggctccagtcatggcttcaccattaaacaactctagagtcttaaacaagttcttagcctgtctgagtctttattttctgtataaactgggagtcacagaggcagctttcaattatttaaaggaccactttatgggagggggataggtgtgttacctgtctagtgttggaaggtgaaaccacagtggagaccacagagtggcaatttgtggctggagatacagaagaaccttctcccaatcaggctgccccaccatgttcaacctgcctgccttgcagagagttggctctccctgttactgtgggaaatccaaggggtctcagaaaacatctacagaatggagatactggcccatttcctagcaggattatctgtgtttgtctgggggtgaggggagtaaatagaagtttgagtgctacatacaaatgtgtattttttgcattgtaatcttaacaaacagaaagaagtattttgctccagtttgtatattctttcaaagcctttgaaccacactttatttttttagacaggatctcactctggcgcccaggctggggtgcggtgttgtgatcatggctcactacagcctcaacctcccccagctcaggtgatcctcctgcctcagactcccaagtatctgggactacaggcacataccactatgcctggctgatttttgtatttttgtagagacagggtctcactgtgttgcccaggctggtctcaaactcctaggctcaagtgatcctcccatctctgcctcccaaagccctaggattacaggtgtgagccactgtgcccagctgaagcacactttttagtgtgtctgccacaagggtttccaaggccactagctggcagaaggataaggtggaaatgtaaatgacatgcccctctcttcatgaaaacaatgtcagttgttcctctcagtccccaccataacagtttctgaaattctttctcacctccttcacttatttatcctttctgctccctgctagactgctaggggtggggacaggagtgatgtctgatcaccactgcctctgtgaccataacctctgatactgtcatttcttctttccaaagtcttggctatcatttgaggagctgagacaataggatagttctgctttcacagagcatattagcaaataccctgtgtgaggccctaatgacatatttggccctttccatctttggggctgtaatattccctacagatggaccctttggttaagtctccttatgttgcttttagttttcatcaatctctggttggtttttagaactactaaatggagccattaggtcattcaaaaacaggcagatgtatgtatgtttgtgagccatgatagggatccagaaatatttacataattttcatctattaagagatttaacagctgtgtctgccatgtagttactttaaaatataaaatgcaaggtcagatctcttggggatactgttttgtttttcttttcttatgattgctgttaacgatgtcatgtttaagtaaggaaagaaggttttgatattcctctaagagttaccagcctgtggaggagttgtgctccaagaggatcgaaggcttagaattcaaatgtaaaagtgtttaccttcttaggccagtcatctgatcaacacgtaatgtagctgaattagtacacatttccaaagaatttacgaaacaagacaccttgcaaaactagcagtcaaataaaacagaactctaaaattgaatttaaagtacagttttgtctggctagccatatgtagaaagctgaaactggatcccctccttacaccttatacaaaaattaattcaagatggattaaagacttaaatgttagacctaaaaccataaaaaccctagaagaaaacctaggcaatatctcattcaggacataggcatgggcaaggacttcatgtctaaaacaccaaaagcaatggcaacaaaagccaaaattgacaaatgggatctaattaaactaaagagcttctgcacagcaaaagaaactactatcagagtgaacaggcagcttacagaatgggagaaaatttttgcagcctactcatctgacgaagggctaatatccagaatctacaaagaactcaaacaaatttacaagaaaataacaaacaacccaatcaacaagtgggcgaaggatatgaacagacacttctcaaaagaagacatttatgctgccaaaagacacatgaaaaaatgctcatcatcactggccatcagagaaatgcaaatcaaaaccacaatgagataccatctcacaccagttagaatggcagtcattaaaaagtcagggaacaacaggtgctggagaggatgtgaagaaataggaacacttttacactgttggtgggactgtaaattagttcaaccattgtggaagacagtgtggcgattcctcagggatctagaactagaaataccatttgacccagccatcccattactgggtatatacacaaaggtttataaatcatgctgctataaagacacatgcacacgtatgtttattgtgacactattcacaataggaaagacttggaaccaacccaaatgtccaacaatgatagactggattaagaaaatgtggcacatatgcacaatggaatactatgcagccataaaaaaggatgggttcatgtcctttgtagggacatggatgaagctggaagccatcattctcagcaaactatcgcaaggacaaaaaaccaaacaccacatgttctcactcataggtgggaattgaacaatgagaacacagggacacaggaaggggaacatcacacaccggggcctgttgtgggggtgggggtaggggggagggatagcattaggagatatacctaatgtaaatgatgagttactgggtgcagcacaccaacatggcacatgtatacatatgtaacaaacctgcacgttgtgcacatgtaccctaaaacttaaagtataataaaaataaataaataaataaataaaatacagttttgttttgtatcatgaatattgttgctacttgggaaaaacatgtttaatcaggcactaaaggggcagctgaagtgtttgatggtgattctcaaagggattcttggacccctcaagagttttagaagatagtgatgctagtattttattatgtataattatactgtaaaatacatttttgatacattataattacttctgtttatgacttaggtagtttttgccttgcaaaagggagatagggaaagaaagtttacttaaataattggaagcaaagggggaatgaggagaaagctaatgaagatgtgaatatttgtgaggaaaattgcctgtaagtgtgaatagggtgtgaatggagagtggatgtgtctggcagcacctcttcttattcttatcatcttactggggtgattgaagttgcaaacacatggcccttcacttcttttgtaaacggacataattgatccaacacagcatgattgctttctagtgcagcaattttcagaatactgccttctcaaagatatggttctcctgattgattatgaaatgagataaaaatataagtccttggtttaataagtgatgaacaagcccataaaatactaggtttttacttttgctagagtaatctactaagtgagttattaagggcctttctgaactcaagttagtgtgtcaccatagactctaattagtctgaggactctaattagttctgctaaaaagtctcactgctattcggtgacaaagctcctataatgtggcatgcatgtaggcagttgtagtttccaaaaaagaaagaagtaggtggagcataggatgctcaaagtagacaatgatcaaagacttttgagagtcatcagtctaggaaagttattctcaaccctggctgggtatcagaattgtctgtagtgcttctaagaattatgagttatggccagacgcggtggctcatgactgtaatcccagcactttgggaggccaaggcgggtggattacaaggagtttgagagcagcctccccaatatggtgaaaccccttccctactcaaaatacaaaaattagccaggcatggtggggtatgcctgtagtcccagctactcaggaggctgaggcagaaaaatcgcttgaacctgggaggcagaggttgcagtgagccgggatcgcaccactgcactccagcctgggcgacagagtgagactccgtctaaaaaaagaaaaaaaattatgagttgctggactgcatgatgatctactgaatgagaatccattctccccccagtaaacttttcctttatctcctttatctcattggcaggcactcattcacaggtccactcaagacagtcacggacaaaaggaaacaggattgtgaggatttagccccatggggctagagcactgctactgaaaaaaaaccaccctaactatatttgcagctttacggtgtgtaaaacttcagtttaaaaacaaaagggaaaaaaggtctctgccttcaaagattataagctattcattcaaaaagaccaaacattgtaagaaataactggataattaatccataaagggcaagagaagtagagccagcttttattgagtacctgcctacctgtgtgctgtgtgctgtgtgctgggtgagtactttatatatgtcacttcctttaatcctcattttaatcttcagaggtcagtagtgtcactggcattctacagattaaaatactgtagttgagggaatttaggggatttgaattgcatttcctctctagaatggggtgagacagaagtggtgtccttctttcaggcatctaggtttgtttctttggggtgtgtatgtgtgtatgtttccatgtgtgtggcagcttaccaggctatgtcccaattaataaggagatgtatcatcctcattccagtttttcaaatgtgacttgaccaaaatgcattctattcctattctttgagtttatatgccagaaatggagtgggcatgtgtgtcttctcaggactaatccatgcatgaagctctttgaatcagcacaatattgtacagcctagttgcgttctgttcatcaagcatcggtcgatgatttattgacaatgcaaacaagtggtctgttcatgtgagttcatgatgatttgtgagtgcttcctgcccatctgctctctcattttaagtgtgctctgtaatataaaaatgatagtcatacaataattctattggggtagatctgtaccactacccagagatatttgtttgacttttactattattttacaaaatgggaatttctttcacaaagaagatgagttcattgtactttggctttttgtaagagaaagtgaatgttgtgacactgacatgaataaatgaattcatgttttctgatcccgtggaaaggaaagaatagaataatatcagcacgtggatctcataatgaaaggggagtaaagtgagtcttcagaaacagacttaaaataagctcaattcattgtaattagaaaatggatcttgaaagggccttgccaaaaggcgatgatgtgatgttggggtgtagaagttttttgacagtggactcttttatcacagaatgtgaggtgaggcagaggaaatatgattcatgttatagtgctttagttattgattacataggagtttgctttctccagctcttgttcatagctgctaactggcatacagaggaaatattgtttacttatttaaataatttttaagatagtgaaaattctgtatgtttggttaaattatacttggttgtttgcataggctgtctctccctgagacgctcacctcacttctctatgggtcagcgaaacacataccctgtgtaatcacctcccctataaaaccccatggcaacctcttccaacaattcatcctttgcattccatccaagtatgtcttgttatatccatagcatttagtgcatttattatttcctctcctgctttcctctactagattttgagagccttaaggactagagagtgactgattcatccttgtttccccagcaccctggagcaaagagcccagcacatagtagttgcttgtggtgaatgtaattcagggtgtcttaggactatcctgctcattatgaatagaggataaaaacagatttctaagttctccatctgccataaaattctgggaagaaaaaatatgaagtattcctttctgcacacacagaagtcttccattttgcaattttctatctagtctgctgtcctttctctctcttctttatcagggctacacatcctctctcctggccagagcgtcatttgaggcgtgcttatgcagttctcattgtcttcaattaaggtttgggactgagattaccagcttggcttggtaaccctgttcacttattaaaaaatcagtcgatccttcatttttatgaaaagatgcaatgcaaaataaccttgatttagaatttaatgaggctgacatttaacctgagttcagttaggaagacaaacaaaaaacacagacaaagttgagagaaggaaaataattacctacttgaatagtgtgggcaattctccatccatatgccccaggagaatatgaggtgggagatgcatgaattacctgaaatttcttttagcctctgtttatgattttagtctttcaagatgcaggtatgtttttcaggccttgtggtccccaaacacaaggaaactttctttatctgatggtcaaaagaagtgacgacctagtccttagtaggagaaaaatgtgcctgcatggactctttgtgagacagtgttgttggatactttatgaacattttaagggattctcatgagtaattttgattatagacgatttttactttatgcattgactaggaaccaaatgcaactttcttagagagacacaaaattcattgtccaaatagaccatagggtcagcaggctttgtaaacatgttttgtatgtgcctaggggttgagagcaggggcgggagaggttctggtccgttcatcaaaccaggggctggtgttaatgtttgatcaacaaaacacatgtaggcctaggctctgatctaggtccaactgccaacatagccttttcatgcctgcctttcctacttcaggtagagagaggagaaaaaacctattgaggaaaaaagaaagaataatattagcccaagcagtggttctactcacttaaggagaatggagtatgtttatttaattttaactgaaaagtcctggccaatatttctaagcctggcttgggataacagaatgaatggccttgggggagagggaggagaaagaagatgactgattttagtgtctgctttatggtgtgtgctgtttaatcctcatgacaatcctaagtggaaggaagaactccccatgttaccagtgacgcagcggaagcccaggtgctactgaaggtcacgcagtcagcattgacgaagtctacactagaatccaggcctgacacaacccaaagtctgtattttttccctctgcagtctcttaaaattggcaaaaggtaaaccttcatgcgaccctagatttgattggaacagcagatttaggggtcatgcaacaggagaatgagtggattataagtttttgagtccccagatctttggggagaaaacccaattctgttgaagtaggagctgttcaattggaggtgagatttttagtagggatttctaatgcattcttttttcccattgatggttgttaatacttcccctacacacacacacacacacacacacacacacacacacacacaagcataaatagggcacacgtattctcccatgtaagggctgctgtcccttctccctcccacttatagcgatgtgtgcctctctgtagctgaaggttgccttgtattaggacactgactgatgagtactccccaccagggtccggagagtgtgcttcattcacctttcagcctctcacagttctggcacaggggagataaagatgttgatggtttgaggtgctttttggtaaataacataggcaaacacttgacacccctaggctaccacctgtcctgttgtgtggatacctattcagtgaagccagataacttttacaaatcacaatgaatacatcctcagcagagccagttgcctgagggaggttactgaatcttctgggagtcgtttgcaggcctttagacactgggctcctttctggaccatgcccaaactagtgacagatgcagtcagagtagcagaataaggaagtctaaagtcacccaagcctcttagttcttgataattgacatgtccagcatttcttgaccatcagtagaaaatactaaactttacagtacataaaataatcaattcattcctctgatggggcaactatttaagtcagtatggaactctatctttctgattgctgcattagtccctttttttttgtttattttgcttcttagtagaaaagaaaaatctaaaagattctcattttaagtgacttgagctatcagttaaattttaaaagccaattattttgaagcagtagagccttacgaattctaaagtcacacactggaagccaaactatctagagtataaatatttccttttgagggggatactgacagattcttctattttatcccaattccagttcctgacctccactcacagacagggaggcaaggggaaggctcactaattggcaaggctggacaagcataaaggattcagtgcataaagaatcaagcttctgatcctctcaagaggtcacacgcagagtgtctatgtgctggacagctttggctgtacacaccagaagtgttccaggcgtaaggtttttggcaagtctcgttgcctacgttcaagtcctctctgagtcgcttactagtgtgtaaacatagctgagatatataatgtttctaagcctcagtttcactgtctgtaaaatggcaatgacaataactgtacccacctcacaaggatgctgtgttgtgaggtgtgaacgagccatttgtgtcagaacatagcacagtgctgggctcacactaagcattccattcatgtcagctactagctctttggaacttttcaactttggtccctagggctacattaaccctctttcctgccagacaataatctgaggttggttgctgctttcagaagaaacagtgtttgaaagctaagaaaaatgtacctagaaatctaatttctaatttcattgtcatgccttaacagaacacccagatgccttaaaagacttttacaaaatgcaaatttctgatccagaaaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcgtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttttaagatgtagttctctggctaggcacagtggctcacacctgtaatcccagcactttgggaggccgaggcaggtggatcacgaggtcaggagtttgagaccagcctgaccaacatggtgaaaccctgtctctactaaaaatacaaaaattatctgggtgtggtggcacacacctgtaatctcagctactcaggaggctgaggcaggagaattgcttgaacctgggaggcggaagttgcagtaagccgggatcacgccactgcactccagcctgggcgacagagtgagcctctttctcaaaaacaaaaaagaaaaaataaaacatgaagttcccaaccatgtgctgtgtagtgagcaccatggtggccctgcagtgtacaaaggtgaattggccatggtgtgtgttggcatggagctcccagtccagctaagaatacccttcagggccaagctgactccaccctgtttcctgaggcccagtcagcggtcccagcttctggtctgtgggctcacctagtttaaagacccccttgagcctcaaaggatgttcgaagcatgattcagttggggagttattggtcaacatggtgggacaattcttcactgtgtgggactgccctaaacagtacagggtacttagcatgtctgccctcccaatgctgagtaccagtggtgctccacagtcactgtgacaatcaagaaaagtaatgattgccacatgtttctgaatacccctgacctctggggaataatactgccccaagttgagagcctctgtccggtttaggtctttctcctcagtccatacctctgctacctccttaagggaccagttccctccaaggggcatgctttcttagaaaagtcatttgatggccgggcacagtggctcacgcctataaacccaggacttcgggaggccaaggcgggcagatcacctgaggtcagaagttcgagaccagtctgaccaacatggtgaaaccccgtctctactaaaaaaataaaaattagcaggacatagtggcatgcacctgtaatctcagctacttggcaggctgaaacacaggaatcgcttgaacctgggaggtggatgttgcagtgagccaagatcacaccactgcattccagcctgggtgacagagcgagactccatttcaaacaaaacaaaacaaaacagaaaagaatgtcatttgacagtgtacaaagtttatatattttaacatacaaatgaagttgacatggtatcaaccaaagggaaagaagggccattttgtaacaggcagaaaccagttgggatttaagaagcattttaattacccttactttttttctataaaggaaaatacttttatttctttcactgatgtgccggtgagagtcttagcaggcttgcctttgtaggtaaatatgatggcacttcccaatcatcatgtattgggatgtgaagttgtgtggagtctgaggctgacccctggtagtgtgaggaccttgggggattgccttggaaaatacagggtccagcccaaggctctggctttcagggtcgggggttgagatgaatttgtcacagctccgcctgagctcaccacactgggaagtcaaacagaggcaacagcttctgtttgctaagtgttaccacatgctaggcactgtgttgagtatggtgaaggacctcttaaatcttcagaacaaccgacgtttcagcattttacagctgcaaaaactgagtcttagcaaacatggtcttagagccacgagaatggacctgggacttaaatcccaagtctagagcctggacttgaccacagcagcatccagcttctcacccatctttcgctcaattcatccctttaatcatttattttaggattcagtttgattcccccaatctcaaaactttcaaggatgaacaatacttctcacacaaacacaccttctaccgaatgccaggaggggtctgcacttagattcctcagctgtcacagtgccattgagtctgaggctgcctgactgcttggttgtggttttttgacacctggcatttgtgtttaacagccccagtggttgagaagcagaggggacccacactggcagaggtggagggaaagaggagagggtgtagggaaagaggagagggtgtagggaaagaggggagggtgtagggaaagaggagagggtttagggaaagaggagagggtgtaagggaagaggagagggtggagaggtagaggggagggtgggggaaagaggggagggtggagagatggagaggagggtggagggatagaggaaagggtggagggatagaggggaaggtggagggaaagaagagagggtgggggcggttccaagatggccgaataggaacagctccagtctacagctcccagcgtgagcaacacagaagatgggtgatttctgcatttccaactgaggtactgggttcatctcattggggcttgtcggacagtgggtgcaggacagggggtgcagcacattgagcattagccaaagcagggcgaggcatcgcctcacccaggaagcgcaaggggtcagggaattccctttcctagccaagggaatctgtgacagacagcacctggaaaatcgggtcactcccaccctaatactacgcttttccaatggtcttagcaaaaggcacaccaggagattatatcctgcgcctggctcagagggtaccacgcccatggagccttgctcattgctagcacagcagtctgagatcaaactgcaaggcagcagcaaggcttggtgaggggtgcctgccattgctgaggcttgagtaggtaaacaaagtggccgggaagctcgaactgggtggagcccaccgcagctcaaggaggcctgcctgcctcagtagactccatctctgggggcagggcatagctgaacaaaaggcagcagaaacctctgcagacttaaatgtccctgtctgacagctttgaagagagtagtggttctcccagcatggagtttgagatctgagaacggtcagtctgcctcctcaagtgggtccctgatccccgagtagcctaactgggaggcatcccccagtaggggcagactgacacctcacatggccggatacccctctgagatgaagcttccagaggaatgatcaggcagcaacatttgctgttcagcagtattcactgttctgcagcctcggctgctgatacccaggcaaacagggtctggaatggacctccagcaaactccaacagacctgcagctgagggtcctgactgttaaaaggaaaactaacaaacagaaaggacatcgacaccaaaaccacatctgtacgtcaccatcatcaaagaccagaggtagataaaaccacaaagatggggaaaaaacagagcagaaaacctgaaaattctaaaaatcagagtgcccctcctccaccaaaggaatgcagctccttgccagcaatggaacaaagctggacagagaatgactttgatgagttgagagaagaaggcttcagatgatcaaacttctccgagctaaaggaggaagttcaaacccatcgcaaagaagctaaaacccttgaaaaaagattagacaaatggctaactagaataaccagtgtagagaagtccttaaatgacctgatggagctgaaaaccatggcatgagaactacgtggcgaatgcccaagcctcagtagctgattcgatcaactggaagaaagggtatcagtgatggaagatcgaatgaatgaaatgaagtgagaagagaagtttagagaaaaaagagtaaaaagaaatgaacaaagcctccaaggaatgtgcgactatgtgaaaaaaacaaatctacatctgattggtgtacctgaaagtgacggggagaatggaaccaaattggaaaacactctgcaggatattatccaggagaacttccccaacatagcaatgcaggccaacattcaaattcaggaaatacagagaacgccacaaagatactcctcgagaagagcaactccaagacacataattgtcagattcaccaaagttgaaatgaaggaaaaaatgttaagggcagccagagaaaaggtcaggttacccacaaagggaagcccatcagactaacagtggatctctctgcagaaactctacaagccagaagagagtgggggccaatattcaacattcttaaagaaaagaattttcaatgcagaatttcatatccagccaaactaagcttcattagtgaaggagaaataaaatcctttacagagaagcaaatgatgagagattttgtcaccaccaggcctgccctaaaagagctcctgaaggaagcactaaacatggaaaggaagaaccagtaccagccactgcaaaaacatgccaaattgtaaagaccatcgaggctagaaagaaactgcatcaactaacgagcaaaataaccagctaacatcataatgacaggatcaaattcacacatcataatattaaccttaaatgtaaatgggctaaatgctccaagtaaaagacacagactggcaaattagataaagagtcaagacctatcagtgtgctgtattcaggagacccatctcatatgcagagacacacataggctcaaaataaagggatgggggaagatctaccaaggaaatggaaaacaaaaaaaggcaggggttgcaatcctagcctctgataaaacagactttaaaccaacaaaaatcaaaagagacaaagaaggccattacataatggtaaagggatcaattcaacaagaagagctaactatcctaaatatatatgcacccaatacaggagcacccagattcataaaacaagtccttagagacctacgaagagacttagactcccacacaataataatgggagactttaacaccccactatcaacattagacagataacgagacagaaagttagcaaggatatccaggacttgaactcagctctgcaccaagcggacctaatagacatctacagaactctccaccccaaatcaacagaatataattattctcagcaccacatcacacttatttcaaacttgaccacttggttggaagtaaagcactcctcagcaaatgtaaaagaatagaaattataacaaactgtctctcagaccacagtgcaatcaaactagaactcaagattaagaaactcactcaaaactgcacaactacatggaaactgaacaacctgctcctgaatgactactgggtacataatgaaatgaaggcagaagtaaagatgttctttgaaaccaatgagaacaaagacacaacataccagaatctccgggacatatttaaagcagtgtgtagagggaaatttatagcactaaatgcccacaagagaaagcaggaaagatctcaaattgacaccctaacatcacaattaaaagaactagagaagcaagagcaaacacattcaaaagctagcagaaggcaagaaataactaagatcagagcagaactgaaggaaatggagacataaaaaacccttcaaaaaatcaatgaatccaggagctggttttttgaaaagatcaacaaaattgatagaccactagcaagactaataaagaagaaaagagagaagaatcaaatagacgcaacaaaattgataaaggggatgtcaccaccaatcccacagaaatacaaactaccatcagagaatactataaacacctctacacaaataaactagaaaatctagaagaaatggataaattcctaggcacatacacccttgcaagacacatacacccttccaggaagaagttgaatccctgaatagaccaataacaggctctgaaattaaggcaataattaatagcctaccaaccaaaaaaagtccaggaccagacggattcacagccaaattctaccagtggtacaaggaggagctggtaccattccttctgaaacgattccaatgaataggaaaagagggaatccttcctaactcattttatgaggccagcatcatcctgataccaaagcttggcagagacacaacaaaaaaagagaattttagaccaatatccctgatgaacatcgatgcaaaaatcctcaataaaataccggcaaactgaatccagcagcatatcaaaaagcttatccaccatgatcaagtgggcttcatccctgggattcaaggctggttcaacatatgtaaatcaataaacgtaatccagcatataaacagaaccaaagacaaaaaccacatgattatctcaatagatgcagaaaaggcctttgacaaaattcaacagcccttcatgcgaaaaacactaaataaattagatattgatgggacgtatctcaaaataataagggctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaataaagggtattcaattaggaaaagaggaagtcaaattgtccctgtttgcagatgacatgattgtacatttagaaaaccccaaatctccttaagctgataagcaacttcagcaaagtctcaggatacaaaatcagtgtgcaaaattcacaagcattcttatacaccaataacagagagccaaatcatgagtgaactcccattcacaattgcttcaaagagaataaaatacctaagaatccaacttacaagggatgtgaaggacctcttcaaggagagctacaaaccactgctcaacgaaatagaagaggacacaaacaaatggaagaatattccatgctcatggataggaaaaatcaatatcgtgaaaatggtcatactacccaaagtaatttatagattcaatgccatccccatcaagctaccaatgactttcttcatagaattggaaaaaactattttaaagttcatatggaaccaaaaaagagcccgcattgccaagtcaatcttaagccaaaagaacaaaggtggaggcatcacgctacctgacttcaaactatactacaaggctatagtaaccaaaacagcaatggtactggtaccaaaacagagatatagaccaatggaacagaacagagccctcagaaataataccacacatatgcaaccatctgatctttgacaaacctgacaaaaacaagaaatggggaaaggattccctatttaataaatgatgctgggaaaactggctagccatatgtagaaagctgaaactggatcccttccttacaccttatacaaaaattaattcaagatggattaaagacgtaaatggtagacctaaaaccataaaaaaccctagaagaaaacctaggcagtaccattcagcacataggcatgggcaaggacttcatgtctaaaacaccaaaagcaatggcaacagaagccaaaattgacaaatgggatctaattaaactcaagagcttctgcacagcaaaagaaactaccatcagagtgaacaggcaacctacagaatgggagaacatttttgcaatctgctcatctgacaaagggctaatatccagaatctacaaagaactcaaataaatttacaagaaaaaaacaaacaacccaatcaacacgtgggcaaaggatatgaacagacacttctcaaaagaagacatttatgcagccaaaagacacatgaaaaaatgctcatcatcactggccatcagagaaatgcagatcaaaaccacaatgagataccatctcataccagttagaatggcgatcattaaaaagtcaggagacaacaggtgctggagaggatgtggagaaataggaacacttttacactgttggtgggatgtaaactagttcaaccattgtggaagacagtgtggcgatagctcagggatctagaactagaaataccatttgacccagccatcccattactgggtatatacccaaaggattataaattatgctgctacaaagacacatgcacaggtatgtttgttgtgacactattcacaatagcaaagacttggaaccaacccaaagtccatcaatgatagactggattaagaaaatgtggcagatatacaccatggaatactatgctgccataaaaaaggatgagttcatgtcctttttagggacatggatgaagctggaaaccatcattctcagcaaactatcgcagggacaaaaaaccaaacaccgcatgttctcactcataggtgggaattgaacaatgagaacacttggacacaggaaggggaacatcatacactggggcctgttgtggggtgggggtaggggggagggatagcattaggagatatacctaatgtaaatgatgagttaatgggtgcagcacaccaacatggcacatgtatacctatgtagcaaacctgcacgttgtgcacatgtaccctagaacttaaagtataataaaaaaaaaaaagaaaaagggtggagagatggaggggagggtggggggatggagaggagggtggagggaaagaagagagggtagggggaaagagggtagggtgggggggtggagggaaagaggagagggttgggggagagaggggagggtggggggatggaagggagggtggagggaagaggagaggatggaggggtagaggggagggtgaagggaaagaggggagggtgggggatggaggagagggtggagagaaaggagagggtgggggggtggaagggagggtggagggaaaggggagggtggaaagatagaggttagggtggagggaaagaggggagggtggggggatggaggggagggtagagagatagaggagaagttggaaggatagaggggagggtggaagggtagaggggagggtggaaggaaagaggggagggtgagggggatggaggggaagttggagggatagaggggaggtgggaaaaaaagaggcctggagctggtgttaggaggccagggtctaaaccccacttgaaaacctacctggtggatgacatgcacagactctctgggcctcagtttcccattcacatataagatggggaggcctttatccacttccctaagagggttgttgtgacaattcagagcagtgttagagtccaaagtcgggtgaatgcccctggggagtgtacaggaccatcctttatagtgtgagtagaaagtcttagcatttttattttttactcaacaagaaattaggctttacaaatatttgatgtatggatggaccatgacatccacaatcagctgcgtgttctgggcatgtcctcaaagaaagaagggactttgcaaacgggaaggggttgggagctctatcctcattcattcccttgcagcctttgtgatgtttgattgcaatttgccacttctggtgaggcgggtacgcagaatacattatccagcttaaactcaacaaaccctgtttcaacaaactgaagaagtggcttaaaaagttttcatgaattaaaagctaattaaaatctataatgaacaatatccacataaaccaaaaaatggcagagttaacacttcactgggaagaagtttttgttgtcgtcgttgttgaatcagccccagtaagatgtgaaaaaaaaaacagactaatgatatctgacaagaagtcggcccaagaagttcaaaattatcaaggtcaggtgcagtggctcatgcttgtaatcccagctctttgggaggccaaggtgggaggatcacttgaggccaggaatttgcaaccagcctgggcaatatagtgagattccatctctactaaaaatcaaacagttcggtggctcacgcctgtaatcccagcactttgggaggccaatgagggcggatcacctgaggtcgggagttcgagaccagaccgaccaacgtggagaaaccccatctctactaaaaatacaaaatttgccgggcgtggtggcgcatgcttgtaatcccagctactcaggaggctgaggcaggagactcgcttgaacccgggaggtggaggttgcggtgagccgagatcgcgccattgcactccagcctgggcaacaggaatgaaactcggtctcaaaaaaaaaaaaaaaaaaaatcgaacaattagctggatgcttgtagtctcagctactcaggaggctaaagaggatcacctgagcccaggactttggtgctgcagtgagctatgatggcactaccgcactctaacctgggccacagagtgagcccctgtctcaaaaaaaaaaaaaaaaaaaaaaagaagaagactttttgaattaaagaaagatttacatctcctctcattaatagcactattgatttttatttgatttaacacattatttcattgttattacaaattatgtgttttaaatgcctattttgatgtataattctataatgtacacttagttcagtagtacatgtgtattacttgtatttatcatgtgtgaatatatatatatacacacatggtatgtgctcaaaatattttacagattagagtatgtgaaaaaaatttgaagaccactctgcataataaatgtgcaggggctggcccatgagacatgttcagtaaatgcttgtttccatcctctttctccctggaaataaagtcgatagtgtgtgtgtggaccttgcttattaaaggaaagtggctgatttgatttctggaacaaggtgcatctcaaactagctggcagcactacctcggcctggccccatcccagctgttcacaccgagttccagacatttgtaggagcccggacgaggccagctggctgcctatcagtggccttcttctgtcagcactacacagttgtcacggctcacatccaaccgccagacagccaagaaggagacgccaagatttaaatctgcagttcctgacctccgcaaccacacccgattctttggttggtcctagacaaaaacaacggttttgcagatttgggttctctttctcaaactgccttttgatgatttatttgtgagatatgattgctcctcttgcaaatcagagctggttgcagtagctaactaacatttattgagcgagtagtatacccaggcttcagctaagtgctttctggaattatttaattttcacagcaaccatgtagagtaagttctgccactggcaccactttacagataagcgaatggagacttagaaaggttaagtaattttactagaggaacataaactaacagtgaaagtgagaaatctcagagtctcattggtctgacagctatgtaaggaactgaggggatgtaccattgcaaatcgtcaaaatggaaataccccaaatgcaatgcaggactctggatgcgattctggaacaaagaaagaacacttgtgggggaaaaaaaatagtgcaacccagagtctttatttaacagtattgtatcaatgttaatttcttagttttgacaaatgcatcctggttatgtaagatgttaggattatgggaagctgggtaatgaatagatggagagtttctgcactatgtctgtactgtttttgtaaatgtacaatgattccaaaataaaaggtgtatttaagaaacagaaatgccaagtgtatatgtgtgagtacacacgtgctctcacatgtgcatgtgtacagttgtgcatatgtaagtctttgtgcatatgtaagtgccccttgctgcacaccccctgctgttctgtgtgtgctgctccactcaagcccctgggacttacatggatgtcagcgagaaggaagcctacacaactcacatgtgacatgcccgccatgctctcgtcatacctcacctgtgctgtagaacccctgggtcacaggtggcagtcttgttcccccataacaaatgccagaaaatgatgtgtgtgtgtgtgtgtgtgtgtgtgtgcatgtgcacacacgcatgcacgcacacacgctctggtaggggggtttcaggaagtcattcgtgaagatgcagtgtagcatccagaataaaataaccaatttacaccttaaacactcttctccagtaaggccactacagctgcctctgcttactaagtgcatttgaagagtcctctgctttatccgtactctatcctcctgaaaagaggcactgacctgaaagggaagcccaggagcttctaggcccagacttttgctttgtttctcaccatgtgctgtgtcaaaactgagagaatattttgatcaccttttagctaagagctatctcctgggcagcagcttaaggctagagtaaggacatttcacagtttaagagagagcagtcactccgccaaatggctctgaggtggccacaaagtgcttgacttgcaaaaaattgctccattaactagattcagggattttcaggatttatgggctaggctgtgctaatattactgtggtgcttctcagtataattgctagaggcctccagtgagcagaggaattgtgtgttcagtctgtcctgggtgacccttactgcgtagtcctagggagacaaagaaaacccactcaatccaggaggctacagaaatgatgtttgtggagatctcagtgggtatctaatctgtaacctcagggggagaactctagctggtctcagtctttgctggaaacagaacttactggatgtgtgtgtttactcactcattcatttatttgtttatttatttactgtgacagggtcttgctatgttatccaggctattcttgaactcctgagctcaagtgatcctcccacctcatcttccaaagtagctgagattacaggtgcatgctaccacacccagccatcattcatttacttattgagtgtctaccatgcaccagatgcccaggttaagcataaaggatatagagcaggacaatcaaaaagtctcagattcagaaggaggagatggataaaaaccagcaagatctaaagtagataatttgattatgataagcacaaataagcagagaatacattgatgtgatacagagggccatgtggggggcagtgtgattcctttagattgggtgaatcagggtgatggcttttcagttgacattggaagaatgaggaggaaggaggaagaagtggcagccgggtaggacagcaggtcttctctgtcccccgagttcttctgatgtcctgcacagaaacctgaggggtagagtagcaaaggagaaatccaagctcaggctgggaaagaagctcatggcaccaaggttagggcttgtgataacagggacctgcttcaagagaaagggaggtgggtggcagattggtctcatggctgccacccacataattctaaaggtctcccaatgggagaacagccaccctggtaagtgtccagcatcatacaaggagtctctgcccattgtgactcttgcttgagcccccacacttagccctcaccaagctgtgtgatttaggattcaggtgttagaacggagaaggcaccaggcctactgcaccatatcaatgaagcctttgctttggggaaaacagagctgggtacaaataccagtgccacccattcttccctccatgctctggacattcaacccatctgagccttaatcccttcatctgcaaagtaaggaccatgcagtcttcctggtagtgttgtaaggctcagatagaataaccagacagttccaggtgcatatggcactcagtgagaatccacttgctttatcctccctcactcccttccttcctccaggaataaagagtacactagttgaagaatatttctttgccttccttctttagcagctccaatcccagcctaacagcacaatgagcatcagatgtgcttttttgatgtttgaaatttatagtctctgttgaatgttggccaggacagcacttcgtcatttgaacaatttccattttccacaagctctctgtgattgatgacctaaccaggcacatggcattccgttccaccagcaatgtggccagtggggagatggctatgtcagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacgtatagggagatctgacagatagaaggggagaaggcaatgcgatcaccactaggtagaggttagagggatgcacccctaagtcagggaatgccagcagctgccagaagcttaaagaggcaaaggatgaattgtcccctagagcctccaaagggagtgtggcactgcttatgccttggctttggacttctggcctccagaactgtgagagaataaatatctgttgttttcgatgggcgtgatggctcacgcctgtaatcccagcaccttgggaggccaaggtgggcagatcacaatgtcaggagatcgagaccatcctggcgaacacagtgaaaccccgtctctactaaaaatacaaaaaagtagctggccgtggtggcgggcgcctgtagtcccagccactcgggaggctgaggcaggagaatggcgtgaacccaggaggcagagcttgcagtgagccgagatcgcaccactgccctccagcctgggcaagagtgcaagactccatctcaaaaaaaaaaaaaaatctattgttttaagccaaccagttcgtggttatttgtgtagcagccctagaaatgaagacagcctgcgagcaccttgccccacctggctgtaggtgacttttggtgccaccatttttgactcttgtggataaagagcagactatattctttttataagtaagtccaccttttacagaaaaattaatagccaggatcatggttttagaactcatagaatacactcctctcatcctctcattctttcccccacccattggcttataaacttgttcctatgaaataagtcagctgagttgagtttgtaaatgcatcttgaataaatgtgttgggtggggtcacaaacatgcagacacctgctggtgagtgttactgacctgcactctgaaaggcccctatattgatgatacttcttaatctcctatggctcttcttcagccctgggagcaggggagtgcagacttttgttcaacccctttcacagatgtgcacactgaagtcccagtgtgtccagtgacttgctcaaggtcatcagcactgtctggtggagctgggactcgaacccagtcctcctgctctcagctgtgggaaatggagacagcagttgccctggaagatgtttcctgtgctgcgtgtttgtggttgtctcaggatttgtgagacttactgttttcttgtgtcccctgtccctgtgacttatctttgtgcccactcagccatcaccacttccaacacacacccacacctgtggagagaatgcagcctcctagagctcatgtcatggcaggactgagggaagtagtcagttcttggtgctctctaatagggctctgaattgcagcctgggccgtgcccattcatttatgtattgtctatagctgcttctgtgttacaagaattgacagagactgggtgtggtcgctcacacctgtaatcccagcactttgggaggctaagacagaaggatcgcttgagcccaggagtttgagatgaacctgggcaacatgatgataccccatctctacaaaaaaaaaaaaaaaattagttgggtgttgtgatggaggctgagatgggatgactgcctgagcccatggggtcgaggctgcaatgagctatgattgtgccactgtctcaaaaaaaaaaaaaaatgttgacagaacaagttgattcaattatagacttgagtagttgtaacggagactataaagcctaaaatatttatagtgttaactttgataggacaagtttgccagctcctgcactagaggataaagattaacaggattgactccacatagaggagaggagaggaaggggcaaggatggaagcaaggagggagaagggttagagagaaagaaagagggaggggggtcactcagagacttcacaaagtatgttatttcctaaaaactgtaatgcccagtatctagtgattacctgtggcactgtcagccttctgcctgggaacaggaatcttgcaaagatcaaatgcagggcccagagccccaggactctgcattggcattcgtcagtaagttttgaaggaggcagacatctcaaaaccatcctaagcataaggcacccagctggtgatttgaagatagccatcttccccattactagttggcctcactttaaaaaatgttgtttcttggatagcatttttctttcacaagttggtttgctttcacatgtcaaaaaacaaaaccagggctgggcgcggtagctcacacctgtaatcccagcactttgggaggcgaaggtgggtggatcatctggggtcaggggtttgacaccagcctggccaacatggtgaaactccgtctctactaaaaaaaagaaaatacaaaaattagccaggcatggtggcgtgcacctgtaatcccagctactcaggaggctgaggcaggagaatcacttgaacccgggaggcgaaggttgcagtgaaccaagattgtgccattgcactccagcctgggcaacaagtgtgaaactctgtctcaaaaaacaaaaaacaaaaagcaaaaacaaataaacggaaagagagagagaggagagagagagagaaacacataccatttgccatatttgtggtttctcattcttgcgctatttttttaaacctttcattacattaggcctttatcagatattagcactggttcttcagttttccccctgatcaggaacttccctgaaataaatgctggtaagatcgtggaaagttcccaggagaaggatagaacaggtgtaccccagggaggctgagccagtacagagagacctatgggtttcacgggccctcagtagaactgatttcctctccttgtctcaggttgtcatcagccactgagcaagaccgaataagggatctcgtgaggctttggagatggatgcaggatctgttgcctgcgattcaaagctggtggaggacttgcttaggtcatgttaattagtttttctcagctctcaccaggtgtcattcatggaggttgcataaaagaaactcatacccagggatgagctttttcttaaatattacctttctgaattttgaaatttagtgtagcattgagacatttaaacacatttttgaagcacaaaacttatttatcctagttcaaagccagatttggtttgacctgtcttggtggtgttttctgtggttctgagatccaacccccaacttcgtcccttttgacctagtttatcacccatgtccttgggttgaaaatagtagtgtaatcctaagagaaggggcctgaaaggaagggaagagaaatcagatgtcagctggtgaggatgagaaatactgcaacaagggagcagcattgacccttgagagctacatgctaggtagagtcaagctctacttgccctaagtcaaaaatatcattgacttgtggctaaagcccagactttgaagagcaaagaaagcaaggatttaactgcaaaaatagaaaagtggctgacccaatgctgaggcttttaacaaaatttaccaaatagtttatttcagactgagaaagaaagagctcaaacaagcttaagcagcagcaaatgctatcagcctggaccatgagattgcatgtgccctgcagtgatcttccaccttgactgacattaaaactacctggtagtggccgggcgtggtggctcacacctgtaatcccagcactttaggaggccgaggcgggcggatcacgaggtcaggagatcaagaccatcctggctaacacggtgaaaccccatctctactgaaaatacaaaaaattagccaggcatggtggcgggcacctgtagtcccagctgcttgggaggatgaggcaggagaatggcatgaacccgggaggcagagcttgcagtgagccgagatagcgccactgcactccagcctgggcaacagagggagactccgtctcaacaacaacaacaacaacaacaacaacaacaacaaaaaaaaaaaaacactacctggtagtgtttacagccttgagtgcccagaccaataagatcaaaatctctgaaggtgaggcctgggcttggtgctttttgatgatcctcaggtgatcttaatggtcttccagggttgagcactgtggggaaaattgaggccaagatgtggaggcatctaactggctcgtgcatgttaagaactggatgagatgggaagccagacattagaaataatggggtcagggcaccacttacatggtattaatagccagaggtcttgaatcttcctccagactacagtgaagagagatacacatgttatctacctggtgatagataccaaagggaagcaaagtaccacactgaagcaaagtaccatggaaggactgctccccacttttgatgcatgataaagaccaacctgcctgcatgaagatgatggtgcacttctcctgaacttcaccatcatgatcacagtcaaagccagtgatgatggagtataatcacaccagtaaatgaagttcccctgctgtcttctgactcacttctaagtggcctggaccctggtggttaagaaaagtaaacccccaaagcagtcagtcattgtcggtttgctaacttgagcatcctgaaattaaaggactaagtactttaactgggtcacctctattagtgggtaaaaagctgtgtggtctttgttcacttccttaaaatgctgctatacgtgatggcaagcaacagaactagccacgagaaagcaacatggaaaccactgaagtcaagacttaatcctacctggttccccatcaataggtaaaacaaagtggttctgagcacaaactctgaagccagatgatcagcttttaaaaaaaaaataattaaagaatatttatttatttatattttattttagattcaggtggtacatgtgcagatttgttacatgagtatattgtgtgatgctgaggtttaggcatctaataatcctgtcacccaagccatgaacatagtacctgataggtagtttttcaacccttgatcccatcccttcctccctccttttggaatgcccagtgtctgttgttcccacctttgtgtctgtgtgtacccaatgtttagctcccacttacaagtccatgttgctgcaaagaacatgatttcattcttttttatggctgtgtagtattccatggtgtatatgtaccacattttctttatccaatacactgttgatgggcacccggttgatttcatgtctttgttcctgtgaatagtgctgtgatgaacatacgagtacatgcccttttgatagtatgacttatcctttgggtatatatcagtaataggattgcagagtccagtggcaattctgttttcagttctttgagaaatctccaaactactttccacagggcctgaactaatttgcactcccaaaaacagagtataaatgttcccttttctctgcaacctcaccgacatctgttgttttttgacgttttaatagtagccattctgactggagtgagttggtatctcattgtggttttggtttgcatctctctgatgaatagtggtgtagagcattttttcatatgtttgttggctgcttgtatgtcttttgaaaagtgtctgttcatgtcccttgctcactttttaatggggttgttttttacttgtcaatttgtttcagttcctataggttctggatattagtcttttgtcagatgcatggtttgcagatattttctcccattctgtaggttgtctgtttactctgttggtagtttccttttgctgtgcaaaagccctttggtttaattaggtcccagttgccagacggacagctttgaattctggtcttaacacttcataactgggggatctaggggcaagttacctaacctctctcagcctcagtgtcctcatctgtaatggagggataatagaagcttccccccagggttatagtgagggttgatgaggtagttcatttaaagcactcagaactgcgcgtggcacctgtaaacactcccacccccagtaccttttcacaagtactattaggatgatgctgttagcagcaattatcagcacctctcatctcaagttatattgctagtgacaaaacctttggcatttcagtgtatagctttccaatcttttccataactgtattttttcttataaaagtgagattatactgagcatactctttgctttttaaactgactatattgagaatatctttctatttcatgtaatctacagcttcatttgcaatgactgcataatggtgcagatatatcatagattatttaaccaaacacctgtggtttaatacttaagtctctctcttttttaaaagcaatgctgcagtaaatatcattaagtaaaagcactgctcattggcataatttcccctttagaataaattcctagaagtgaaatgtgttgttcaaatcgcatataaacttgaaagtgtttgctattctatatgactgccaaattatcctctagaaagattctaccaccaccagcagggaataaaaagtcagtttcccctcactatacttgacactgggtattacagtttttaaactgtaatcttttgtatttgttcttgacctaaagctgagctctgctgtttggggcttggcttctctgaacttggtgctgattcttgctttaactggagcttcctactggagcatcctaggtgggctctcactggctcaaacaaccctatgaggctcttcttagtcttctaggactagagcagggctcagccaagcacatggtgctggcaggacacttggagctgtccctataccagcagcaatcttttgtcttgcttatttaattaccttatcctaaagtacgtctttactagaaatttgctgtcctcagtgagaagcagtacctttcccttgttccctgctgaaccaccagggtcactaccagcagatcagagccacttccctgtccctgggggcatcgtcttagactttggtcaccaccaaagaggagacataagaagaagggcaggaagaggtagcattgagcaagagctctggatttgccatcatcagctgaggattctgaattaggaaacatatctatttaggtttaaactacaaaatatgcaagggttcctattccgagcctctcagaaacatccctctggccacaggcaactgtcactggtgatggttattctctcagaagatgctgaggatcagggtgtctaaggagtagctttgctttaatctgagcttggtatattacattttccatgttagcctacctaatagggtgggttcacatagaaatactagaaaacacagaaggatataaagagcaaagatgaaagcattccaaatcctaccatctagatacaacctatgttgatatttagcatgtatgcagaggatagatgctatcctgtagcatgatcatttatatgcatgtgcgtacacatgcatttactttttataaaaatgatataatactgaacatgctattctgtagtcagtttttaaaagaatgtatctttttttttttttttttttttttttttagatggagtcttgctctatcatcaggctggagtgcagtggcacaatctcggctcactgcaacttctgcctcccaggttcaagtgattcccctacctcagcctcctgagtagctgggactacaggtgtgtgccaccacgcctggctaattttttgcattttagtagggacagggtttcacaggttggtaaggatggtcttcatctccagaccttgtgatctgcccgcctcggccccccaaagtactgggattacaggcgtgagccaccatgcctggtgcccccccctttttttggggtgggggaaacagggtctcactgtgtccccaggctggagtgcagtggcacaatctcagctcactgcaacctccgcttcccaggcttaagcaatccttccatttcagcctcctgagtagttgggattacaggcatgtgctaccatgactggctaatttttgcattttttgtagagatggggtttcaccatgttgcccaggctggtctcgaactcctgagctcaagcaatctgcccgtcttggcctcccaaagtactgggattacaggcatgagccactgctcccagccttaaaagaatttatctttaatggctgtgttttatttatacattttcagtcattcattatcaataaatactgattcaggcccagtatgtgttaggcatgattctaggcaagagagagaaaccatgaatgagagacatggtctctgcccttggggagggtgtaatgaagttcgtcagttttgtgctttgtggtttctttctatgcgttatgtttttaaagtcctcttccatcctaaagtcagacaatcactatattttctcatgttttcactttttacattgcctgagtccatctagaaattgttttggtggatgaaaaattttctacttttaaaccattggaggacagcaatgaccacaaaaggattaaatcctctttccttatagacaagtgggcacaacttggctatgcagtaattctaacatcagcagtgcaaagaagggaagtacagtgttgattcttcatgggagactgatggaattataatagacttctgttcttaaggtagaaaattatcatttttttaacctgaaaagatagagtaatagtctatgataaggacaaattaccccaatatgtttttaaaacattgcaattattaacaaagtggtagtttctttcatttaaaacccccttgggccctaaagatatagctaacaagaggaaaaactgtcaaaactcttattaggtggttgagtttattttctgctcacaattgtatcatttaaaaccctgagaaactgttttttggagagcaatttgtccctattagagttttatgtgttcaaatccttgacttagcagttctgctggtagaaatccaccctatgtatggaatcacaaaagtacgtctaagatgaacatagaggaagattcattgcagtcccgtctataattgcaaacaaagcactgagaaccacctaaattatctattagcagcagactgctaaagtaagttaagctacatctgtgaatcgccatgccgtagttgcaaagaatgtggtgggattccatgtgctgaatgaaatagtaaaatctctaagatacatcacgaagtgaagaaagtaagctgaagggcaggtcttttgtgttaagaataaaagaccccaacttatgttggtgtatccattttttcctgtaggatgcataaaggactaataggaattgttgcctgaaggaacaaagctggtagggatgaggtgaagagaaagtcaaatgttcattttattcctgtgtggatggtgtgaatttttctaccctgcatgtttattacttttatttatgttttgtaatgcttactccatttatctaggcagggagattatagacaattggtgtttccttctttatacttttctatattaaaaaatgaatatagatcagaaatgttcaccagatactggcatctaagaaacaaacaaaaacatgatttgtcaaagtcagaaaaggagtgtatgtctctgtttggaattatgctaatttcttggagtttgcgttcctttgttgtcatcagaatgctgcacattgtgttctctttctatttttgtgcacactatcttgttttgtatttccaaccacgacagctatgttcagttgtgccccatcccctcccctgttctgtggcctgcggtgctgagaactgcgagcagccaatgggactgctgcttactgtgaggtccatgcagtgtccacccccgcttcctgccctgagactgcctccaggcctggcacgtcttcctaagacaggcctatcaacccagtggatccttctgccccttcctcctcctgtcctccaactttagggagccatattctgatatccagagatcctggatttagagcatctcctccattcttggtaaattgagaaccttcccaactgctgcctcatctgcagtagttcctttcagatgaaaagttaaaatgggagagaaatattttgcatttgctcttttcattagactattcgatttctatgtaaatgtcttctacagggattgaaagaaatgaatatattggttcaccagacattgctgaaggttccaacacagccttgacctatttttgtttgaaattgagaaatgctcacaaatgtaagaggcctccttttttggagattggagggatttgacatcaagatgttttgcattttcaacagctcatttgccctggatggcttttggcagataaatgtggaggtggcagtgtaataggtttcatgtgtccagagtggaattcacccagagccaaacaaaagctagtagctctgaacatgtctcttttcatggtaaagtactctggagtgagactgtttaagtttcaacccctgtttggccacttcttagctcaagggcacttcccttacagtagctaagtttaggttgtttcatccataaaatggaagattttaaagtatctacctcaaagtgtgatgaggattaagtgaaaaactgcggggcaattcttactataatgcctgacatagcaaggcatcaataaactcagttgccattattattcttaccattatggtttataccactaccatcattgggattattaggttcaaccactacacaactgaattgttgttgcatgagtaaattgcagttgtttagacaaaatcctaagccaaaaacttcgtgctaggtagaaaggaagcaccttcatttattaagtccctgcactctaccaggtgatgtgttagttccatctttgctgtatctcatttcaatcctgcagtagcattttgcaggtagttctatttcagtatttcagacggagttccaattgtttgatgcttactagccatgtgaccctgtctctttatcttcctgtgcctcagttttctcctctgtaaaatggggataatgatagtacctaactcattaggttgttgtgaagattaaacatgttaaatcacacaaaacagtgcctggcacacagtgaccactatgtaaatgtttgctagcattactttataactcaggaagggcacatgtgacagtctggaacgtgtgaagtcgttgttctccttagcactgtggaatgttagtgatgctggaggaaacttagagctaagctggcccaacctactcatttcacaggctggggatccaaggcccagaaacaataagggacttgtctaagtcactcagggagttcgtggcagagcccctacctgatacgagatctcctgactctgctcacgagacttcatggtgggaataaggcaacacacggagagggatgagatggagatcacattcttcgggagagtttgattctgttattcctgccatttgggactttttcagagtcctctaccattctgcctacctgtacagaaagtgctggatttttccaccacaaggggcttatcaatgtggtgtcataaagcgggtcttactttctcatcagagcccatatcagaccacttcccttcttggtctttagaggaaaccaaagtgaagcactcctagcaaagaatttgatgttatgaccatcaaagcaaaagtatagctctatggttaaataattacttaaagggtcacaccgtgggcagaccttaaaaaacagacttaagatataacccatatgggctataaagtatctataaaggaccctaaatggaaactctgctgtgttgtgcatttgacttggcactaataggccagatatattaactgttgggtgaaattaatgataatattgcatctaaattctatgggatgtttcttaaggttttgggtgttaaattaccccttctaaaatccagtattgaggctcgaactaatcaatgtcttctttttcttttaaaaattctcttgaccatattgtttctattacaaatgaaacatgaaggtagaaagtagaataataagttacaagaagtggagaagggagtgtgtgtagtggaggatgagagaggttggttaatgggtacaattatacagttaggtagaaggaataagatctaaggttggatagcacagtaaggtgactttagttaacaacaatatattttagattttaacatagctggaagagaggactaaaaatgttcccaacacaaagaaatgataaatacacgagatggtggatgtcctgaacaccctggttattatacatcctatgcatgtaacaaaatattacaggtacccaacaaatgtgtacaaatatcatatgtcaataaaacaattaaaagtaaataactacagaaaacaatacaaagctggcagttccttcttttacagatagatggcaagctcaagtccaaataatcagttgaagaaaagagaagttatgtagatggaaatgctggtccaaactaagggatgaggaataaatagagttgtggaattatccacttcacctggtgatgttgcgggttaaatgggtacatggctaggcagaacaatgtagaaaacctaccttacttgttcttctgaccaagccttttaaggctgtcatttaaaatggctctgagttctgtttcttagttttgtaggatcagaaaatcacatgccaacttagctttcagctacttatctacaaacccaagtgtctatttatttttcagtggatggacactgcaggggtcttagcaagtaccatctctccatttagctaactacataggaagcctgaatagaaatcaggattatgattggtgatcttgaagacagagccaggagagtgagttttaatatctgatggtgttgagatgagataactgatctcgaacagggatgtgtctgctgagcaaactcagcattacttgttagctggacaggcgattggacaaagctgagtgagcacctcttcaattttttttatgcttgattactcaggttttcagtttttagacagactatttttcttttttttcccctcagatgtataaatagcattgaatctgcagtagtgttagaaaggtaattataacccaaccatgtctgagatgacattgtgatttcttaatagaaaaagcttgttgggtccccacttgcaagttgatttttcataatttaattctcaaaatgtcaccttatttcttggtgtaacccagataaaacctaggtatcctggcaatccagtttcagcatgaagttatattcaaaggaacacaggctagttggccaaagtaatttcagtatccttactggaatcttctggagaacatcagaggggattcattttataagccacagtaaaatatctcaagattctcttttcctgatttcctggccttaatatctcagccttttcattttaaactcttgaactttaaactgtctctgacccctttcagtgctttacttcttcatctcttctttccttttctcgatcatttttccccctaaatagcatccccacccattccctttccaagtgcaactatataaaacagtctgtttctcgcagtttttcagtactttacctctttctctgattcttcatttcaaaagcctaggaatcctctggcaaaaagtcacttaaaaggtttggggcaaggaaacaagattccctttagctcacatggaaggaagtcaaagctgaattatcttcatctagcaatagaaagaataaagattgcaacgtttacaatttaatatattttctttaccctcctcttgtctaaattctgtgatctcatgatggcaagagggccttgagtaggtcttctggtcccttcccactgctgtgccctggggcgcgaggtatcagcgcaagctagaatgggggttcagtggaggaaaggaaacaccctatttctgcttctgactaccttccctgcttagcctctttccctgtctccctgtttctcacacactcagttgggacacccaccttgtccacagccacagcctggcatctcctagtgctccagttgcagcacagtcagcaggagagaagagggagtctcaaggagcaaaaaggtggaaataggctttcctaacaacaggtgcttgccatgtctgtcttctcatcatatttattgaacagaatgtgcttcattctctacgggtgctctttaacaatagtttacgtgttatgttacgaacatgttatgattataacatgttctatcatgttataatccttccagaaaatacttgccaggaaaatatataatttatagaaagtgaatgaaagtggcttgttagccttcccagatagtggaggaatctggaagtctttctaatggattgagatcacgtcattccagatgtctcttgaggcacactgccccgaatggttgctactgtcagctcattatgcttttccctggaatttccacttcccccgcctttctccccagaataagctttccatgattctttcccagaattagccttttcaactctttcctcatatgcatagcaacagtaatttatttcatgtgggttaatgtctttagcattaggacacttctggttttatggactgatggccaatgtgtttttaataatgtattttgcttctattgaagtcatgagtacaaattcgtaattcatttgaatgagggatatggacaaacaggaacacaagtggaagagagaaaaaagaggatagtacactcagagatactcagtaagcataaattacatgtattcatcatacaatattctaggctttagagatgtgtcagccaagatccttgtcctcaaggagcccatagtttgttagagagagaagatgtgtaaatagttaagtgtataaagtgctacagtgcttgaggtctaatgtagaaaaatccacagcctgtggggagggaagagaaaggagggagtgatgcaatctatttggagggaacagaaaaatcttctgtatttgtcagtactctttgagttgtaagtggtagaaacatcactcaaactagcttaagaaaatgggagatttattagtgtatataatttaggaagcctggggatggttctggcttcatgcatgactagatctgggactcaaacaatgtagtaggacccttttttctctttcaactctgcctccctctgcatgttgactttattttcttcaatgtagatgcatttcttttatgtgacttggaaaaattgctactcagaagtacatcatctcagcttaatcctagtggtatgttttttcacttctctcctggtatccgtgtgtctgtccctagaaatgtctctaactggtgtttctcagttcacttagctatcccttggatcaatagctattgcaaagaaacgaggtagcatgattggcctaacctggctcacaaacaagtcctagtggcaggaatgagctaaccatgactggcatttccaccagagccatttacagtgagggtagatgtgtttccccaaaggaaagaagactaggcagatcaaaattgacagatgttcattaaagcttcatggatatttaaactgtgccatcatagatgaattgttttttgtcaaatgaagcagcagtgcacatcgattattgttagaggaagcaataagaacaaaactaagaggacatgaaccagccgggaagatcaggagactgcaagtagtctttgaggttggatcatggtagggggccatggcttgagatgaagctgtgaaatagacaggagcctcactggctatgctagggaacctgctctttgcactgtaggcaatggggagacatccttggttttaggcaagggtcggaggtggtcagatttccattttagaatatcactctggcagcagtgtggagattgagttggagaagccaagaatggatgcagggagactaataaggaaaccactacagtaatccagctggagataagttctgtaatgtgctaaagatgctaatatggaatagtctccatgtccaggtaggagatgaaggaaggagggttaaggcaatactcaaggttatagtggggaagcaaaagatgtggaaactggccagcagaatcaacatgacttggtctttcaagaaagtaagtgtctaggatgacttagatttctgacttaagtagtgtcatttgctgagatgaaacatagaagaaggaacaggtgtgaaggtagagggtgggggattgcttgagatggtgactgcatgtgtttgagtttgggggagtgactatgaatagttggcagttcagtatagggatctgcagctcaaaggagaggtagagttgtagagtggatgagaatgaaggcccgaagagttactggttttgtcctggttaagggaaggagaaatctggaaaccagtgggctatcccggtgaggagcacagctcagacctcagccatcaaacaagtatcagaaactgcaagtgagttccttaatggtgtcctatgcaaacttgttgtcgtttgactcatatctaattctgagcgtaggctggttgcctcttgtccacctagaagtgactttaagaccatcactatgggctgggttcggaggctaacacctataattccagcactttgggagactgaggtgggtggatcacctgaggtcaggaatttgagaccagcctggccaacatggcaaaaccccatctctagtaaaaatacaaatattagccaagcgtggtgacacacacctgtaatcccagctactcgggaggctgacacagggaaattgcttgaactcaggaagcagaggttgcagtgagctgagactgtgacaacagactgagactctgtctcaaaaaaaaaaaaaattcactgtgaaagggagctcagctagtcaaagaatcctgaaatagctgtggatgcacagtgggtccttgtcatggggccaggcccagggtcatcagttagaatgcagttgtaaacatgctaatgctgctgcctggttgtatgtgctaacaactgcttagttccaaattctaacccaataaggagtttcctcaggggaaatgtatgactacagcacaaatgggctcagccttactgctttcccactgttaccccttcctgcaccagcgctcttctggtccgtgtgactaaaagccaaaacaccactttgcctaaccccccagatcctattagttttgagtctcatcaattctgtttcttccatttgtccttctctttccattctgattggtacagctctaagctaggaggcttgttagttcatccatccttactgcacaaccaggtgaatggaacatcctcctaaggcacttaaatgatatttgaatccacaggtcagcaaactaggacccgtgggccaaatctggcccactacctgtgtttgcaaataaagttttattagaacacagccacactcattcatttaaatattgtccaggactgtttttgaactacaatggtagcattcagtagttgcgacagagactgtatgtcccacaaaatctaaaatatttacttttgttttataggaaaagtgtatcagcccctattaatccaccttatgtatgaatgccagattaatgttcctaaaatgccatttcaccatatcattctgtagcttagaaccctgcaatgacattgcattgtccatgcaataaaatctaaacttcatggccctccatggtatagtcctagccaatctgttgagtcattgatctctgttcctaaaggcaagccctacaaccagttagattttcctcctcattgtccctggaatatgcagtgcatttctacccttgttcacctagttccttttgcttggaatgtattgcccatttgtatctacctaaatcctactcattccttttttttttttttttttttgagacagagtctcactctgtcgcccaggctggagtgcagtggtgtgatcttggctcatggcaacctctacccactgggttcaagtgattctcctgccttagcctcccaagtatctgggattacaggcatgtaccaccacacctggccaatttttatatttttagtatagatggggtttcgccatgttggctaggctagtctcaaactcgtgacctcgggtgatccacccacctcagcctcccaaagtgctgggattacaggtatgagccactgtgtgcccggccctaaatcctacccattcttaaaggactaacatgaactctacatccttcatgaccatgtcagttacagtgatcaccaatgagcctgctgcttgagcatgtaaaggtccactgcccatactgcctggtaagttttcttctgctcagagaatggttcaccaatatgatgatgggcaactctggagtgaggactttctgatggaacaaagtcacagctgtgggaaagcctgggaatggtttggaaatgacaagacatgtaatgagaacacatgacactcaattaatatttgtggaaatcttgagtcatcagcctctcatatctatgacatacatcttggttctgtatttaaatgtaggacaactacatatcttgatagccagtgggaatgactgacaaagtccagtaagtctactcttgagagattctagaatgtagagatagcagctggaccaggaagccctagctttatcatgtgccatctctgagatggtggatgtgggctgttcccactgtgcctcacttttcccatccactgtcatatattttatggtcttgcacacactctgggattaagtaacatcaattatgcaccattgattggagttctttggtaaatggtactacattcctaaaatattcatgtgtcttactttgtcagggagattatatccgtgacttagatatcatattctagtggcttaagattatgagctaatattttgtaaggtctgggcattgcacagaaaaccttggttgtaatacacattattattacattgatttgaatagcaatggtacaatcatagccccggaaacatagcgactacataaaataaaagcttccgttaacactgagcacagcagccaggcttccgcattgttgttgtccctaggatttggctgttgtattgtcaaatgccattatgtcttatctaataagtttctccctgcatatgtgagtaaacgaaaatgctccagtatagtaaatgtctcagcaaaccactcctgtacgctttggaaacagaacattaacaaggaaactatcatgagagcagacctttctgttctcatgaatcacattcatatgatgtttattgtccacattggagaagtatagagaagaaaaatatgaagggtacactctaatggaaaggttatagtggaaatgcaaggaaaatatatccctttacaaccagcttctaggcattacctagaagtaaaattatgacaataagactaacagcaaataacattgagcacttactctgtgccaggtattgttctaggccttttacgttacatcatcttatttaatccactccacaactaagtggtttggatgcagttattatctccactttatgtacgagaagaccaagacccagggaggtagaagaacttgtcagaagtcagacaggtagtgagtggtagggctgggagttggacccggacagacagattccagatttcatatttatcgtaacctcagctgccccacccacatgaaatgctaccccaaggctagtggcagcaaatataacccatttcatttgcattgtttggtatgtccaactgggtgatttgtcctacaaaatttgaaacaacgtctgcttatttatgtctgtgattttgatcaaataaatctcacccagaatttcccactgtcttattctatggtatttgcagtttgtaagaacctctgtcttttggattgagacgtttttattctttgtgtccaaattaacactgcacagaacatggttctctgtgtgtgtgtgtgtgtgtgtgtgtgtgtgtgtgtgtgtgtctgtgtgtgtgtgtagaaaccgtcttttcttttggattaaattcttgcagcctggctgagtgaggagaatttctcccactcttcgagcctacagcagacatgttaggagaatgctgctgcttgcaacacacccagagacggtggggcaggtgacactgcgtgtgtgcccggtgtctctggaagtgtctatacagatgtgtgctgctgctgctgctgctttctgccttaaaatttctggagccaacacccacccactcttacagcctctgtctctttattttcaaggaaaaaagaaagaggcagactgaaatagaaggcaagcgacaacagcttgacgagcagatacttctgctgcagcattccaaggtaagcagctgatcccaggaacctattccattattagacatgcagatcacactccggagagctgggcagtgcctgccctgccgtgaaggcgctgccgccaaccaaaccagcctttttcattcaatcaggaaaccatctcttggcttttcttgtgaatttctcaaattcagggcattattacagcattccaatttctgcaagcataagattacagtgtgcatgtggacagggtggagggtttgtgcgtgtgaagtgtggtggctatatatagaaattggatgagaatacttcacagggtgggtgaggcagcatttcaggattgtttctcccatgcataggtgctgggtgtgtttgctcagagaccccaaaagatatatttcacggaacgttctttttattcacttaaaaatattagtatttcctttcttgatatggagaaaagggagattaaacgatgtgatctgataaaagaacaacactgtgtatttcagattattcatttattttatttgtactttaacaattttgaaagtgttctgtgagagcaagcagttggtcaaagatggctttgaaatgatttgactcagacgggtctccatggtaccatctaaaaagagagagagagagagacagcacacaagagctgtttattttttctttaaaacatgatgcacttaagcatcgtaattgattacagctcaggagaaagctctgtcactgtcacaaggaccccactggttgcagaatgttgcttttcacatgttcagagaataatgtgaccacattccaatggccagccgggagttgttgcttgcctttgactgctcctgggctttttggcaggaaaaccttctcctgcttacctcatgttgctgtgacattgcctgcacagagctgcattgctcagaggactgggtgggaaggtggtgctgactttcggggtgatgctcggtatgaattatctagatttttttcaacaagataaacctttatggctacttttcctgtccttttctagaaaacaggattgtgctaaatgaatacccaaaatgagaaccatcagcaagcgagttactgattgaaaatagcagcatgacctatatctgcttagcatgtttatcagtttttgccatttaccttaaccagagaaatgtgcttaaaaggaagaaaagcagcatgatactaaggatattgcctgtttctctctgttcatcatataaattcattgacagatctttctttgtaggagcttgctctgtatccccggtgctgttgctctttccccacaacattcctgagggaggatggagggctaaaattagtatcctcttctcacagagagggggccttaaaaacacctaatagaactgagtgaattgttcaaggtcaatctgcacagagctaggtctctggctcagagtacagtccattcagtacggtgcttgtaagagaccaacatgtactaaaacctcagtgaatttctggttaaaggtgaacttttaaataagaggaccgaatgaaaaaagagaggctgctttgggctagacagcctcactttaagctcaacgtagttctttgcttttgtattccctgaatccagtcagggaataaacatatgtcaaaacatcaagggattttttttctttggtctcccttctcatgatcctgggtgccaaataagataccaagggctcatttattgctgatgtccagtgcagtattagtatattctgttcatattacatctattcatttttttatttgtttgtttgtttgagatggagtctcgctctgtcgctcaggctggagttcagtggcatgatttcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacattgtgatccacccgccttggcctcccaaagtgctgggattgcatattcatttttcgtctatgcatccattcatccatctttccatccatccatccatccatccaatcaacagaaacaacagtagaaattaacttggtcttgtatgcggaagcagtgaggtttttctcaaggacttggaaacaagggaatcagctagttctttatggctatcttggtaaaattctcacacagttgatgagattggctatctgaaggaacacccaacactcgcaccatggcaaccttgctattgcagggcaggaggtgggtgaggtggggaggactggaggtgatggtaacttactaagtggaggtgagtgcattgtatgtctctgggaaaggcttgtgtggacagaatgagggtgagttatttgccttgaatactgaaaaaggaaagctcagaggttccaaaggtggcagtggttgtctagtactatctgcagagagacccccagctttgggaggtcctgaatttctgtatgctggtgaggtggggtcagtggtaaggtgaggagggtcctcaggccacagtgaggcccaagtgaaacttccctcaggaccttgcctctctttgttctgaattcatcctccctataattattcagttattttgatatgaggaaagggttgcctgattgaaggatatgatcactttaggcactaggaaggaatatgtttcactttaaatcaataaactggtgactgaacttgaatagcatgggactttttccctgtaatcatccagtttgcagcctagtggcctcgcccctggatggaagtacattcgtggaggttatattttcttctctgtgagcctctccaaggagtcagccagttttctcctggtagcctgttagccaccgtcagtaacagtcaccatttttttgagtgcctaacacgtgcctggtactttaaacacataccctcaataatgaccacaagacagttattactctgtcttacagctatgggaacaaactcatgaggtcaagtgatttgcccaagaccatagagactataaatgagggagcctgagagaaactcctgggctgtctgctttcaaagaccgagctctttccaggccaccgttctctttgaaagaaatgtttcctttggaataattcatttagtgagatgccagttaccatcattgctgtctctcttactctaaatatattgtgatggactccagaaaatttagatcatgtggagacatgtcacagtgattattgaagttccttgaagtagagaatattaggaaatatgtcagtaatcaatatttgtttcactaatttgcaaaatcctagatattctctaagaaaaaaatattctccttgcattagagttagttgtcatgtttataagatataattttcatattctttatataattctcatattctatgtcttaagataaaattctcacatgtggcaattatcagatagcctgtggacacttattctcatgcaatgagatgaattatttagacagattcacctgtctgtggtcaaagcaaataaatagaatgcaagatagtagttttggcattcatatatatttttagaagacttacttattgcaatatttaggaacatatagtgagcaactctacaaaatggaatatcatcactttgtatatggacttcgagcaaattccacaatacagtaaaagactaaagtataaaatggtaaaatactaactgctacatcccagtgattaggaaacctcaagatactttgaactccaggccaaattaaactcagatgtatttttaaagcatccttagctatacgtagtgtggtgtaataatttctaagcattacaagtagaactagtaagcaatttttatagctatattatttttgatgattacaaaaggaaagaatgtataatcattgcaaaaactaaattaaaaagtacagcaaaatataaagaaaaaacatatgtactctatacttaccattcagatagaacccatgcagaggtaaatccttctatacttttttccccgatatatttctgtagattaagatatgtaaccatcattcacagggctcaccaacctgtgggtaaaatgaaattatattaacattagcattggaataacattaacctttacctcttttttatgtgggttctttttaatacccatacaaaaacttataatttttataaaatcccatggagcattcttttactttaggataactgactttgatgtcttccttgaaaagaatgtctccatctcaaactcttagctattatgtttcttatacttcaatagcattaattcatctagaatttatttacagacgaggtatgcagtaggaatataactttactttttactgatgctgagctgcttgtctcaatgtgatttattgattaattcatcctttccttcactgatttaaatgtcttctttatcacctacatatttctgacttacatttgagtctaccatttatggattatttttattccattaatctgcccattcctgtgccagtattgttctcatttaatccctatagctttttaatatattgtaatatttcataagacaagaactatcattattcttttgaaaaattgtcttggctttttatttcataggaacaattatttatttttattgtttttataatgagacttgtgatgatatggatttttttaaaataaatcagctactatatcatactagagcagaaggaatttaatatttccttctgtcccttggttgaattgccagagatttgtctattttattggtctgttcaaagtcccagcacagagtaggcactgagtacctactgcaacatgaattccttggagactgtcatatttacaaaggtttgcctgacagagttggccctgtcagaatcaaattgctaataccacgtcttcaatacataaactgcctttgaattacttattcatgagcggggaaccctcactagagttttcttctaatccaagctataaaaattgtcattatatttggaagaccacagccttttcttccaagaaagctgaatgaaaaaagatgaaaggctgaattgtgaccctgtgaaatatttgttgtcaacccactaaggtcatttgctgaagagcctgaaggtatcagaagacttgctacaaagatattacagtgtctttcccggttttgaacatttagcactaattttagactttttcttgttactgggatgtgtgaaagacttatttcaaattttaaaatattgaacagataggcacagtacacagtgtaaagtaaccttagatctcctcccttgtttccatacccagagcttgaatggaagttaaaacctgatttcttctatcagaagtcttgggtcggcttctccctgggtggactgaagcatataacaaaatctcaaaaccaaaccaagatcttatttattgagagtcaagaaagaggaaggaaagagtgggaaggataggggaagagaaagagggacaggacacagataaatgactgaaaacacaaacacagctattgcctcatgctgagtttaacccactttctgttagaaaactgaatttaggccaggcgcagtggctcatgcctgtaatcccaacactttgggaggccaaggcgggcagataacctgaggtcaggagttcgagaccagcctagccaacatggcaaaaccctgtctctactaaaaatacaaaaattagctgggctacttgggaggctgaggcaggagaatcacttgaacctgggaggtggaggtcgcagtgagccaagatcacaccactacactccagcctgagtgacacagtgagactccatctcaaattaaaaaataaaataaaataaaataaaataaaataaaataaaataaaataaaataaaattgaatttagccatattccaaccatcatccactagaatagccaatatcagcttcagccagattacaaatgaatgaaagatccagagtaaaaagtaaaatcatgaaagtacacaaaggaatcacaggtgaatatttttatagtgagggtaaggaagtcttatctatgtatgacatcaaagccagaatgtgcaagtaaaaaagattgccagttatgactttataaaaataacaaacatctgaccaggaaacaacaggagacttattacaagttctcattcacctcctacttccccaatctgccccacccagcctctccagacatgcctcactcttcaccggggtcacctcaaaaagtggtatctaggctgggcacagtggttcatgcctgtgatcccagtacttgggaggctgaggtgggaggatcatttgaacctaggaattcgagaccagcctgggcaacatagattccatctctacaaaaataaaataaaaaataaaggaaagtaagaaaagtgacttcattgcagttaccttagctgtagatgaaaaagattgggttagatgatctctgtgatctttttttagctttagtgatccaagattttatatttgctaaagtacagtgtatgtgcatgattttccaagaattcctcacatgtcagcctccgtggatgaataaaagatacagtcctgactgtgagaactcaggggcaagtgggggagagagagcatcaatatggaacccaccattagaggagctgaaaaatagttttccatgttatgaagtggatcagtggcacctgatgattttgtaaatcctatttgagcaaaaaagaaaaaaggattcttgggtgatcttacacagaggcaagatagtagagtgtacctcttggcttcaaatcccagatctacagctcactcggtgtgataccatggataagtcagttaatgttagcacctacctcatgggatgcttgtgaaagttaagtggatttacatgtaaagcacataaagcagtaagagttctataagaattatcattattgtcaccatcatcacccagtactatggctgcaaataccatttatgtatatatgactgccaaattgagaatcccagtcttccatgttcaactgcttttctgacatgtccgcttagatggatgtcactttcatttagaagcctctgaaacttaacatgcccaaaatgaaagattttattttctgcttttctatcatttgttctactcttccctgtctccagttgatgataccactattcaccctttcactcaaaccaaatatctatgcattgccctaatccttccctttttctcagcccacatctaatctgttacaagtcacactgattctacctccagaatgtaccaccatgccttttgattcttctgtctctcttctgtttcaagctaatattctctgtcacttgaaccatgcaataaactcccatcacttgtactttgtaatcctgccccttgcaatgtgttcttcctattgggcttagaagacacagcaaactccttaacaaggctacagaatcctacctaatctggcccctgccttcttctccatcttcagtttgttctgccctcccaccccaacctcacttattatggtccagccactcgggcatttgttccggtccacaaacacaccaaactctgtcctaccaccaggctggtacatttgccagtccctccacctggaacacccctccggatctcagatctcagcttgaatgttcaagtcatcagagagacctttcccactttaaatgtcctcccctggtccctctttgtcacattgtcctgtctacctcttcctaggcagcatcatagtctgagattatcttgcatccttgtttattgggatgaaggcttgagtgagagtagggacttgcctgtcttcctgagctgtgacttcagggactggcagagttcttggcacctaggaaagggataagagagccactgctcctgagttggggacacagaaggagaggatggggagttcttttagattatggtgtttgaccagccattgagaaagcttgtgtattcttcaagcatttggatagtcataggtcctcatgctgtgctactcaaatcgtggtcctcagtctggcattgccagtgacagcatcacctgggaggtcgttaaaattcaaattcccaggccttatgcgagacttagagaatctgcatctccatgggtgggtcctggaatctgtgtcttaggaagttctcctggtggtccttatgcatactgaagtttgggaaactcagttcttgctttttgttttccaaagctggccaggccagtagagccagaaacagatttactttgggagttccttctgtcctcctttcagaagcccctgtcaagtttccctttgtccagctgccagctccccacctgctccttccttgtattgacttgccatgatgacattcgtttgacaaatgtgaagtttgacagtccttagcaccttgggaggagtttgagaccagcctggccaacatggtgaaaccttatctctactaaagctatgatactatgttagctatgatacttttttttgatgtatgttatttagacaataaaggccacaaacagagaaaagttttttttaattttaatttttttatttctattgagctctgcttccgctaaattctgaaacactgaggcagccaatacaagctagcacagtataggggaccctgtgctttggatggtgcactcagtatacaccattccatttggagacatgttggagacaacataagggggatctggagtcagttaaggaagccttttgaattggtgatttcccctgaaagcatgactttggagccaagtagaaaatcaactatgctttttcggcttcttaaaaatgtctaaacacctttgtgaaacaggattctctgagaccaggcccactgccttttccagttttttttctttctttcttttttttgagacagagtcatgctctgttgcccaggttggagtgcagtggcgtgatcttcggctcactgcaacatctgcttcctgggttcaagcaattctcctgcctcagcctcctgagtagctgggattacaggtgctcgccaccacacccagctaatttttgtatttttagtagaaatggtgtttcaccattttggccaggctggtctcgaactcttgacctcaggtgatccacctgccttggcctcccaaagtgctgggattacaggcatgagccaccacacccagccccactactgcctttgtctgttggagcctctcttcctggctcctcctgttgggatgttcttaatgatgtcatgcctatatcaagaaaagagatggaagtagagggacatgcacctctgggtgaccagagtcaccaggctgctctggccagagctacctgctgatggtggcagctaagttggtgagaagtgaggggctagacccttcatgtgatggcaggaggcactgtgtgaagaacagcagagagaacattccaagagcagccatttacgttgcaagaagttgtggctgcagaacatccctgctggtgtggagacagccaggactgtccatggctgcttttccagaagggtccacaccaacgccaaggcttccaggatgtctatcccccagaatcctaaggtttttactatctgtggtttggacatctttagcacaggaagcaccctgaaagtgtggtccctacccctcccaaataattagagagaaggaaagttgagaatttcccagttcatccatttactcattcattatagggaattgggctacaattccattgactgaatgaataaatggatgaattgggaaattctaggtgacacagtgaatgtgaaggtggataaaggacagtcctagccttccaggaaccagcaggctacagggggaacagatgtaaaaagaaagaatttgaggatagtatgaaagggccatagagtgtgtctcagagccagtagaggtggaaggcttctctggtggtattttacttgttctttcttaggtaaataaagcagaggccaagggaacaggatggacaacaacaatagtaaacatttctatagtactaagtatgtgtgtggcccttttagcctataaactcctttaatcctcataacaaccctctgagctgggcactgctattttctccattttacagatgagaaaactgaggctcagtgaggcgaaggagcctgtccaagctcactcagctggtaaatggcagactggttccagagctcaggctgttagccactgttcagcatggcctcttgcagtctctaccctcttcctgagagtaaatttcagagccaagttatagttcaagaaaagcaaagcaataatcattcttctacttcagaattgctaccaatgaacaatttattttgtgcctacaacagattaagtatctgaataaaaatataaaaacatgaattgattaaaaaatggcctctcataatgtgcaaaacagggtctgtcggggaaattttgagaggtttttgtggagaacaatggttctgaatgttttgtagaaagagcaaccgatttgccccaccctttcccactttccaatggaaaagaatctctgataaagctttgataagcaaccaacgtaagcaaattgtactgccctcttttacacatgattttatactatcatacgatgccctataatgtaaaaactgtacattttaatacctaccctggtggtagatgcacactatttatacagagcacattcaacaggcagcatgtcaccagtgatgcatagctgtttacgcatattgaggtgtgggggtggatcctgtctataatcactgtaagagtatagttaggaataattctatgtgaacaaactcaagtctttaagcctaattattaaaaaattacaggtcaagtaccataaatttgcctatgtgctgcaagagtaatcaaagagatctctacaaacaatgatttgtaatgaaaaggcaagaataacatcaataaaaaccatggtcacctgaacccacactgatgatgtattgtcaacacagagtctctcctggaagtgcaggaattccaggttgattgaacttgctcctgggcatggagcagggtgtctacagcaccagatgacccctggacttctcaatagaatggtgaatcaggaccattagtgaagtctaacttactaatactaagtgttggtaatttttttttgagacggagtttcgctcttgttgcgcaggctggagtgcagtggcatgatctcagcccactgcaacctctgccccccaggttctagtgattcttctgtctcagcctcccaagtagctgggattacaggcgcatgccatcacacctggttaattttgtatttttagttgacatggggtttctctatgttggtcaggctagtcgcgaactcctgacctcaggtgatacgcctgccttggcctcccaaagtgttgggattacaggcgcgagccaccgtgcccagcccagtgttggttatttttaaagactcatcagttcataataaaatgcccttaatgccgcatacaaatgagagtctatggaattgtgcatccttcgctcataagagcttcagggagtgctccaagcctccattccctggctctcagtctttagaagagttctttcctttcacctcgctcaccctgcctgatgagatcaaacgaaattctggacagaggtgatgccagtgagccagggagccaaagagccaggtctttattctgtgttaggtggcttaatagtcattgctcctgctgttcctttcgttgcttactatttctgggaagaattgttcatgtgccctgcatcctcactgtggtcccctctggtgaccactgacctgcccatgggcatggtcactggtccttagccatgatgtacagggtcagtagctgctgccgtctgccatctagggaccatataagtggaacctgaatcaaaattatcctctcacatctacctctccttgctcttccttttagggaatttcaacatgcttttttctggaactgttttcatttcccttctcaaagcagtaattgctgcctccgaaccattgacctgaaacaaaagctttttattccactgtactgtatcgtagtacacttgcaaacatgggatgtatggtttttttttttttttttgacagggtctcgttctatcacccaggctggagtgcagtggcacggtcacagctcgctgcagccttgacctacctggctcaagcgatcctcccacctcagccttcccaagtagctgggactacaggcgtgcaccaccacacccagctaattgtttaattttttgtagagacaaggtctcactatgttgcccaagctggtctacaactcctggaatcaagcaatcctcctgcctcagcctcccaaagtgttgggattacagacatcagccacggtgcccatctaggggcatatgatttttataacatttggagattattactgaagatgattgggagtcattaaagaagggagtcattgaagaagagtcttgacaatctttttaaaacactttaatatggaccagatattaggtggtcttaggaagttttttaattaaattacagttgcatagaaaaatgttcttaatttttagagactcatactgacatattgttgggtaaaatatggttgttatttagtttaaaatcatttgatgagaaacatatgggaaaatatggcaaaatgttcataattgttaaatctagatgaggttacatggtcattcattatacagttctatttttaaatttttttaataatagaaaatgatatagagataaatctccttgggtgttgatctagagggaagtagggagccatgttagtgaggaggtgaaggcagcgattcaggcagcgctggtgaggggtggagctaaaacagcaccactgcagagggagaggacagtgtggactgaaaagtatcatcttgtctgttgtcttccctcacttccacagtccaaagtgcttcgggagaaatggctgctgcagggcatacccgctggaactgccgaagaggaggaagccaggaggcggcagtctgaagaggatgagttcagagtcaagcaacttgaagataacattcagaggtaggtggcttccagcccagggaacccatgctacagtttttcagtgcagtaaccactgctctcctctaggtggcctttctcaatactgttaccttctcctgtacttgagaattttcttcctaaacaaagcacattgatgttgtttaaacttttccagatgacccagagttatgacacagagtactaataattttttatttttatttttaacttttattttaagtttaggggtacaaatacaggtttgttacataggtaaacttgtatcgtggggatttgttgaacagattatttcaccacccaggtattaagcctagtacccgttagttatttttcctgattctctccctcctccctcccttcaccctccaaaaggccccagtgtgtgttgttcccttctacgtgtccgtgtgttccatcattagttctcacttataaatgagaacatgcagtatttggttttctgttcctgtgttagtttggtaaggataatggcctccacctctatccatgtccctacaaaggacatgatctcatccttttttgtggctgcaaagagtactaattattgcactgggctgtaatacagcacagtgatggcttcatgggcccacaaggtgttgtgagcagcttgccccttcactaggtgctccctttgagttcttatattagctttcatctttttcctccttcgggtcaggttgttagctgttattgctgctgtagtgagtctgttttcaaatttgctgtatttggtcaattcgaaatgtgaaaactgtagtcaacagtcttgggattgaaatgaagagtgtggaagtgctgagtgagagcacctctgtaggttatgtgcccgtgctctaaaaattaactttgtattgtctgctttcactgctcagagagtggtttctttatggttctcaaccaggatctgatcacttcaatctgggagataagcgacctgtctgtgggcaataactggccaggctcacacaagagcaataatgtaggtttttacttgggagctatagccactccaggtcccaggacacctagccagagagatatgagatagggatggaaggtggtaagcatagatgccttagaaccaaatctgtccctccaacccatcccaccaaattctacctgaaatctcaccacctggagcttcatctctgtcttctgagcttatgagctctttttttttttttttttttttttttttagatggagtctcgctctgtcactaggctggagtacagtggcacaatcttggctcactgcaacctccgcctcccgggttcaagcgattctcctgcctcagcctcccgagtagctgggactacaggcgtgcaccaaccacgcccagctaatttttgtatttttagtagagatggggtttcaccatgttggccaggatagtcttgatctcttgaccttgtgatccacccgccttggcctcccaaagtgctggaattacagacatgaaccaccgcacctggcatgagctcttttaaaataaagggtaatagctaagctgctaccagccatttataaccaacagcaaattaagactctgagggcacctgtaatagtgtcactaaagggaaaagcaagccaagtaaatcccaaaggcatacgtcagcctatgtccctactttgcttaggtcctcacatgtcttaaagagctttcagagcagcttggctaaacattgtgaaggaaactggccaagaaaaagtttggagggtttgtgtgtacatatacatatgtatactcacacacacccgtgtacatgcacatgctttttcttagaatacaaaggataaaggctaaactgttaccaaccatttatatcatatacatatatatatagagagagagtaggtgttattatagacagaaggcagaaaggatttggaaaataggataaaattagttacatgaccttttctatttttctttttgtttcttttttttttaagagatgagatctcactctgctgtccaggctggactgcagtggtgcgatcatagctcactgcagcgtcaaacttctggacttaagctatcctccgacctcagcctctcaaatagctgggaataaaagttcatgccactgtgcctagcattattattattttttttttttggtagagaaagagtctcactatgttgcttaggctggtcttgaactgctggcttcatgtgattcttcccactcagtctcccaaagtgttgggattacaggtgtgaaccaccgtgtccgtcctattctgtttttcttaagtgtcactgggaaacatggtcttccaatcaaattggcagtttaaccttggcttgaatgcaaatatgttgttattatggtccaataggtggtaactcgcacttgtagaatgagccattgcgtgtggaggctagagtcttaaactgagactcagtttctgggtaaattgaccattggaaggaggtgttgtgggttaggggctggtttattattcaggtggtcatgattatactcaaagaaaagttgttaaagttctttttatcctttacgtcctttacgtcaatggaataaagagcacactcaatgtatgcaggcagtctcacccatttagagctagaatcccaagccagaggaaggaaatcacaatagcctacaggggtggatggtgaggcctggattcaggggccatttcttgtgtcttagtcatgactttgggccaaatgggcactggatgtgtgctgagatgagctgtgctccctggagctgctttctgtaggagcaggactgtggtgagcatcgtttcctctgcagggccttctgagggaggagtttcttctaccctggaagtcagcttctgcttctcttcatcttgctggcatcttctctaccacaatggttattagtgtctttaatcttcaatcccatgggaagaaagagctgttatctctcttcccataaaggacactcagtcacctaagacatttctctgtagttgaacatagcttagttctcactcacagaatgacatttgaatagttctaaaggctcattgcaaacatgagcaccctacggtgttacaaagtccctgtggattggctggcatggctctgctgatagggctgagctcacctacgtgactctaatctgcgtgttgcctgagtccactcttgtttaccctgcactaacaggctaaccatgatgctgtctctttctggcaatgggagaggtacaagagggctgagcagaaacaaggcctaggctcagactgcccacaagccatctgccaaaccaagtcaatgagcaagcccaaaaccaagggaagagacagccagccaacttttagtggaaggaacacagatcagggaagggtgaagaatggggatgaataattcagttttccaggagcatgattgttgaattgaaaactgcaagcattcaggaaaatggaccggcattagggaaactacagaaaagacatttaaaaagaaagaggactggctgggcacagtggctcatgcctgtaatcccagcacttagggagaccgaggcaggtggatcacccgaggtcaggagttcaagaccagcctgctcaacatggcaaaaccccatctctactaaaaatacaaaaattagatgagtgtggtgatggtcgcctgcaatcccagctacttgggaggttgaggcacgagaatcgcttgaacccgggaagcggaggttgcagtgagctgagatcatgccactgcactccagcctggcaacagagtgagactacatttcaaagaataaaaataaaaataaagaggactaactaaaacaatgcaagaatgcagagagaaaggaagaagagagtaagagagaatatgagtgacttcaagatcaaatttgcgatctgatctttatataataggaatcttgaaaactataagatcagatgcagaaccattaaataaaggcattttaagggaaatcttcattactcaaggcaaaacattaatctgtagatctttagatttgggccccctagtctaagtcacccccagcaatcaattagattctcctaaagagatacataaactggttgcaaactataaagtatattagtacagttgtgccctgaaggtattttcgtccttgttgttgaactaagaatagcttgaagacactgaaggaggaatagagaatagtaaccaaagaacaaggaacatttctacaaagaaagactaagggaaattgggccatttagtttagataacaaaaggataatggtatcataactcagaacttcaagtgtatgtaggatctaggccatgtcttaattctttatgtgcaggccattttgaatatggcaaagacttcaaataaagcatgcaaatttctacttagatgtctatttccctagatacctcctagaagaaagaacataatcaccttttaattcttattctgtgattctttacagtgccagtaactgtacaagaagttccaggtttacagacatgtttttttccaaaatgttatttataaattggtggtggtttggaagggcgaatgttgttcctctgccagaattattatatgtggtgcttagcttttgagggcagcccacgaagaaggaaggaatggaggaaggaaggatggaaaaatgtaactagaatattaaaccctgggcattagaatcacttgggaaggtttttaaaaataagaattaccaggcctcattctaggaaatttggatttagtgatccaagtaaggagtcctgtaatctgttttttaaaagggtgttccagataattctgttgtatggtcaggttcaagaatgattgcagtaaatggaaaaaaggatagaccataaatgaaatcccattttaatacctagaaaccccccaaggagagtgggaagtaaatcatgtttataagaaaactggcttcacacacaaggataaaggacaacccaacccttgattcagactgtttctgagccttcctactttgacccaaggatatgtgaaacctgctttggggattcctgtaggtgagagtagctctggcttagagctgaagtctctcctccataggccccacagtagagctaagctttcatttgaagtggattagaaacagccttggtttaccaggctaaagatgatccaggtcaggaaaactgtgtgctttaccaaaggccagaaaattctaccattcttccaagatttcttgctaaaattcaaagtaatgtggtcttgaaggggtgacaccaaagcagctgcaaaggaagaggaaaacccggctgccacagtggagaaatagattgtcattcttttgcacagcttttccctgggtaatgtcaggattatatttttggctccctggaaaccagaattaaaataggctaaataagattggaattgttgaaagcaaaatctgtagacgtttccttttttgaattttttgaatgtccacatcttctgtatgctttgcttctttttggagtgacgtattgagaaagcccaagagattgtttctggcttgggcccattgccagccattgtccgtgccattattgtgtgtggtgggtccctggaggccacatgtggacctcgggttgatactttcggagattgtaggtagttcgagccacactagccctgtttacttcatgtctgccccaagcatcaagtcttgttgtttaccttgtcactttcccacttaagattctctttcatttcactgggttttactaaagtgtttgaaatacagggtttttaacttcctttgattagtgagaaatatggggaaaatttatctcccaaccttatcagttgggggcagaccaaccccagtgaagatgagaaacttcatggagtattaaatgaaaatgggatgagctgtcacaaagccaggatgttaattctagctctgctgatcatttgctgtgtgaccttgggcaagtcttttgctctcttcagtctcagtttcctcatatcttcagtgagccatctctcgggatcttccagctctggtattctgagtttctctaatttgaggagttggttagagatctcttttctcaacagtgtacctgttccgagaaatgttactgttatagaaggaagtggttttggaaacgggtcagagtggaggaaagaggttgagttctcaaaaaactaaaggctaggtataagtaactgattcatcacagagatgactaattcatcagaacagctgtctgttctaaaatatgtcacatcaaatattcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaacactccacagtggcattccacatctgtgcacttccagccggggtccccaccccacgttcagccacatttgcagcccaattattgtttccattcttttgtttccttccaaaataaaactatatatgctatgtatacagtaaactatatagtagtgtctctatattgtgtaatatttcctgttttgtcactcccttctgggtagcggcctagcttttctgcctccatttaattcattaattttctaatttaagccttgtaatactcccatgaggtagtgatgatgatgatgatgatgaagagagaagagaagcacaggaggtgaagtaacttgctgcccccccctaaaaaaattcaatggaaggacatacaagatgaatgaaaaataattttaaaaaagtgaaagagcaagtatttgaactcaactctgcctaattctaaagcatgttctcaaaaatcccaacagaagttgttattttaagctaaatttttttgagacctctgatattgagtgaaattacactaacgtgcacctcgtgatgtaggaggagggacaggtaatgtgattctccctcctcaacctccacacatgcttcttcagaaggcggtgcatcagacgcaccatgactctggaggtgccggtcttcagcctattgtgggtggtcatcatgatggtgagactgcccccttcaggttctttcatgaagtgcaggtttcattttgggcttggctcctttctgtctcttttggaagccctttgttcctgattgcactttctagcctgtgtacagtctaaacctctgcgggaaacagtgtgtgcttctgaaaagggctccagcatagcaaactcactagaaagccggacctcagagcttgaccaaacttggctggagtcctagttctgtatttacaagttgtttgatcttggacaagccatgtaaactctctggacttaagtgtcctcgcctgtacattggggaaaactatacccaccttgcagtgctgttgtaatgtgtagaggtcaggtgtgtttgtgaagtgccaagaacagcaggttgtcagtaagaatagtgctgttggctgggcactgtggctcatgcctgtaatcccagcactttgggaggctgagacagatggatcacctgaggtcaggagtccgagaccagcctggccaacatggtgaaacctcttctctactaaaaatacaaaaaattagccaggcgtggttgcaggcgcttgtaatcccagctactcaggaggctgaggcaggaaaatcacttgaacccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtgagtggctgtcttgagtattgcaagatgtttagtagcatccctggcctctacctagtggcttccaggggcaccattgccctttcccagtcatgataataaaacatgtctccagacattgctgaatgttgccttgggggacaaaatctctccaagttgagaactactgctcaaaagcctggcattatgtgtattgatactaagatgagaatctcaccaccgagtagttccagaatacagaaccctaaaaagatttatgaagataacattagtgattctcagtgcaaaatgacaaagtgtttcagttacttgaaaataaaaggcttctcttatgcactgagccatgaaagtctgttcagagttaaaaagaaatagttgcttttttggtttttgcattcagtattgtgctgcttttgcaaaggcaataattttatgacagttcataaaaccatggaatcttagagtatgcataactgacatgttatgcggatcaactcctatctgattcttgaatttgcaatgaacgtaatgagtgggagtgaaaaaacagtctctccccaaagcctgaaagtgacaggaaactcatttacttgcaaaataaaacccaagtatatactggaacaactctaattattacagaggatcctcctttgggatgaaagttttgttccctgcagctcctaccctctctctggtccctgccctatcctccaaggaccacacagaaaaagccctcttcactgactgaaaaaatctagatgcttagggtttgtggtcagctttgcaagctggcacaggtaagggaggaaacactctgaaattgcagtgcagcatttcaacatttcatgtgtgttacttagcaacaatagcaggaggcctgccagatgtaccagagtcatcgtgcctcgctcaggttttgtaggatccattataatcatctcattattggtctggcaaattgggtttatagtgcccagaactatgaaaatagtagttgaatttcttccatacactgaggccatgtaagagccatatttgggaaatacatgcatttcccagccctcagaacaattgctgcaatggaaggaattctgcaaagtcaacttttttggtagccagttccaggctttttggcctatgattgccacaccccaagttttctctctacaaaaagctttgataatagtctttttccaattttaggtcaccttgcatagcccctctggcttgtaacgtggtcatttccaaccgttctacattcttgatgaaatgaaaacagcaagcttcctgttgacatactcttccacagttttcatgaattatgcattttgaaggcagcagacaagatggtgtctcagtcctttccagcgattctccagcatggaggtcttatttggtacatccatcacaagggcccggagccaagatgatctcttgagcacaatccccacttcgtgtttccccttttcactgtgtaggccacagggaagagtactgtgggacccgaggctgcttgatactcatcaaggcccgcttcctccagccttcctagcttctctttccctcaggtctaggcgtggagccctccaggacagcgaacgggtgataaaatatacaaactgtctctgattatgggattttggctccttagccaatgcatgcaaggatggtagaaaaaacactcatcttccttctactatcctaaaagcaacttccgacatcaagaatttttttggatctctcatccaaaggtataaaccttaacagtgggaaattcagaccaggtgagaggaaagggttacacactaagagatgacttaggtttgggtagtttcatcaggagaggtctgcctgcatcctggttcctgtccttgttttgggaaactctttttagcatacttggagtacatattcagttaaacttgcaaagtgaagaatcagagaatggaggcctaaatgtgattcacctgaggccacacgcagagtgaggagataccagtgtgcttcctgcagaagcatctcccacatctctgccaagcctttttatctcctttgaaacagaatctctaatggaataaaccactccagggatcctagagtcttgtgtttgttcctcctatgcagaaaggcaaaggaaaaaattaaataatatctgaataccgcccagtgcacagagagtacctgtgaaattacagggacattcagccagcaaagaatgtccccctggccagggtgcctggaggaaggcttttaagcattaccatgctgtacagcatggggctgccagcttgaccagattctagctggaaggatcaggcatctttaaagaccggtagcattcagggccattgctgggccacatggctcctttgtgcaattagaaaatgcagttccacagggtaggcagcacttagaaagccactggctggacttcacctccctttgttcccttggctagcatcttgggcaacaacattctgtacaagcatgcaccatggccctgctggcttcttggtctccacgtgcctccttcttgttggtcattaaggttatgccattttcccccattattaagtaatgtcaggtaaggtctgaggagatggagatgaagacttttacaggtcgcaggggaacactgacatgtcactcatcattttgtgtgtgtgtgtgtgtgagacagagtctcactcactctgtagccaggctggagtgcattggcagaatctcagctcactgcaacctcccatctcctggattcaagcgattctctcctgtctcagcctcctgaataattgggattacaggcacccgccaccatgccaggctgatgtttgtatttttcgtaatgatggggttccaccatgttagccaggctggctttgaactcctgacctcaagcgatctgctcaccttggcctcccaaagtgctgggattacaggtgtgaatccccgtgcctggccatcacccatcaatttttaaatggtggagtagctcccatgatggatgttatgaaagggtctatgggtgcatatgaaagggagtggtcattactactcagtccaggtaaaactccctggatggagggtgaagacaatgtggtttgagttgttaggtaaatgtttccttatcatttttcattatatgttacatttacattctgttcatccctaagatataactccttaagattacatctctcagatgtaaactccaccagagtaaggactgtcttggttacctactgtgttcatttcctgagactgatgtaacaaatttctacacgttcgtggcttaaaacagctccagaggccagaagtccaaaatcaagatactggcagggctgtgctttccccagagcatctagaggcaaatccttccttgcctctctcagcttagtgggtccagacattccttggcttgtggctgtgtcgctctaatctctgcctttgtcttcacatgggcttctcctcttgtctctgtgtcttctcctttgtctctcataaagacccctatcattggatttagggccctcctaaataattcaggataatctcttctcaagatccttaaattaattacatctacacagacccttttatccacataaggtcatattcataggttctgggggttagggtgtggacatatctttctagggccatcattcagtgtactatatctgagtgcctagattactgttttacacctaggaggttgctcaataaatagttttcaatttaatttatatgtttcagccttagtttatccataagcttgccatgaggttcagaaaccatcatttatatccagagatggtataaggcagtggttaggggcatgaacatccgcgtaatacttgctgggttcaagttcagaatctctgcttgctgcctgtataatttgaggcaagttctttagcttctctctacttcagtttcttcttctataaaaagaaataataataataataaagatcaactttattggggaggggtgactattaagtcaagatatgcaaagagtacccagaactgtcttggactttgtgcccaataggttttggcttttattataaaaataaaagaatgatatgacaatgtacaatatataaacaatctcaaattgtttgattttatcagactccctctccactttcagaaacagctgagagggctgtcactgcactgagattagcatggcattccagaactcgggcccggtaagcatccaggtccaagggtgccttggaggggtacacctcacctttgcagtccagggcagaggaaggcagggaggctaggagtgcagcactgagagagcagtggccactgccttacaaggccaagaagcgtcccatctccccaacaactgtcaggttccttcctgccctgggaacagctctaatctgtctgtttaccacctacctgccagccttcagcaggaattccaggactgctgggcctatcagctgaagtagaggatgaaaaagaacaaatccaaaggcagaagaaataggacaatatgatagatggatttgacaagaatccagaccaattgtgggcagaccaagttgaaaagcgtgagaggctagagttatctcagcaggggtttcgttttgttttgttttgtttttgagacagtctcactctgtcgcccaggctgaaatgcattggtgtgatcttagctcactgcaacctctgcctcctgggttcaagtgattctctcgtgccttagcctccagagtagctgggattacagttgtgtgccaccacacccagctaatttttgtattaacaccgtagagatggggtttcaccgtgttggccagggtagttttgaactcctgagctcaagtgatccatctacctcagcctcccaaagtgctgggattacaggcatgaggactgtacccaaccatctcagcagttattttaaaaaatgtttagccttctgatgagaacacgtggacacgtggtgcggacaacaaacactggggccagtcgagggggctgcggggagagagatcatcaggaagagtagctaacacttaggtggtgggttgatctgtgcagcaagccaccatggtacatgttcatctctgtaacaaacctgcacatcctgcacgtgtaccccagactttaaaataaaagttgaaggaaaaaagttcacttttctgctttccagttgcttatttaaaaaaaaaaaaaaaaaaaaagaagcatctggctgggtgtggtggctcatgcctgtaatcccagcacttcgggaggccgaggcaggtggatcacctgaggtcaggagtttgagcccagcctggtcaacatgatgaaaccccgtctctactaaaaatacaaaaaattagctgggcatggtggcgggcacctataatcccagctattcggaaggctgaggcagggagaactgcttgaacccaggaggcagaggttgcagtcagccaagatcgcaccattgcactccagcctgggcaacagagcgagactccatctcaaaaaacaaacaaacaaacaaaaatgcatctaagttgtctgagtgatgtcctgctcaagtccataagggacttgctttattacagaaaagtggccaaacccagtaatattgaaagtatggtccagggactgcttctggtcaggcaactgtttattaccagtctgtgacaaagacagaaattgccagtaaggtgtttagaaactttaatagcaatatgatatcccaatgggtgatcaatggacccatcttactgaatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcagctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaagaaaaagaaaaagaaaaagaaaccattagatctcatgagaactcactatcacgagaacagtatgagggtaaccactcccatgattcaattacctccccaccaggtccctcccatgacacatggggattatgggaactataattcaagatgagatttggatggggacacaacgaaaccatatcaaatattaatagagtctggcagggaggaagcatgacttcatactggtggtgagtcagaaggggcatcttcatattttaaggaaggtggcacttagattccaagtgcgtcctgtgtgcagtggagtcatatgcagctctaataaagaacattattcaggccaggcatagtggctcatgcctgtagtcccagtttgttggcagcctgaggcgtgaagattgcttgagcccaggagttcaagaccagcctgggcaacatagtgagacctcatctctacaaaaaatacaaaaattagccaagcatggtggtacatgcctgtcgtcccagctactcgggaggctgaggcgggaggatcacttaagtccaggagtttgagtctgcagtgagctatgatcatgccagtgcactccagcctggacaacagagcgaggccctgtctccaaaaaataattaattatttaatttaaatgttcgaaagaacattatgcagatgcttctcaggcttctcttcagatggcaaaatctcactggttttcaaatatcctaactgaaatgttcagttccagctatcttttgcttcatccagtaattagtttcaagtttttttttgcctctttttagatatgaatcccatgctaggtaacaaattatagtgacaggaaaatgtggatttttccataaagtttaaatattcaccactcaaccttttagcagaaagctctgggaccaacctagcataagtatagagttgagggttaagagtaagcattcttcccttcgtcacttatgtggccttgaaccaattagttaagattttgtgcctcattttcctcatctgcaaaatggaaataatcataaggtatactttggggattagtgtgaggggcaaatgagttaacatgtataaattgcttaaaatagtatttggcagccaggcttggtggctcatgcctgtaataccagcactttgggaggctgaggcaggtggatcacgagttctggagttcaagaccagcctggctaagatggtgaaaccccatctctactaaaaatacaaaaattagccgggcatggtggcgggtgcctgtaatcccagctactcgggaggctgagacagagaattgcgtgaaccccggaggcagaggttgcagtgagccaagattgcatcactgcactccagcctgggcaacagagggagactccatctcaaaaagaaaaaaaaaatagtatttgacaatgacgatagctgctgttattatcatgacccaaatgctatatttgcttcaagcaaatggaatgattctcagaccaaattttttcaccaggcatttattagaaggaggtttcatgtaattctgaattatgctccgaatcatattcacttcattcaatatgaaaagcaagtatagatttacagtttaattgttttgagacagggcaggattcctaatcacatttttagaaatgacttttgtgtctcatattgttcatctcctctatcctctcaccaagattccactgtgtttcataccagcttgttcagttgaacaaggtggagaagcccatttactgtttggattaaatttttttatcaccagtgtatgaggatttgcattaaataaattataggtaattacattaacaaaccaagaagacttacagttaaagagggcaaaaatataatttacttaactgctctatgaaatctatttgtggatttctctcttctcaaaggagaattaatcagagaacaactttgttgttattgttgttgttgtcgtttaagaaaaaaaagaaagaatgaatgaaagatcacatagtagcagtggtaccctattcaccttgcaacagttgtactctgcgcacctgccccaggttatagcaacatcaaggtcaagctcccaatatttcaagtacaaataagacttcacctgtgcacaaacatgtgcttacacacttccatcctcctgaattttctttccagactgttttacagataaggaagcagctctcaaaagacctctctcagacatttgaaaacacattttttttcagagtgctaaattcatgcttcttattttatatatgttagaaataaacacataaataataaacagtcttgcctggactggttcatgttcaattcataggcactgagtattctttattaggacatactcactattgtttgttgaattattgcacttttaagaaatcaatctgaagattaaacattaggagtctcgataaaaaacaagtctctatactttatgaagatcttaggaatttctaactgactttggaacagccatttgttaaaaaacactttcccatcccaaactccactgactccatttttcttctgcactaactctcccttcctcctcccccatatttggagcagcgtctctatgtcccattcactctcctacacctgccaaatcaccagtgactatttaggggctaagtgcaaaggagacttctaaatcctcactttcatcaactgttgagcagcaacggaagctgctgaatgctccctatttcttcttgaaacacactctctccttgtttacttgagatgacactatccttcctctgtccatctgggaaatattggtgctttgaggttcttgacttggggctcctttcttcacttctcccattctctgagtgacattgtctgttcccatggcttctgaaatataggcattctttgatctaattttttctccagacctacccatatagccaactgccccctaaccatatccatttggatccccccagacacctataactcagcatgctaaaaattcattagtcattactttctctgattgattccttttcattgattcttaatctcattgaaaaacatcaccatgcacccagttgcccaagtctgaaatcaggacattgtccttgcttcttttcaccctttcaaatcctctatctaatcagtaattttatataataaaaggattcttgattccttctacactttttctttcccacttccatgacagtagtccaggccaccattatctttcatggggattgatgcaagagcttctcacctagtctcccttcccctagtgttgtgtccttctgacctaacctctgccacccagcagaagtatctttcaaagttcatatttgatgatgctactctccagcttcaaaccctttacctgttttccttggactataagataaagttcaacttccttaatttagcttagagagtcttttatgatgtgacctcctcttacttctctggccttgtctctcataattgtgtcattccattgctgaccactccagcaactacctgccattccttggatgtaccaagctctgtctgtgtcccgttctttggatctactgtcccttctccaaggaacgttcttcagctgctctttatgtggttaactcctactgaaccatcaagtctcagctgagataccactttccctgagccctaaaccctggtttaatgtttcctgtgggcatatttaccttagagcttactgtgtcatagtacattggaagctgatttttttctctatcctcctctagcctcagctgcctaggggtaaacacactacagtgttcacccttgtattctcagatcttagtacactgccaggctcaatgggttttcaaacatatttacataaagaaagaaaacaatgacaaaagtgcagatgacatgcccatggatactctggacataaatgcttgtaatatttctctctgtaagcgtttccagtgggaagttcagcttttgtctcaattactctgattggcatgcaatcatgacaagaaactaaaggaaggagattgttttcttgacatttactgagaagtatagacaagtactgccatgaacaaacattcttgctaacaattcttgctctaaattggttgatataacatccacttgagtcaaaatgattaagtaggtatccattgagtgtcatgcatcgcaatggcaaagcattggagttacagaaaataagtaaaatcatctcccttgctcttacagatctgacagtctaggcacccaatagatgggtaaacaagtactgagagatgtcatacttgtcctcaagatagtagaaattcaagaaagtagtgaccatggaggaccttaggatttgggcttttaccccagtggtgtttggctgagttaatctttctaaaatgtattcatcattcaatcaagtgcttcttctggaggccaagcataattagagatacagagatgaaaatgacagtcattaccctcacaagacctataatctacccaataataatgggaggcaagcctttagagttttttaatttggagttttcagagatttcctgaagcttctggactgacgtttctattgtacttgagtcccatcatttgacattagaagatctccttccaagaaatatttcttaccaccaaaagacagttaactttgacttcagacagaacattctggtctgcacccagaacctttaatacctgaatcttttaaatcagtgatggtctcttcttctaaaaagtaaaaggtaaatcaaattcagtatgtctcaattaattggaagggagtttcaagctcataggaaatgaactacgaagccatgttgggatatgaactgaatggttgctattgagatggagcaaatgtacctggatatcattaggtggaaccagactggaaaatgggggtccttccttgacctcagtgaagatttggccctttcagcctcaagtagtatcccagctccagaactggacctgagttactggataatgctgtcattaggaaactgtgaccacctaggagttggactgctaaatgggcaatgtcagcaggttgttacagatactctatgcagaccaagcttatttggctcttctcagctcagccacctgttgtaaacagctgagaggggcttagctccacgtggaggttgtcactatctctggtatgttgtctctccctgggaacggacatgagtgtggaaacagggaggacacagttgattcctgctttcactgagtcactctgtccattaggagaaacagtccaggcatggccagccaaagggaggttcttcgcaggatcttctgtctctttgaagatgggataatctcaggcctaaccacagaagcagttctggagaagagtcagaatagcagattggaaacagctcacaggggcctctgaatgctaagtggagggacttagaatttatcccagaggccacagaacactattagaagtttcagaggtataataaaggccgttgtgaggttaggatgctggttcaatgtcacaattagagcaaggcaggaggtagagaagtcaagggcagactgggaaccagctgggcaggccactcattttggttgaatttggcaagactgaggaagacaatctaccaatagaggatggatgagaacaccagaaagcaaataaaacaagtcattcaaaaatcccaagatcatcgtggctgggccagagaaagaatcagacagaagcagcgcacggctctggagagttgcagggagaagcattgctgcatccgctgtctccttttctttttctttttttaaatatcagcaatatcttggatctgaatagagttctatcacagattagggtttctctttccccagggttcccaaagactgagcaggatcttattacagatgcagcgaaaagggtacgtttttcagtatcagactgacctcatctgaatctcagcctcacatctcattaactacatgggaccttgggcaagctacttcacccatctgcaaagtgggaatcaatgatatgtatctcatttggctgttgtaaatcttaatcaagttaatatatgtaaagtgtctcatcagtgcctagcgcatagtgagttcccagcttctatagcaccctttcatctttctctccttacagcatcagagagcttgtcctctgtggctcccgtttctctctggccagaggcagagcctccatgggagcatgggagggatataatcagaacagcagcattctttcattatgacgtcaattcagccatccctcaatttactgagcccctgaaaggccatacagtgagccatcattgtaatgaagtaaaagtagctggatactccaggaagcccttctagtggcactttgttaggtgagatgtgtcagcattgacttcttttgtaagtgctacttctgttgaattcaatgcgttgaaaggtggaatgcattgatgaatgtattcagtgccttggccacttctcagttagcttttagagtagaggacctcatggccacatgacagagtctaactgtcagtttccagacatttactgtgcccttggccctgcttggactttggaaatccaaagatacatatgaccgacgcctgctctgggaggaattccctgtccatgtggaacacatctatgcccttctggtccaagtgagaagagaacatgaaggagcaagtgtgcatgcccataagtgccggtccctactcagttctcactcagtcccacagatacccaggtctactttatgtaggtccttgtgttggtttctggcattgctgagatgacagaggccccagtctctggagcctcagagatttcatggacacctttttctgcttgagctcatgagccagatatcactcctggcccaggtcactgggttaccagatgcacgggtgaaagagctgctcttgagcaaagggcctgggacacacatgccggagaagcatggtgagccagccgcagggaggaagagcactttgcaggagcatgctgtgcggggtcttgctgctgcttttcagaagcaggagagccatgagccttggggttcacatcagcaccgagactggcctttggtggcagggaggatatgcgtaccgggaggggttggccatactggaccacagggccactggttgggttgttcataattgatctttggggacacttactgcaacccatttattaggtgccccctctaaagtgatgatctcaatgaagatggttcacataggcccactacttctagaaggcccgaatccctggaccttcccaaccactttttctccctgttcctgggttacatggcttagctggatatttttgcacacagcattaagggcaagtgcactgttcctttgaaaacaacaagggaacaaggagttcagtgttgtggacatttaatgaactttctcctcctaagtacacaataccaaatcagcagaatcacagctgtctcctcccagctttacctaaattcccacatgtgctacctcagttagggaactatgacttcacctgccactagatggccctccatgtgcacataagccgctcccacatagcgaacttgcatcagattttctggatttttttttttttttttacatgtagacacacatgtgcatacacaatcttaacttttaccatccttgaagccaataatcaacactttagttttccttctggcattcaaatgatagaatgtattctcattctctggaaaatcagtttaacatcagaatctacagatattcctgaatattgtgggccacaaagcacatattaagatgaatttgaatttattctattaaatagtatgctttggtttatcttataaatgctgtatttaacagacttgtttctaaattaaatttttttaaagcactggaagagaaaggaagcacaaacatttgaatagtacttgctccatggaggcgggcagtgttctgaggtattttaaacattagctcatttaagcttcataactttgatgtaggtattccatatgcatcattataaccattttatagattgaggagaaaatcagattgcagcatgaaaggtgtttagattcccttttgccttcctgtcaattttcttacctataacatgggaataaaataatccctaattgctgtgaaaggatgttgtaaactctaaagcattacacaaatgttgttattattattatgacttgggtttcatgggaatataattttcttatgtgctcaggaggcttgtgatcattcattcattcacatgaaaacatttatgcaggtcccaggtcattgcctctgcatgagacgtctcataccgagatgcctgtactatttctaaaacaaatctagtctgtcttgaactctcttatagctgagggttccagggaagttgctgtgtgctttcagcaggtaattctcccttagtctcaggatttagaaatgatggatgtggtaggacaacttcaggggtgggacctctgctgaacacagaggtggccggtgctgatttcacataagccaagccagcgggaagaggcaggctgttttttaaaattattattctggagcacgatgtactatctctgtatccaagagttcacatttcaagtggactatcagatcatctctgtgacagagggctttaattaaaagcataagtctctgggtggattttaagtggcattgtttttctttggacgttatgcaagccacttctgtgctgtaaaagggcttttaaaatttggcttaaggaaatttgctttacccctcaggctttgatccctgcgtgtgaatcattttgtatctggaggttccaatttgcagtctcctgggtgtaaggaaaattctaccctcacagaacattttggatttgaaaactgagaaatctgcatcattctcgacataatagctgttgtaaaatagaattagggctgttaagtctatagggataaagttcaccaaagaatattttaaactttagttttagttcctaaagtttttgtctccaactcccataataaatgtactgggacagtgacctacccactcaacacctgaagctcagtgttctctgcactcaggccaggtggactcagccatcgaggccattgtccctgtccagcctcccagggggcacgcatgagccagggccaggatacagatacttctgcctcaacaccatctgtaccaccagaaaagggccccaaaggcccttctcactgccatttgtaaggcaaaatgtctctattttatctaagacaggaaaaaggcagagagatgccagagagaatgcaacgactgtgcccgtgagaaaccaacagtgcagggtggcgatctacccgcagcacatgcaggatgcagcgttagatgctgactcagtttctcagccatacaggagaaaagtttcagcatttctcaaactccatgaccatccttcagtcggctaccccaagccccgttttgctgcagccgggtgagggcagtaatgcagctcagtaggttaaggggccaggctgtccttggacttcagatgatatcagttcagtccctgggacatcttaaattagggcctcaagcttcaaattcatgccttggccaacacgttaccataaatgatcacagggagaagaaacagtcaggccagggatggtggcaggttcctgtaatcccagcattttgggaggctgaggtgggaggatcacttgaggccaggagttcaagaccagcctgggaaacatagcgaaaccctgtctctactaaaaataaataaacaaataaacttttttacaaaaaagagaagaaatggtcagtttacgttgcatttccttcttttcctcaagaagaggtgccccgtggtgcctgggacagctgggccatcacatggaagtggctgagaggtgggctggaaagaagaggaaaatccagggctcccaccaaccccagccaatctctagtcactgggcaacctcaatctacttctggtcatagttttacaattttgcgggggtaggggggatggaatcttgctctgtcacccaggctggagtgcagtggtgcaatctcggctcactgcaacctccaactcctgggttcaagcaattctcctgcctcagcctccccagtagctgggattataggcctgtgccaccatgcctggctaatttttgtattttccgtagagacggggtttcatcatgttggccaggctggtcttgaactcctgacttcaagcgatccacctgcctcagcctcccaaagtgctgagattacaggcatgagccactgtgcccagcaatagttttacactttaatattgccaactttttttcagcccagcctgtgcagccacacaaatgcaaaaaggttagcttaggaagttgtcaacatcattatactataaaaatcaataaatggaaccttcttgcttcccacagtagtccatgctaagcttggcttcaccatcccttgcttggacaactcctaattgttctttatggtttcactctgtaaccctttcatacatccaaatccgttcttttcacatctgtccacatggtctttctagaacatagccaatcctatcactgacttaaagcaaacacataaacaggcagacagacaaacaagaaactcaaatggctttctgttactttccgaatcagactcattagtgtggcattcaagagccatcatatcctgagcctgatcctccctgtcactttctttccctcatgagtgcactcagataggccagtcctacagaggtcctcattcactcacttgagcctgccttgcacatttctgcatcaaagcccctttgtccatgttatcatcctagcttgaaatgctgtctgaacacctctatgccttgatcatttttctcttcaagatcctactgacatgttccaacctcctgaaatcctgccctgcctccccacaagcagagttactcagactctcttctttgcattcctgcagcattttggtcttgcaatttgagctctactgtgcactgcattgtaactattcatatagcttcctccctcatgagatgatgaatttctcaaaagtagagactgggcagctgttactgaatatagcccaacacttgcttgataatgctcgataaacatgaatgagtgacccagaacatttcaaacttcccttccaagacctgaaagactcatatttctgggtgttttaagctctgtgatttctgctctggtcacctgggccaggaactgcctgcctctattttcatttcaggcctttctctctctgccagatgccttgatctctgagccgagtataccttgacccaaagccatgatgcagccctcagcttctgagaggaaggggtagggttcagtagttgcgcctctgagaacatgacagagaacaatagcaggaagcagccaagcgggaaacaatcagcccggcacaacccatgtggaggagcttcctgattggcttgatctggtgggagcaggaactcttacaataactctggaattatcccagtgggatgacaaatttctccactgaggagaagctgtcacctggtaatgtcaagcacggaaaacacagttagcaaaaaacaaaacaaaacccaagacaaagttctcttgaggaagagcagtttggatcagttggaagcctcccagccactgccatagcaccccatgccgacctccttcctagtctctgtttcaggtacaattaagtcgtcatctctaccttccggatagatatcattctgccgtccatggctcaaaggtcagaggtgctgtttattctttggtgtccttttgggtagtttagggaaatccatgctgtaggtgaccacaagagagaatgttcccttttagaactatattgattgagcacaggctgtgtgcaaatactcttctaggcactgtggatgccatagcaatacatgctgtttctgctttcatagagcagtgatttccaaatcctgtgtatcctatggaaagaccaagccaggcaaggggtggagtgacaggagctcccagtcagctttctccttaaaccacagcagctccctttgatcaagatgttggaaaagaaaaatctaccccaaaaagaggaaatgctgaaaacatttggattgggagtggtttcatttgctcttaggcaggacacactgcagggtagcagttaatattctaggctctagctacaagcagacctgggtttgaatcccagctctgccacttactggtggaaggtcataagttgcttgaactctctcaacctcaagttcttcatctgtcaagtgcgaataacagtagtagatattttaccaagtgcaaagaattgaataatgcttacaaaccatttagcatatcatctggcattgtctattacagtaaatgctcagtaaatgtgaactattttacccctgttgtttgacgttaattttttttcaatgaatgactcattgagatactaactcatgcgtcttgaaaacactaccagtctctccagagtaacctccaatatggacaacaggcaaaaatatggtgattattcccagtttgggcatttgtgaaagatgtggctgaggctgtatggatgcgtgtgcacacacacacacacacacacacacacacagaggccgatgggaaaatctaactcagcaggaaagctatcacagagcgctggatttaggcacaatgagtaaacagggatttggaagagaggaatgcaccacataaacaattttcacaatctggtatgaaagcccagatgcttcctgcatgaaggggtgaactcagagagcgtcacagggcaaaatgaagtaaatgctgagactgtccatcattctggcccaattcctacatatctgtgcatcttctacttatggttttatttaggtgagaataaataagagtacctcatagtagataagaatagtacattacacacgcgcgcacgcacacacacacacacacacctggggttagatgaaattgtatatttggggaacttggggtaaagagtacagagccacacagcagttaccttctgcatcctcctgcttcagagaaagcaaataagaccagtttctttttaatctgttgtttttactaagtccaggattgatgttaatttgaatttgttcttttaagattcatttttgactgaaagaactgagccggaaggtctgcttgaggctacttccagttgagaaacaatttatgtgttcattgagacagtcatttactcaaccaacacttactgagaactttcaatgaggcaggttccttgctagatacaggccagctagatgctagaagccatcatcaaaggaagatgaaaaagtgatggtaattatcctctagaggtttgtaaactggagttagggaagggagcccaaaatccatgaatgagtgattaaaatacagtgggataaagttggtggtagaaatatgtccatgagatatggcagcaaagaagaagagcaccttcatgggaaaagtccaaagaagacttccataaagagatgatacctgagcagatgctttaaaaatgagtagtaattacccatgggaaggggaagagagagaacaagggcaatccaggcagaggggtggtatgagcaaagtcattgagccaaacaaggaaatcttcatttctgcaggtaaatgagaggctgggagtgtgtcatatccatgagctttagcagagagcccatgaggggttttcagcaggggagtgctattgtggtgtgtctaggcacattctggattttagggtgatggggctgcatagaagcagagagattggttagaaggttgttgcaggcatttaggagagagcctatactagggctgaagagaagcagctatgaaaagagatttgtggggcaaattggcttggtggctaataagacacttagttgacctggtgactaataagatacatgtacgtgatgatagtaagcgagggtcaagccagaggtgaagacaacatctaggtttccctcctaagtagaatggattaacggtggtaccagcatctgagctagagaatagggaggagcagctctatggagaaagatgagtttggtcctgtatatgttgtgtatgtggaccatccgggtggagacattcaaaatacaattgtacataaaggctggagttcaggagagatgctgaagatatagtttggatagatttaagcatgttcggtaggaattaaagcatgaggctggacatgagtagccaagaattaaatgttaatcaataagaacaataaaacaaataaacctttagtggtagagtaggagaagaggtgcccatatggagaacatggcgtcatggtctcttcatcatggaggaagagtgatcaaatatgtttttaaaaacgaagaagtcaaacagatccacaccaaagagggtccgctggacgtggcagtcatggacttgactaggagcagacgcagcagggcatgagggcagagggactgaggctgaggcatggacttgactaaaagcagatgcagcagggcggtgagggcagagggactgaggctgaggcatggacttgactaggagcagacgcagcagggcggtgagtgcagagggactgaggctgaggaggggtcaggatgtgaggatgttgaggcagtaagagatgactggccttggggaagtctggaagagggattcagcagcaactagaacaggatgcagggtcaagagaagttcacttatttttagtatggaaagagataattcttgtttattgactagcaggaaggaggcatcttggagagaggtgaagacacaggggagaggggatagttaatggggtatcctcccagatcagtctgcacaagctcaggtgcaggggtggaggcgctggccttcaacagacagtctgagtcagaggctggaggtcagaaggtgtggctggatgggactttttctcttcctagaaaaaagggacatttttagggggaaaaggagggggtttaagctattgagaaaagtactgctttgaaatgaaataatctcactttcctgtaatcaaaactctttatttctgatgaaacagactcaaataagaatcacaacaaagaaatcagtgctcagctcaagcctggaaatgatttcctacacggaaatccacttgcacagattctgatagtgtgagtcatgtgattccagatggagtaaatacacatgaaaaggagagaaaagctggtgtctccatgggctgaagcacacttatggagagagaaattttcatttatttgtatttgggcttcaatatgattacatcaccatcaataatgaaaagtgctgccatgtcccagctgtatacttagatcaagatataaatcagtccaatattgttcttttttctcactgaatatctaaatttgtatatttgaggggaaagtagaaaaaccaagccaagattttaaaaattacatttactatcaccatctccaagttacattcactatagaatcctttagaagcatgttcttgggtagctttgctttttatgcactcaacaaatatttattgagcatctgtatgtacagggaagaatgtgaggtacagtaacacaaaatatatagtcctatctcttaataagcctgcacttgggagaaggtatagatagggttgggaaggataaatatatttttaacactctaatacaaggcagagtgtaccaaaagttagaaatgctgtggagaatcagaatgaatgaacataccaggctgggttggggggctgggggaattatggaaaacattcctaaagagatgtaatttgatttgggcttttattatgatatctgttttcagacaatggagttgagagtggggagtccttcctggctttgtcaggagcagtttgaggtcttggctgaagacaggaaggcataaggctggaaaggggtgggagcagaacatggagggtgtgaacttccagccgaagaagtttgatggggtttgggaaggaggtgagagggagccaccaggaaaggatgtgagctggacctttggaattcttaaagggacccttgtcttctctgccatatttctgtctcagggatgacgtgaggaaaaaaaaaaaagaggaggaaatgggcttgagtttccactgacaccttacagtcaaggaaggccctgttctttcataaggaaaagtggaaatcctctgtttacttaagggccattaacatgttttcatattaaaataccaaatgatctgccgtgactccagatagactcatctaaataaaaggaagctgtttccttacaaattgagtcacaaaggataaatatttgtggagtgccatagaaacaaatgcgctgtcttcctgaaatgtggaaaatgaattttgtagcattgatttgcatgaaaacaatattcttcccagtgttctacctagaatattgaaatggaggtattaagatagatgatagataggacagatagattgctagagagctagattagatagatagatagatagacagacagacagacagataagatagatagatcgatgaggttaaatattcttaggatggaagaaggggtcagataatcacatctcagacagatctggaattccaggcagcaggaactaatgaagtggtctcttcagagttttaccatgggacgaattcacccccgattagtttttattctttgagtcacttctctcaagacaaagatctttgggcaagagttcagttggcctagcttagatatgtttctactccttggccagggatgtgagccttctgaccaatagtttcaccaaatctacaaggaaccctagagagacttttttcccagtggaggagctggatgttgttcctaaaagaaaagggcagagggaccctgggcaggcaaaattttcagctgcctgccaccttagcccctgtccccacactcacttctgaaccacatgtgatcagtcttctcttcccaccacataactgaaacttcaaggtcatgggtgagctctatgttgttaagtcttatttataggagcgatcagctcgctgcactgcaaggctggaaaggtgtttaaaatgtatacttaggcatgtcttggctctttctgatataattcagctggcaaaggctctggcaggaagccagacggacacaaatagcgcaccaaagagatgctaagacatgggtgattataattgtgcaaggagtagaaacttctctgctgagactttggatgtggcagagatttggggagtagaaggggggcaaagcacagttccagccaaccccatttacaggcgttgattagcagtaatgaattcacaaccttgcaattgctcatttttttttcttctgctgctgagtcatggataagactctaagctctgattagctgtgatccctaattctcagcacaattctaagagcattccttcaaattcaacaatatgtggtaagtgtcttgtattaattaggattccatgtggatgcaaggaacagagacccacaataacagtggcttaaacaagatgcttatttctttttttttttttttttttgagacggagtctggctctgttgcccaggctggagtgcagtggcgcaatctcggctcactgcaagctccgcctcctgggttcatgccattctcctgcctcagcctcccgagttgctgggactacaggcgcccgccactacgcccagctaattttttgtatttttagtagagatggggtttcaccatgttagccaggatggtcttgatctcctgacctcgtgatccacccacctcggcctcccaaaatgctgggattacaggcgtgaaccaccgcgcccggccaagatgcttatttctcccttcaataaaaatccacaggtctgcagttatgtaaacatccacaggcatgcagttaagagctgtttggtggctgtgccctgtgaattccttagggacccagacctgttccactttaaccctaaagactgatccttgtcaacagtgaccaagatggcagtttgtgcctcagctgcatacatgtgcatttcaggcaaaggatgaagaaagaactggagaagaaagggctaaagaagattctaggagctgacatatagcactttcacttacatgcctttggccagagcatgtggctacaaaggatgctgagagatgtggcctttactctgtgtggccatatgcccagctcagccacaggaatgacattgctttgagagaaggggaggatggaaattgagcaacttagcagtcccctttccacttttacttgtgctgaattcataaacatgtgggcagctttcctctcctctgagcagcaaacacttcttctgaggttcttgttttggcaggttggccagacaggcaccccacttgactgctcaactatgaaactgcagttccagagaagagaacaggtctgaattaagcaccttaagccagttggtcagcatctccttttattcggagagtagttactgagattcaaacccatgtcaactgagtagcaatgtgtttggctatagggtagggcgtaaccctagtctatgtctctcaatagtgagttatttcataaaggctcagcccatcgtcaggaatatgctggtcttgcgtaagcctttttcagaagtgttcatagggtcctgagaattttgtgagcacttctttactgcttctcttgcctcctcttttagttggtgctgagttcactgcatgaagggtcccaggagtcctctttccccttggtttttctactcctttccttttctgctctttctaccacctcctactgctggacctctttgtatctgtactccaccatggaaaataagttttgtttgccccagatcttcccatttcccagagtggagcctttataattcatgatgtttactaaacttgatctctgccctttcaagggatggaactcagataatgaaagatatagggagggatacattgcttaaatctgtgagtgggcattacgatgggcctaagtgtcccaagagggattggcttgccatgggaggtggtgagctccccatgtgtggagaagttcaagaaggtgtgaaataatcgttgggtggaggacagttcaaggacttcatgtttctggagagcaattaagttcaatggcttctactcccagtctgacctgtgcttctgtgagcttgaaaaatatatattgtgttgcaatgtgcattctttagggaatgaaggtaaaagggcaagtggtcatgggaggatgtcaaggataggggcaaagggtactggttccccagccagaccaccagggtccaaattctggctgcacatcatctctgcaaccctggacaagtcagtgctctttctgtgtatccatccatctgtgtcatgggagttgcagatttttttacttcatgggatattgtgaagattaagtattataatgtacgtaaaacactcataacagttccaagcacacagtaagcactcaataatcctaatccttatgattattattgttacatatattactgtatctagcaaaaacaatattagaattgttagtattataataattattatcatcattgatggggaaggaaaaatgaagcccacctgagttcacagacaagaccctctccaaacagtaaaacaattaaaaaccaagttgtatttgtctgtgctcctttggattcaactgaccaacacccaggcaaagggaaaatatattggcttgctttttttttttgagatggaatcttgcactgtcgcccaggctagagtgaaatggcatgatctcggctcactgcaacctctgcctcccaggttcaagcgattctcctgcctcagcctcccatgtagctgggattataggcacctgccaccatgcccagctaatttttgtatttttagtagagacggagtttcaccacattggacaggctggtctgaaactcctgacctcaagtgatccacccaccttggcctcccaatgtattggcttttgtaagtaagaagggcaaaggagtagctgaggatctgggaagcaggaactggagattgaatggcacgggtccccagcagccagcatgctctgtcttcccttctctttgtttgggccttgcaggaaggtaggctctcagcagagccttgaaggccaggtatttgagagccaggcaagtgaagcagaaggagagcatgagtgagccattgggagtggggacggaaacggcgagaacctatccaaggcaccgtgctgagctatgaagctggagggcagcgcaggctgtgacccaaaaaggccacacaaggccacatgctcctgagtgacaggagggacatgtgatatgctgggccttggcccatgctgtctcctctgcctggctcattttctcctcttttctacctggtgaatgcatccttcaaggcccagttaattcatcatctactttgtcgagtttttctcaccacctgtatcagttgagaattgcattcagctatgatcacaacagaggcttaagcccataacaagcaatctggagccaggcattccagaagtggtgtactctttccatcgtgccctctgggacccaggcaatgtctctctttctgcacactcagacatactattgcccctgtggacataggattactgctctgcctatagcatcatatcccttgcagtaggtagaataatggacccccagagatgtccacaggctaagcctcagaacctgtgaatatggtaggttccatggcaaagaggaattaaaattacagatggaattagagtttccaaacagctgactttaaaatagggagatcagtatcctggattatctgggtacactttgtataaccacaagatccttaaatgtggaagagggaggcagaaatcagaaggaggggtggctgcagggaaggtcagagagatgcaacagtgctggttttgaagatggaggaagggacccacaaggcacggaacgtgggtgacctcagggagctgaaaagggcaaggaaatggattctcccctagagcctgcagaagggaacacaacgctgccagcaccttgattctagcctggcaaaccccgtgtcagacttctgacatacagaaatataagataataaatgtagattgttgtaagccactaagtttgttgtagttgttatagcaggaattggaaacgaatgcgtctctttagcaccaggtccctgtacctggcaggaaggaaggaaaggcaaatgtcacttaagccaacgctcctttccttttttttttttttttttttttgagacagggtctcactctgtcacccagactggagtacagtgttgtgatcatcactcactgcagtcttgaactcctgggctcaagtgatcttcccaccttagcctccagagtagctagaactaagggtatatgtcaccatgcccagctaactttttattatttgtagaggtgggggtcttgtcttgccacgttgctcaggctggtctcatcctcctgggctcaagcaatcctccagcctcagtctcccaaagtgctgggattacaggcatgagccaccgcacccagccctcctttcccttttagggagttgtgtggaagtcccttcggatcatttttacttacatctcattggccagagctgtcccatggccagctttatcttcagtggaagctaggatacataatttttttcaggtgggcatgttgccatccccaaccaaataaggattctgttagtttggaagagggggagaatagatattgagaagaccactcagcgtccccaccacacactcccaggcagaaccaactattctacagcatgttgttctttcctctattattgctatttttggtttgtattgtaatttatgtgttcacatggctgtttgcattacttgaccaagaagtctcatgagcagacactgtgtctgatttatttctccatccccagtgctcagcatagtgcctgatacagagaaggtgtttgcatgaagttagatggatgaatgtctaaataaactttgaaataagagcatgatcgatgcacttcccagagcgagagttcctttctgttttcttgtgaggatgatctattggggttaggtacattttataagaccatttggccatgattgcaacctcatctccagtaaattaaacctacacagctgcagtgtgtcacctttccttatggcttattacagtttgctttttgctcagaaggaactgagcaagcaggttagaggctgttatgtgcacctgccacagcctacggatcctcaattaaccttgcgtgtaaattacacttcctgcccattctttatttttagcacagcaacatctacttggctcttccagagaagactgcattagatttcagtcatgaaactacaaaacagtggcgtctgcagcctggctgggatgactgttgttaaccccatgacactctgttccttgcgaagctgctttgccccaggactcaggttttcctgagaaagagagcagcctggactgaccacaccctcagagcctggcccaaggccacatgtgaacttatagaaaaatctgctattggatctgacataaactctccatttccttcattcattgcatttgggttgaaactcagttgttgttatcacaaaggtttcatttcgttccttttttttctctccctctctcttcgttccttctcagttacacagtatcatgacccaaatctttagcacctgaaccatatagcgcagagccttgaaacccatagggccagggcaccccgtggagacaggccagccagtgggcatcaggtcgcagagaattcttaaccacttaaggttgcttcactggaagaagtgagttactgagagacagccattttcggttttagtcagccatttttatcacgatcttgtttgttttagaatcccctgtagtgcctagctcggagtccaaccaaacaagctccataaatgttgattttgaatttaaatagatgttggggtgctcccatttccccttcactagacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccattactcagagacaactatcactgacatttttctgttttttcagtcttaattctcatgaaggtgtgccctgtttccctccagatttctcagaggattcaggattagggaagggaggagagggtgccttatgttctttctaatcgtttagctttgggtattattgggatatatataaatacattaacacacatataaatatatgtgtatatatattatataactggcatatacattattgggatatatattagtaggatgtatatatatatatgtgtgtatacatatgtgtgtgtgtgtgtgtgtgtgtgtgtgtgtatatatgtaaaatgtatacacacttctatttgacctgtaccagttcattattaccacaataatgctaactaacacgccctcaaattcagtggcttaaacccaaagtcatttattcttgcccacacttctgtgagtaggctgggtatttgctgatctaggctgggcttagctgagtggctctaatttcaggtgcttctgaactatatagctgagagccctgaaacccatagggccagggcacactgtgcctatctatgggtttgcctcaggtctattccatgtgtgttctttctgtggtccaggctgaaggggcagcagctgcccagataagttattgtcttggcattggaaggggtgcaagaggacaagctcaactgggcaagcacttttcaagcctctgcttgtgtcttatctgctcacatcctattggctaaagcaggtcacatggctgcggccagtgccaagggactgggaagtgtaacccatctaccataagcctagagcaaatcacatggtcaagattgacatcagtggcttggggaagcatgtactcttcccatggaagtaagggaggaaggaagggaatatttttgagaataatgtaatcttttttttttttttttgagatggagtcacactctgttgcccaggctgaagtgcagtggtgcaatctgggctcgctgcagccttgcagcctctgtctcctgggttcaagcggttctcctgcctcagcctctagagtagttgggattacaggtgtgcaccaccatgcccagctaatttttgtatttttagtagagacgggctttcaccatgttgatcaggccagtcccaaactcctaacctcaggtatacgcctgcctcggcctcccaaagtgctgagattacaggcatgagtcatcgcaaccggcccaagaataatataatctactgcacaccctaaatatctgctaaagtactctgtactttgagatttaaatcaaatctgctcaggccaggtgtggtggctcatgcctgtaatcacacctcaaataaataaataaataaataaataaaacctgctcagagcccacctggttggtagtatcatccagtctacacagggaacctctagtccagagctcctctactcattgaattaattcagtttctggataatgtgactgtctcgtgtgttgttcctatttcacactcatgtctctttacttactccccccaaaataatttacacagatgtgtgtagaagattttgctgaacatctggaccagcaaagaagttttacatctttatgttcgtatctctagattggccagccccctctccataaattctctttgcgtctcgcccacacacagcctctcaagttaaagcttgctgaagaattcactcttgtctccaaaattctgaaagtcttatcttggctgggccacacctttgcgcaacttagctcagctttttaaattcattcaatgtaggtgtattgagcatttgtgccctctgtctgaggaatttataatctagtaggggaaattaataatgtatgttactatttggggccagaaaattctttgctgtagggtgccatccggtgcactgtgggatgtttaccagcatccctggcctctacccactatgtgccagtaacaccagtcccacccccttgagctttggacaaccaaaatatctctagacattgctgaatatcccctgagggacaagatcacctcagttgagagccactgctctaatatatggtagacttgataagacttctgataaaacaaaataatgtgctaagaaatgttcagagggaagcgatgttatttcctggcagtgaaatctgtgaacacctcatgacaggtggcatctgagctgagacttcaagaatggttgggagtttgagttgagtttcctagaggaggaaaagacatggggtacatgtgggcaaataagagtggctctatttgactaatgcatgaagtgaaataggcatgttgttagagtggagctgataggtactgggaggctagataccatggggacttataagctgtaggacttctacttttaccctgagtgaaatgacaaatatttcagagctgtgttcatttggaggaggttaatttggatatagggcttgccttcataacccaaagtaattgctgcaaagattatccctccagaggtcacttttctgacacccaggaaggaaacagaaaggccatctgaggggcacagtatgtcgctaaataaattcatgcctggatcttggtgttccttacctttcagaaaaccccactctgaactccttattttaggtctaagtctaatggccagttcccgagagcagattaaaagatggaaaaagagggccaggcacggtggctcacgcctgtagtctcagcactttgggagcctgaggcaggaggattgcttaagcccaggagttcaagacccacgcaggcaacatagtaagacctcacctctacaaaaaaaaattaaaaattagctgggcatggtggtgtgtgcctttagtcccagctccttgggaagctgaggtgggaggattgcttgagcccaagaggtagaggctgcagtgagctatgatcgtaccactacactccagcctgggtgacagagtgagactctatctcaaaaaaaaaaaaaaaaaaaaaaaaaaaaaaaaaaaagatggaaaaggaggaaggcaagggaggggacttatataggcagacacagactcagcagcaaagcttccagcacaacagaggggaaagagaccaaaagaaaaaatgaatgaatgagtgattgaatgaatgaaccaatgaataaattcagatcaaataattcaagaggcacagcaatctagagttttagcaagagaacatttatcccttcattcttcctgaagacattgctgcatatcagtgccatcctactctgccaatatatgtaatgtttaacaaggtgggggatgtggagaacactttagatcccatgtggtaagagttgctcaatggttaggaacagggtctagagtcagagcacctggcttgaatccttgcttcaaggctctgtggcactaaagcctgctttactaggttacttcaccttgccaagccctactgatctcatcggtaaaatggggattccctactcacagggtcattgggaagtttggataaaataatccacatgaattcttagctcagttcctggcacagaataagtgctcagtaaatactggtggtaattattatcatttcactgaaagaatatggctgttgagactttccccaaatcatagctgcagctgctattctggaatatttccagagtctcctggcagtgctgaaatttcccttttataaaatacataggatggctgtgaaaattgaggaaagttccaaaaggcaggggcagttgcatctgtcttcttcatttcccttctttttggcagtagaatccagaccacagagggagaggacaccaggctcccaagggtactggccaccagctatttcttggcaacatacttcctttgagcaagaatggccctttactttttgaccaacctgagagagcacttactctgagccggtcaggagaatatgaagctattttccttctgatgttatgtcctatgctatgtaaatataatctccctccaaataagaaaggtgcacatgcatggtgttggcagggaaacatcgaaacatattgcatagtggtggctgtgaaccagtggaggcagtgctgtgttgatttcccttgaccaatgtctgcccagtggcagagctggaaacacaagatgctgtgtaatgtaaaaccttggcctggctcctcagcgtaatgtaaaacaaaggctgccaggaaggtacaaatcgcccaacaggaaggagctgctctcttgcccgtggatggcaggacaataaagtaacttgtcctttgtttgtgtgttttccaggctggagcaagaaatacaaacgctagaaagtgaagagtcccagatatctgccaaagagcaaatcatcctagagaaactgaaggaaacagaaaaatccttcaaggactttcagaaggtgaagaaaaccaaaacgatttctcaaagttatttccatggggaagtagggcctagcaaaatggtgctaactgggaaacaggccagtgggcattgatgagaaatctgagccacgaactctatgaaatgaggggcagatgtgtgaggaccaggggccatcctgaagctaagcatgacatatctttgggtgtgggaccatctggcctgctgcaaggcatagggaagagtcattagattaccccatctgcctgctctccggatccctgatatgccttgtgcctgaaaagccttctcttattggactctagaattctaaaaccaattctgatgaagcagaataaacatgctctttgtggctttaattatagtttgctttttgagtctttcattataaaaaggccagaagcaacaccttatgaagtggacaagaattccaaatacaaagagtgtaaatacatgacattttactgtatatagaaacagatggtgcctgtaatcccagcactttgggaggccggggcgggtggatcacgaggtcaggagatcgagaccatcctggctaacgtggtgaaaccctgtctgtactaaaaaatacaaaaaaattagccaggtgcggtggcaggcgcctgtaatcccagctactgaggaggctgaggcagaagaatggcataaacctgggaggcggagcttgcagtgagctgagattacgccactgcactccagcctgggcgacacagcaagactgcgtctcaaaaaaacaaaaacaaaaaacaaagacaaacaaacaaaaaaacaggtggtgccgtgtatcaaagagtagagtccgtaaaaccagtaggctctgaacaaacatctcaggacctccctccattttataactgtttctgctgtacctatgagtgacagaaaagcaatctaatgaaatcaatttaggatgggattttctgatatcattctccagcatgaccaaggatatttgctagatcattgaaataaatctctattgggagaaatttagtataaattgggaattataattttggaattctaaataaattgtccagaagaaaagagatcgttgcgtttccccagcacagtcaaattctgggctggggcatgggagaaagatgggttaagtctttaaagatgggaaaagatgggattgtacccccacatgtagagtaacgctctgccttgtttttgttcctacagggtttctccagtacggatggaggtaagtgctctctgccccgactgtagatgaatgttttaatcctggtcagcttagggggtttcattaacaggggcttaaggaagaggtactgtgttgatttgtaaaggcatcagaagaagtagcagcgctggttgcaggccactgaggaggtccacattccaagccttccctgcctctcttcttcaggaactatctcttggctcactgtttctcctcttacaaaattggcctggctcttctccttcccattagtcccaacactcactgcttgggcctctcttgaaaggtacccagcaaagaagagtactaacatcaggacctggtcccttgtagggatgagcccatttgtcttggtggttaggtcctcaggttgaaacatacgtgagaagtttaagaaatttggggaaaatatttggtgtttgggaaacctttctacagcctctggattttctttgctttctctctctctctctctgatcagacaactgtcgtttctttcatagaaacagggctgggcaaaaacttccctccctgtgtgggatagttggttcagagcataggaaggtaggagtggggtcctggcttcctggtggcaagagcaggtctttcaccttctctaccttccctacctttcctctgtcctctcctctccttacctggactgtggggatgaacttgagattgtgtacttctcacccttcaccttgctccctatcctcagctgcaaacccatgattcctactttcatttggccctcagctagacctgctttacaatgcagggacttgttggaaagaccagatattgtctgctcccctggctcttagaaagtcacattctagggctgggtgtggtggctcaggtctgtactgccagcactttggaagactgatgtgggaggatcccttgagcccagaagttcaaggctgcagtgagctatggtcacaccagtgcactccagtctgggtgatagcaaggtcttgtattaaaaacaaacaaaaaaggtcaacctctagactaggaagatgatcaggagccaggataagaattggcatcagtgttttcccagcgtcatttggaaatatacggggaaaggtttaaaaatgtgtttctctggattagtcaaaggtatttgcatgaaggatagttctgactttggcaaaacaaacaaacaaacaaacaaacctgtgatttttaatttttttttcccctagcaagagacctggattttgtctccccaggtgatctttaggaaggtactaaattaaacttcatgctctgagtacatgtaggcagggccaagtcatgtccaagctagcaaggactctaggaaaagcggacctacaatacttctaggaagtctctatggtgtgaccaagtcagggcacttgttctgtgctttgggggtggggcacggattgaggaagtggccttggggaattgtgggtacagcatggggaggatggcaggcttccctgagtctgggaagacctgaggcatgccacacaattagcaataatacagtgcatgtcaggctgggatgaagtgtgggacactgacccatgaacacctacccaaagagtgcatgtcggccttttatgctttcactttttttttcccttcccttctcaaatcaggaatttccctagacatctctctgatacttagggaagggaaagaccctgtatgtcatgttcctgaggagtctgtgtggggcatggagacctgtcatactctgtgacttgttaacaagcaaaaatgcagccgcatcataaactctcaccacctctttcatttttacctcaaacttctttcattttcttctgcattgcttcccattgttttcacttatccacctaagccatttgtagaggtggtaagaagcctagtcataactgaaaagagcctgcagggaaagttgcccacagactccatcctccaggatgggggagctcaggcttaagaggatgcaaaagtcttagggatctcatttcttgggaagtggcccagggaagagtttccgtggtcttacctgtcaccctgcattataattcctgccatctgtggttatcaccaagcctgggtgacctctttatctgtcataccacatctattagcaaagaaagaagtttgaaggcgggaacacatacatcccagaatgtgattgatgtatatagagtcacaatgtggtgaagcacatcccagttgagggactttgggatgtctctttatcttctcattcttcaatttcaaaggccccgagttgccaagaccctcttagaatcatccaacttgctacaaaaaactaaccagatattattatagaacaatggtgacttaagaaacacagttaatttctgatgcgtgcagattacagaatccaggtccagttaggattatgtaactatacagacactgcagataagcagcaaaagcatcccaactcgtgaggtgctatgagatagctgctggtgtctgtgtgtgtaatgaccccatctcaggtaacctaagtgtgtccctctatgcatggcagaggaaatagaggtaccgtactgctggatcaccagtggcttttgattgcatgatagcctgggcaatcaagaacaatttattctattcttgagtagaatctcctggtcatatacattctgacacccactctcctcccccgccaacacacactgttgttatatagcagaacgctcatctattgggtgggttggttttcactgtcttaggcataatgtcttgtacacctataaattgcatatagtatatatctggtgctaattctgttctttacccactgaggagggagctgatgcaaaactcttgccagaacaggcaaaggaaaatgtctgtcctgggcctatctcagtccttggtgtatgatatggatcttcttaggttcccatcccataccagtctgtggtggcttagagcgtttcccacatcaaaaccttcataccagttattcgcaaacctcaatcttcagttgcctgtaagttatgtgtttgtttgtttgtttatttattttgagatggagtttcactcttgtcgcccaggctggagtgcagtggtgccatcttggctcactgcaacctccacctcccaggttcaagccattctcctgcctcagccccccgaatagctgggattacaggtatcagccaccgcatccagcctaagttatgttttaagaagagttttcatcaatttgtttctctggctttagctgtttagattcttcatagctactgtaaatatttcagcgggattagaactaagaagcagcactcatctttaatttctactctataagttactgctttccaccttctctgtcagtggggagaatagtgttagactattctgactttggcaggaagagggcagcttattaattgaggccacctgaagaagtttttcccattgaagttttggcaagcctgtttgttactctttgtgctggcctatcagacacttcctgtctatataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcgattctcctgtctcagcctcccaagtggctgggactacagacacacaccaccagtccaaatttttgcattttagtagagacagggtttcaccatgttggccatgctggtctcaaactcctgacctcaagtgatctgcctgcctcagcctcccaaagtgttgggtttacaggtgtgagctactgcgcccagcccattcccttatctcttaacagaagccatgtagcccaaccctctaagtgctgtagacttcaagcttgtagccagtaaacatctggcaaaggtaactccatcatccattcccatctggcagggagctatctcctggaggaggctgagacataagccctgggaatcacatgttctttcagatggaaaattccctgtctgtaagtagtttttttttttttgtttcttttttaaactgctaaaacattgagtatgcagacacacatgtgaccagtccatgagatctcacatgggctccagcctccatcttatttgaatgcagaaagtcaaattcaccaagatcccattccacagatttctggaaattatcagtgaatcttggaagttctacaaatctgctctggtcatcccttctttcctaaactgaccctctagtcctagattactgcttcactcttcccacggacaattgtcacccacctgcccctaccccctcaggactactgacctcaaggtgctgctctttctagttctgccttgtgctgctttggggcacagacccttcctacagccttccacagtgggaattaaaggaaagagaagtctgtgacctaagtttaagaatcatggaggtggctcacgcctgtaatcccagcactttgggaggccgaggcgggcggatcatgaggtcaggagatcgagaccatcctggctaacacagtgaaaccccatctctactaaaaatacaaaaaattagccgggtgtggtggtgggcgcctgtagtcccagctactcgggaggctgaggcaggagaatggcgtgaacctgggaggcagagcttgcagtgagctgagattgcgccactgcactccagcctgggtgacagagtgagactccatttcaaaaaaaaaaaaaaaaaaaaaaaagagagagaatcatggaggtgcagttcaacatggagaataatgcacaacttcagacatgtggcttcactcacagcccctgactcaaatccaaaaccatcttcagggggtccctgcaggctgctttccagccatctcccagcccaccatcatctcaaaggctcaatttccttccttgcagtgaggggtgccttcaaccatgtctgccttatccaggatccaagctccaacacatataaggcacctgagagggaaagcaacttgagcctcactccaccctaagtcctgctgttctaatcttcctttctcattccttctccccaaatggttaatatggaaaaatctatttttttttttttgagacagagtctcactctgtcacccaggctggagtgcagtggcacaatcttggctcactgcaacctccgcctcctgggttcaagcgatcctcctgcctcagcccctctagtagctgggactacaggtgcatgccaccatgcccagctaatttttgtatttttagtagagacggggttttgccatgttggccaggctggtctcgagctcctgacctcaggtgatccacccgccttggtctcccaaagtgctgggattacaggcatgagccaccgcgcccggcgaaaaatctgttttcttagcgatactctacctttgcctatgaacataatggtctaatgtcaatacattctggattgttcagactcatttgcaagtcagaaaagggtctggttggtctagaactgaactaagcctagtccagtgtgtgtttgcaatcctcttcagcaagaaatgaaaaagaaagctgctagaatggaagcagtacgagtggggatgcagaggaggggtcagtgatgagaaatgcggaggattttgaacagaggcagaggctattgaacagattggataccagcagggggaagagtgaagggtgctgctgaggatcccaggtgaactgcagtgctcgtgagccaagatagaggacaggagaagcagcaggtgagcagagatacaaggtccattttgcacatgttgagtttgaggtgattgtgggatattcagtatagacctacagtgagcagttagatgtaaccattgatgactgatggacgttccaggattttgtgatatggtcgtgatgcaaggaagggatcacatctcatggtgcccagctttccggaatcttcctgctttcactttcccacttctttctggggtgtacccagatttgtcttgtcttacctcaggggtttcctcctttcctctgataccttggcatgcttgctaatgttcatgctccccatgtctcacctccctaaagaggcttgtcgaggtatttgcccaagcaaatctaatgggctccttcttttacatagcaacattccctgcaactgggctaatggtgggctcaaggggtattgtcatttagaatctcaggactttctagctgaaacaccagcctgcagtattgaaaacatgagatcaattctgaagtctgtttatttgttgtaatgcatataaaattggtcttttgaatgaatcaggctcataaagctatattgccagttcagggaatgaaccccataataatcagacacagaaagctttatttccggttcagagaatggatctgtttttcagtactgtttaatgtacatttctagttccatgttttctatttgtcaatcccaccaagttgataatggctcccacaagcccatctctgaatcttccccccgtccctgaactcattgtcctcctagaatctagagatttctgatgactcttctaatacatagagccatcctggggcttgagctctctggccaggatccctcctgcctcagctactctgctgaataccagtcactgggcaaatgcttgtctttgtttaccctgatcctcctgttcagtggccgcctcagcggtccattatgtagggcagacaagctgctgtctcggcagtgaacccattgggcctcccaacactgtgactaattgtattccctgttctctgctaccagatgcagtaaattacatttcctcccagcttcccgacctgccaatcctctgttcacgaacagcagaaccatcacctgggcaggacgggaccagcagagcggctggtaagtcctggggacctttggacgctaggatggtccaaggggcttgcatttcactgagctttattaatgagatgagtgccctgctatccttacatagggggagctcaccttcagcccagcctcagatgcagccttcacagtggccacacaaggcaggcaccggccccagatgggtaactgaggaccaaatgggaaggagttctgaggaaatcatacggcatttcacctccgacttcgggggagtctttctttggtgtttgtggtccttatatctgtgtttattctcaaagttaatctgtattctgcctccagggattttcattttcctcattggaaatatacaaattgagagagccatccatgatggaagctggatgggaaatattttcaaagcctgtggtatctttacagaatcctttgggaattgtgctatttgtatattatgaatacatatattcctaagtcttcccatttctggaattatttcttagccactgtggtatatttgggaggaaaagaagcaatttaaagcacacatgttacttgctaatgtgtctcacaattggaaattttacaaataatatatttatgagtgttgagtgtagggagaaccatgctttgctctgcttaatgcagacatgcctcagaaatcagaactggaaggatgcaagcaataaatctgtacacgaacccttatgatctacacagaaatgtgctgagggctgggggttaaatggaaaaatgaattgcccaaggttgcatggttagttacaacataggtgacttcaaatatgagtatcagattctgctttgcatattctaggtaagtgtatgtttaaaataaatcacataatggcagattttttaaagtaaaacaatcatggatgtttaagccagaggatatcttttatataggccaacctgaatatttcatgaagcaaagaatccctacttattttaatacaaaagtaaaataaaaggcaagtaagaattaacatagttgtcacgtccactggctaatttaaatatctgttgggcatctctgtaaacatcttagcagattacttttatgtacagactcacagagtcctagagatggttgggactgtaagtggtatctggtcaatccagagccagttccacatcttcctggacagtgacaggatggataaacaggaacctgcaacctgcagttatgcttcaaaggactcactggcagtcactttaacattggactctttaagtactccagggtacacttctgaggtacacttctgaggtcaacttaggtaaaatgtgtttaagagtgacaccccttccctctggttattagagacatgggtgttgatggctcctgatagttgtgggtaaacaacttctcaggtcctctgcacaagttcctgcacttcaaaggacacaggatatgatccaacatatggatcagcttatgggagggtagggacaatgtatgagaaataattttaagagacagaaaaagaatttgagcagtgtgggtagtcaaagagtttaaagttcaagagtaacacatgaatgtgattgtagtgctgtgtaagcagcaatacacattattaccacaacccagctccctttatctttgaagatcctgcaaaacatgattttaaaagccaatgcattttcaaaagtataatgtgatcagaatctttttcaaagtaattttacatatgtttctgctgattagttaagagttaatttgcgtaaatgcatctactgtgggattacatataagcagagctatggaaggaattgtatttgttacgatgaactcctttgtccaggctgtttagggaatgggatgttcagattcatgatcaattatggttaatggtgactacacagagcatgtgtggcttaccaaccaagggtactcactagaattctcctagatacagtccatcttgctttaggaatgtccttttggaaatttatataacctcagggacattttgacaaatgtcacttgtcattactgagtagtataacaaatatcctggttgtttggcgtttggaaggtttgggactctgtataaatgggaatttatttagaatcattgcttttcagaattaggagacatctattccaatcctttatccaaacattgaatccttaacatagcagccctgtgaagaggtcctcaaaccctggtcacacacctctgtgattcatgtttaatcttcctccaagtttcccattccatctctggttggttctgactattgggaaattcttcctctgatggagccatcatttgtctgccttcatcatccacccacttatccttatcctgcaccctggagctactcagagcacatctaagttctaatttcccttcaagtgtagaaagtcactgttatttcctgtttttcccagatcctcactctaaatcccctttgtgctcacagtcccagtctctccagctggtattgagatgatgagattgcctttagacaccctccgccatccctgtccctcccctctgcacgctcttcacttggttgctagtcttcttgatgtatcatgctcagagctacccaatgccttcagagctaggctgctcacccccaaaatagagcacgacgctgcagaccacatggctgactttgctggcaatgtggcctttcagcttcagttttgaaaggcctcaaagtcatttcatgtgtgccactgctcagcctcactccgtttatccatagaattgttgtttctgagtcatttcagttgaaatgttcagtctgtttcccctagctatacatatactacttcacctgttcatacatagaaggacctacagaattcttttgttttttaatctcgaaagacaaaaataagcatgagctatgcacttttctgtcctttgtagatttgctatgactattaaatttcttcttgttagattgtctctcaagaatgttgcgggtttcatggaggcactgaggaaccacagcaggaagtgggggaagggaatgatgtcatgggatttgacagggctctgacattccctcccatttcaaacacgcgcagttcctccatcctcatgtttacatattgtgtttccacatcagatttcacttgaatctaggcctcaacaagttttgaatgtagaaaaccctcttctctattgttagggtctttgtagctcatgattatggtatcctcatagcctcactttgcttctcagtttagtaccccctcaaatctgaaaaagcaatcttttattattttttatcatctcattgctaaaaatgttgcatgttggaaccaaagtcagagccctgtggcacaccattagagatctcttggccctcaataaccctaaattgacatctttggggtatgatcatgcaaccactaacaagttaattgtcttaacacccaaggcacatgtttctgtgtagtccacaggaatataagggattttgtgataatccaaatactctggatcttttcaaatgcaatttgcctattctttccagagaccttgaacagaaaagaaaatgagattaatctgcatagtttctgcttgattaacccatgctggctcttagtcatctctggtctttgaagattaactttagaatttagctagccatgatgtcaagctccttcgatgtagtttagaatcccctcattctcatttttgaaaatcagacctttgagtgtcagcttccagcacctttcctgatgttcaagattcttgagacaaattcaacaagggaactgggaccctgatcccaaagcactgagagcctttatatccctgcagtgctatgttattttccaatcttctctgctcatctgggcttcacttccctttctgccactttctttctggcactttacaggctgaaaactctccttcttgaccaaaaatagaagcaaaatcagacacaagaaattggcttgcctttattatccatcaacatcacacccttgctgacttatttttgttactactgaggtgtcttggaaaaacaattgattcacagaaatttttgatcactgttttttttggggggagttacaattttttattgatacataataattgtacatatttatggggtacatgtggtattttgatacattcacacaatgtataatgatcaaaaaagggtaatgaggatatccatcatctcaaacatttatcatttctttgtgttgggaacattcaaaaatcttctagctattttgaagtagacaataaattattgttggctttagtcaccctactctgtattgaacattagaacttattccttctatctaactatatttttgaagttggagattgtgctttcggatgagagggagaacccattctgaattaatttcctcatttttattgtcattggcatcacaatagccatttttacatttccagcccaaagataatatgtgaacacatatttatatgtataaccatttgctcgaagggataagactacccatatgtgtgttcattcaataagtcaaccatgtgcattgcttgtctatcacatgccaggtgcaatgccaactcctggatgtttctgttactgagatgaccctgaccccccatggatgacacttatgatctgcttctctcctactgtactttacgcatcactgactcgtgaaccacgcagggtgttcacagcaccataaaatatcaaatctggataactttcattgtacaaatgagaaaatgaagccccaaaatggggtgtgatctggataggaattcagatcctatctttctccctcctcccatctccctgactaatgacagcggaacatgtggtgcttatattttagatgtgggctctcagcctgttcctcctcccgtaatcacagtgagtgaaagaaagtgagctgggaaaagcctgaatcaatgattgaactttccatcctcctggaatagtcttgttttgtatgctcttggactgatgctcaaatgtattcatgtccattgctcttcccgccttgcttgtgtcggttactcttgttccctcttctctaggctccctacagcccttgcagttgctttcactctgccaaaggtgaaggcaacaggcaacacaggcatgtgtagagccagggggataagtctgaatcagaaccaaacattctctgctcctcagacccatctctctgggccctgcagagcaatcgcttctctgctcaaaactaccaccttggtttttaggtgggcaccttccccagaggcctcacactccgctccacacctgggtgttttcagaacctagagactggaattctcaacctcaacttaatgtctctactccttcagggcgtttccctattgatgaaagaattattagggagcaagaaccaagaaaaccaaatgcggaggcccaaaatcaaagtatccatgcagtcattcatctgtatccctttgaataagctagcaacattcgttcttactctctttaataaaaagagcatattaaaataaaataaaataaaataattcttaaaaacagcatattactcagctgtctcgctggcttcttggaaggagtagcaaatatgctttatatactccaatctcattgtcatcagtatatagggtttggaaatcaataattaaatacataatttaataaaaacatacttccagatttcagccagcctatcagtgaaacttccattgaattgtcttctatttcttttccttcttccccaggtccttcatccaggaaaatttccagagctttccttcaaatacttttctgtatgtccatgtatgtttcaagatttctttcagggctccccagaaagccctcacccctcaacagcactccctcctcattttttaaataagatgaacaaaggcagcaagccctttgaccctcatcattatacaaattgtagtgtacctctgacatggagaagctggagagaagacagggcaggttagagagtatgctctgtgctttgtggttagagacaaagggatgaaaagtgtgagaggccattggtataaacttttggcagcaacaggaagtagaagagtttttaaaatcttgtgcatcaaaaataagacattgcactgaaaacgtaagtcttatgttcctattggttcatatgcactctagttcatgcttttgtatattattggctgagaactgaagcaaaatataaatgcttactcataaagatgacatttaaacattcacacctcttgcatggctttctaaaaggcctagataacattctcatatatgtatccatgaaaacgaaatattgcctttgggttaagtcagagcttctcaaagtgttcgcctttgttctctttactggaggaaagagtgaatgcagaaaggaatgtagaatcacactcttaagtgtgatttgtggttcctctgaagccttatgttttatctaggaaaaaaatacatatgcattttgtgacataacatatctaagtttattttattataaaattatattaaaattcttaaaatattctatgctcatattctaggaatattggaagaatagtgtacaacatgtaaatataaataggtaaccctagtaaaaccatgtcacatgtggttcagtcccagagccatatcacatttaaagaactacagcttaaaattgcacaccaaaaaaccattaagaaggtgttctgttctttaactatttctcctgaaggatattaaaagggaccttggccgggtgcggtagctcacgcctgtaatctcagcactttgggaggctgaggagggtggatcgcttgaggtcaggagtttgagactagcctggtaaacatggtgaaaccccatctctactgaaaatacaaaaattagccaggcttggtagcatatgcctgtaaccccagctacttgggaggctgaggcaggagaatcgcttgaacccgggaggcagaggttgcagtgagacaaagtcgcaccgctgcacttcggcctgggtgacagagtaagactctgtctcaaaataataataataataaaaaataaataaaagggacctaatttatatctccactaagtaataattctcatattcacttttctttcctccacatatcacctgctctaaagcatcatttaccaccacaaaatactccttctctatgcatatttcatacagtttttactctctttcccactaaactccttctttctcatttgtgtattatgtggatatacttaacctttccagcaaagaacttttcatcatcatctctcctttcttccaggctctgattctagaacaggcaaagattaaaatgacagaaaattggaccaacaatgatcagcattctcattggtgggaagagggagagggatatctgtaaacatccccatgttaataatttgtatttttatcctatcacatatggatataaaaatagaaatattttgttccatattctgtattgatcgcaggccagtgtgtggatttgttcacagataactgaatgtttgcagaataataagatattgtacctacaaactaacaattattactttccttatttataactgtgtcccatgagtgtgttaatagtgataagatatattctaatcccaaactgctttttaaaataagtgttatatttcaagaacaggcttttggagtccatgcaaattttaaatgcctattctattcttctgatggcacattttgtgagaaatcaggaactaactgagataaatgtttatttggatacacagtcattgtgtgtgtccatgcacctctatgacaaatgctggttggcctcccattgtgtcacttgaagaaacttgagatctttatgctgaacaagtgaaactttcaaaatggatctgatgaaaaccaaacatgggattttgtttcataatctttttagttaagtgttaaccaggaacagagtgtatcttattatgcaagcagatggaacaatatcatcactgttattttttcaaacaagttcaaacattaattactgtgtgtaccatttcattggtgtcatattatacaaagtatttgttactagattacaacaaccatattagactcttgaattattagcctttgtttgagagatgtgtatattgggtacctgctatacaaatggctctaaggtaggtgctgacagggagggggcatcatggataggtgttgggcaagaaactaaccctcaaaagatcctaaaaatctatgaagctgatgaaacattcccacagataattatacaactgagtggtaattgttaagagccttcagagaagtttagaaaaagtattgagaaaattttaagagagggatgacttagagatggaaggatcaaagaaagcttatggaagaggaggcagttgaccttggcgttaatcaatgggccatatttggatatgtagaaactcaaaacaaagacatttcaggagaagggaatcttaacaaaagcagaagatatttacgtctgggatggtgttatttggttgtgctaaatggaaaaggagcactagaacatatggttgaaaagatagtttggatcttcttaacacagggaacttattcagaaagaggtagggactcaagacaatgacaagcagatgggctagatctctagaagtttggaggagcaacagaaggctatctaggcagagggacagcaggcacacagatgagcagccgtgggaggaagttgagtgtcctgggaatagtgagaagtcgttatggccacaatgtgtaaagaatgagagagcccacaagacaaggctagaaaggaagtttgcagacacatcctgaagggaactatatgccatgctggggagtttggtgtttattttctaaagacacaaggaaccaacagagggtttatgactcaagtaactgtgggcaggatggagcacaggctggcaggggtcggcaaaatttttgtataaatggccagattttaactattttagactttgtggaccatatagtctttgtcacacattaattgttttctttctcttttctctttccttcccccatcttttcctccctctctttcttcttctccttcctcttcttttttcttccttctccttccccttctcttcttcttcttcttcctcttcttttttttttttttttttttttttaaagaaacaaccctttacaagtgtaaaaccactcttagctcctctggccatacagaaacaggctcaggctgtctttggccctctggccacagtttgcagtcttctagactagagcaagaagacagaagtgttaggtaaaataaaaagcaaggctgttgtgcagagagcagaggagggcctggactaaggccttggtgacagaaatggtggtgaggagatggatgagatatatctgaagtagaatgatttactgtcagtgagtgtttggctgtaagaaagtaggaagaaaagaacaagtcaggtgtgattctcaggcctgtggcttgagagactaggtagcagtgctgctgttatttggcatggagactgtggaatagttttgatagaagaagctggagtcagtttggaagctgctgagtttgatgggttcgtggcacatccagataaagggcacctggagcctggtggctctatgggcctgatgcacagtttcttcccatccaggaagactgtgaagaaaccagtttggaagtatgaggtgtcacaagagtctataggacaggaaagagctgtccttagcaaccccagactggcagcaagagttgggatgaattagaaaggatacaagactgagagacaggggcaaggggagggggagaccaggtaggaagctcttccaacaatctagggaagaggaagtgaatgtcttacattgaccagtagcaatggaacaaaaagaagacaacagatgggaaaggtattaatggaacaaaaagaagacaacagatgggaaaggtattgtgggcagcaggacttggcactctgtgcatggaagatgaaagaggccttctgcgatcattgtcttcaaattccagtgtcctatgtgatgttacttctgtcttgttcttttcttagttcttattttaggtacctagtttagtgactgaagtactcacagggcacataatatgaatgctcccatgctttttcaattgttgaaaatattctgttgtatagtacagtggaggatagccatgacccacctatgaaaacctttgtggaaatgtagagaaaacgaaaacacttgatgaaagaggttttttcatttatttaaaattttggacctggaacacattttaaccaagggtttgtaaattgtctgtcagcctgggaagccctcagtcaaggtagtttgcatgttgccagcctccatgaaattcttcacactaagatctaaagtctcttgtgcccttattttagcagatcttccttaaatgtgtgagtgccattgagatatagcaaccgtgcatctgtcttccaagtgcattaaactgctgtgttacaatacagatataaccatctttattcacagtgcgcacctcactctaacactcaagatgcttggcagttagaatagaaagggcacaaaacctttttttttgtctgtttggcaattaaccattcactggctttttttgttgtaacatgcacttcctttctcttgttttcattcaagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttcttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatctacctctgtgtgtctgtgccctgattctttccccttctcacctgccactagcggacttcaggccagaccgtgttgggagcaccttccgctgttcactaaaactaaacactaacccagtgcctctcaaactccagtgtgcttcagaatcacccgggggtacctgttaacagtgtggaagcttagtcacacctctggaactcagattccgattcccaggtggggcccagtagcatgcatttgtaataatgtctccaggtgattctgatacatgtggtacctggaccgccggtttgggtgccccttggtgggaatcctcatggcccacctgttgtagttggtttctacactaatccaatctcccaacatgtcctccctctaaccccctttgcatgtctctctccacaactgtcatccttttcttgttccttgcaagctcccagcagcagcccagactgtgatcaaacttgggctgccccttaggctaagtgacagggttcatctggtgcagtctgctgtttaagagcatctgaagacacgtggggactttgtttctcttgttcacctctctttacctggaacagggtcagcatagtttttcaataaatggccagatagttttggctttgtgggccaaatgatctctgttacaactactcagctctgctgcaaagcagccatgtatgacatttaaatgaatgagtatggccatgttctaataaactttatttacaaaaacaaatgctgggtccgatttggcctatgggcttataatttgccaacccctggcctcaaacagggcctggtccatagtaagtgctccaaaaaaaaagtttcaaaaaattattgcatgaaagaatgaatgaagagtagatatgatgcctaccacctgcagagcagtcacagaaaatggttttctttgaggagattaagtaaatgaatcagttgggagttctcatctggttgggttccatggtagattttttaaatgtctttatgcatggaaggtaactttaaagatggaaatatgagtggtgttttatagattgctcaaaccgccaggttaagattgacaagagtttcaaccaatagaacgtggaggaaatgcaagaacatcttgtcctcatcaaaagtgctggggataccagaactgggtgctccctatgtacctaagcatttagtgcagttgtttgtggagctatgttttgtcagattcatcttacacagtgaatggcagggctttctttacattattctctttgttaattgaaatactttttaatgtgtagttaggtaggctggaaccatgatagcacattacacatcccacagttctagagcataccaacgggttcaaatgtaggagcatatggaaagtcgtgtgcttacattcatccctagtgttgttgtgaagttaaaggaaattatatttattaaaagcactgtgtaagctggaagtagatgacaaatgttagtttagttataatgagaaagtgtctgttgcccaaccagaggcctcatgctgtccaaatatagagattataagctgttcaggtgtgtttcagaactagtatagaaagggaagctgctttggcctcctttagatttgtgactagttttgtagtacattgaaccttatgaaattgccattttgtagatccataatattgactattgacagttccatatagttcaacctcataattcgattctggggattatatctcatcatggagggcaaatgattaccagatgaactctaaatatagcaggaggaattagatgagaaaattagaactttggaagggaatgtagttcagtactaccaagtagacctagacatttcacctgatagggtaggatttcctttaatctcacatcaactttgtaatgtagccattgaggttactgtccttttatacatgaggaaactgagttatagagatagtaagtactttggctaatgtggcagggctaaaaatccgtgtggggtggaggagggccaagttccaacctcagttgtctttacttcctcccacacagagagctatgttatgaaagtggtgtggaggccgggcgctggaggccaggtgcggtggctcatgcttgtaatcccagcactttgggaggctgaggcaggtggatcatgaggtcggaagatagagaccatcctggccaacatggtgaaaccccatctctactaaaaataaaaaattagctgggcttggtggcacgtgcctgtaatccccgctactcaggaggctgaggccggagaattgcttgaacctgggaggtggaggctgcagtgagctgagatcgcaccactgcactctagcctgggtgatatagcaagactccatctcaaaaaaaaaaaaaaaaaaaaagaaaagaaagtagtgtggagatgcccctgagactggagacaaaaagatttagataatgaggttatttatgcaagaaagacccaatggcaccagttcttattttgcacctttacctactcaagcaaatgctctgttaattataccaccccctggaggctgggaggcatctctgcagcgcttccttaccaaaggagaagcggagggtaaaatcactttgttttcttatctgttcatcaggagtcctgttgttctatttgacagtttttccttcaccattcataaaaaggattaacaaaattgcccaaaacaactctataaagtctaggagtggcacgtcagtctctgaaaaagcaaagggggttttgttattgttgctgatgatggtattgttactatttcaccactgtcataacagcaaagaggaacagctgccctatggtgttatgcaaatgccttttgatctaggctatatcatccttgtgcagctattaatagaccacatcatctccccagcagcccccaagccctagcttctgtcctgcttttctcaaacagtattaaatcttgcattttatcaacagcacaaaaaagcaaagatttgctatttagaagtggacacaggaaggggaatatcacactctggggactgtagtggggtggggggaggggggagggatagcattgggagatatacctaatgctagatgacgcgttagtgggtgcagcgcaccagcatggcacatgtatacatatgtaactaacctgcacaatgtgcacatgtaccctaaaacttaaagtataataaaaaaaaaaaaaaaaaaaaaaagaagttaaggttgcaagatcttaagtgatcatgtagggcagaagtcagaaaatggttatgcagattctgggctgaatctggcctacagtaaggttagtttacctgcacagcaattaaaaatcattttgaattcattgccaataataataaattaagagagttcttattttaaaagtatatttccgacttctcttgagaattcagtctctggcaataatagcctgttctccccactggcaattgtctggagctgatggtggttgctaactttagaggagccatattccgttgttcatcaccaccaacaccaacaccaccaccatctcctattatttttaccaccttctattattcttactcttggcccacttcctttgtctgtatcacctgcctggcccctattggcatttgagcatgtgacccctaatctaccatcattcactcattttatggctgggtcaaataagtcctaggtggaaatgggacttaccttagcaagataacagcagactcagaactaaagtcccctgaactctttggatgaatgaggctttgtactgtgttgggattcaaatcttctaagggcatttttagttttgaacaggctacaagcagaaagctaatgccagaatctagtgcttttgctacagaggaacccatgtgacttatataatgatgaattaaccttaggttaaatgaacagtgtaagtttgtaaggaactttagggtatcctgtgtttcatggtaaaaagtttcattcccaggaaaataaatagatactttgtagtcaacacctcaatagttctggaggcttcatgttccttcttagcaaaaataacaagaggcacagcccatacttatttaaattgaaatgtgatcttccatgccttcctaatccttagtctttgattgtgttcctgaggtcatgtggttgtagaatactactattctgtattgtccactttttttatcttcctaagagcaataatcctcacagaagcttgataattcaaaggactaatgaaacagagatctttactcccagggcttgtcataaatcctggccaatatggtgaaatcccaactctactaaaaatacaacaaaattagctgggtgtagtggtgcgtatctgtggtcccagctattcaggaggctgaggcaggagaatcgcttgaatctgggaggcggaggttgcagtgagccgagatcgtgccactgcactccaacttggcaacacagcaagactcctctgtcttaaaaaaaacaaaacaaaacaaaacaaaaaaactgatatgatttagtgtttgtttgttttaaggaaagactaattttttttttttttgagacagtctcactctgtcacccaggctagagtgcagtggcatgatctcagcccactgcaacctccgcctcccaggttcaagcgattctcttgccttggcctctctagtagctgggattacaggcgcatgccaccatgccaggctaatttttgtatttttagtagagatggggtttcgctatgttggccaggctggtctcaaacttctgacctcaggtgatctgactgcctcagtctcccaaagcgctgggattacaagtgtgtgccaccgcatctggccaaggctaattacatttaagatgataattgtatttcccaaattaaaaaaaatatttccaagtcactgaatattaaaaacacgagctgtgggcctattctcttcaggccagggttcttaggtcaacctcagacaacctgaaagtgagataaattctgcagttagtgtgaattattcagactatcagaatctgccaaatcaaattccatttcttcaagaacttatttccagtcagagtacaaagatagagtcagcttttctacttttcctgaaagactgcctaaattctaactatagctcagagactcagtgtgaggtgctgtcacataccttaactcagtttttcctcaaacttcagacttttgggcatcatatttgttatttttgtcctgtgtgtaccagctcgctcctgttaaaagaaggaaatagccaggttagagaggtgtcaaaaacatagctccatctctttaatataatcagatgggagtgaaagagaatcaagatagcagtaactttcttgctatgtgagtcagtgttacataatgccatgcccacttacccccaaaatttaggaaacactgtcttgcctccttgcatcctcttaaaaaaaataaaaatcccaattcctcgtttcaaagagactagggttagaaatagaaagtgacttgctcaaagccacaagaagagcagagacacagagctgggattcagacccaggcagggtgacttcaaattctttccattgcaccaggtgcctgtcatgctgttccttttataaggattgaatcgagtacatcagtagcaaacttaaactctccagtaagatcacgatcgtttaaacaaacaaaagtaacatctgttccagctaaagagctgtctctggcataagcaatttttcaccgatggaggctagatctgattgggctcttgctgagttaattgagcaaagttacgtggccagatgtgagttttcagatagaaggggaagggaatgcaatatacaagcacatggggagactgatggaccaaatggctggctccactataaaacactccagcgtttagcctttgttctgcctcctgggcgttagcaagctgactcccgcacagaagacttcttggttgactcttgaagagtcagggatttagtcaatgcaagctgtaaactggctcagcactagagaagcagcagacatgagtagaaaaaggttctcccaaagacagctcagcttcacttttctcttctctcttcactcctttcttctctcctcttttctactgaatgaacttaaacatttttcagctgagatgcattcccacctgcagggtgaactgaacttttaagaagcctattaattctcccaggaagcaccaggctgcagctctctggttctcatttcttgcttgctatgtattagaacctgggacattttctccaaaatataatgctatgagggcccccactccagagatcattatttaattggtagggtgaagcctggcacatttattaaatggttccaggtgattctaatggagattcagccagtgttggaaacagcagcacacgggtgcccagggctggccgcagtgagtccgggctatgattcttgcctcaattctgcaagccaagaaaaacgggctttggattcaggaacaaagcaaagcccaagtctgtcattggccagctgagtaatcttaggcaattaatttcaattcaccaagcctcagtttcttcttctgtagaatgggaataatacctaccttgcaaggcttctgttaggaatgtttcccttctcctttccttcccattacaaaagaaatatatttgaggcagttgattgaaaaaaaaaaacagcagaaaaagaaacagatggagaaattaggccaagagaaaaataagatgaaattagaaaactccatctagcttatattactgaacgtttacttctctcacttgtttgagcaattcagtttgtaaaatgtaccacataatactactttatcaaccaaaccacttaattctaagatcttgggtctattttgaaaacaacaaaaacatgatgtgacagaagcagcattcttgagtgtaaagggacccatggactgagctttgtctcatttatgcctttatcgtatgacttagaggaagtcatttttcctctcttggtcccaacttgctcatctataaaatgagacaacgtgattgtgggtgacattctgagtggacgccaacctcaggagtatttttctataatttaaaaagaaaggagagaagaaaaagagaaggagaaaaggaagaggagcgagagaaaaggaaggaagaaagaaggaaggagggacagagagaaagaaaaggaagaaaggaaggatgaaagaagggaaggagaggaaggagaggaaggaaggaaggaaaagaaagagaaagacattaagaggaggggagttgttccttgaaggtgctgaagtccctggcctttagaagccatcacatcagccatctgctgtgcctggccctgtgaagttactagtaagccacccgtcactgccttgttccagggtcttgaaaccctgtggctattttcctgtgtatgaaattcagtggggggaatacctgcctgaccaaaatttgtagttccccatggttgaaaataagagtctgaatcttccttttaaatatatgaacagaatcgtctttgcctgccatctttgtgccctcactttctccttggagacttggcaaacccccccaccttgagggagaatactgcagacacgtgccactgctcccctattctagatgttttctccaaaggaacgttgagtttgtgagcaacaggctgacagtgcttctctccacagacaatgtttaactctggacaaaatacaggctccttctcttgttctcacttgtgactccctgctccatgaatgtccagtgtactgggtctgaaagcagtaagccagttctgctctttaatagctctgtgtctttgggtcagacacttagcctctttgctctgtaatacaccatagagagttgtcttaagtataaagatccaggccaggggtggtggctcaagcctgtaatcccagcactttggaggccgaggcgggcagatcacaagctcaggagatcgagaccatcctagcctatacagtgaaaccccgtctctactaaaaatacaaaaaaactagccaggcatggtggcgggcgcctgtagtcccagctactcgggaggttgaggctagagaatggcatgaacccgggaggcggaacttgcagtgagctgagatcacgccactgcactccagcctgggtgacagagcaagactccgtctcaaaaaaaaaaaaaaaaaaatcctaatatttccattgatccaaagaattttagaagtggtagatagaaagttaggcatagaaactccaagttgaatggggttagttagctgaagtttggctgaagagagtttgttttcatgtcttttcacctaccaggagaaaatttccctcattgaatgttggaaggagacgtgggaatttttggataatttcctgaggcagtggctgggtaatggaaactctcattgtgagcgtacaagcatccatcctcatcactaaggcactctcctactcagtaagaacagagaatcactgctttgttctctttctccagaattaagatcaaacccttctctctggaattcaacatttgctaaaatgcaacaacttcttctccatcacccccctccgcgaaaccttagttcccactgattcccaacataaatttttctttttaattaaggatcccaccctggccctcactggccattttcaccccttccccacacttggcccatgctgttctgtgcacacttggaatcatgtccctcttcccctggagaagccttcatcctgctcagcccagctgcagtgctttcatctcatactgccccctgcacccacccacctttcgctatcagccctcctctgcacactgcactcctgctgtctttaccatacggctgacccttcagtggggctcctctgtattcattggataaaatactaattttttagttccaaaatggatcagtagcagcacctttgatctctgaagtagttgactttcaccctgagacacagacttatagaccatagatgaaaaatgacaatcaagatataatgcataagttgagcacggtggtatgtgcctgtaaatcccagctacacaggaggctgaggcaggaggattgcttgagcacaggaatttaagtctagtctgcacaacatagcaggaccctatttctttaaaaagaaaaaaaagatgtaatgctatcttttggctcccaagagtcagtaggaaggatgggagaggaggggacaggagcccttgccagaaaaggaaattgtagttttattttctcccgtatgtcagaagagaacagattggtatggtgtgcaggtagccatgggtcttctcttaccaggccagaggagaggctgaacttccctcagcagttcccaagcaagtttagcagcagaatcatagacaaattgtcttcctatgccttgcagtgtgggtgcttgtttactatttgagggaaaagtgtttaggcaaacaggtatcctgagggtgaccagctgtgcaaggattaggctactgaagcacaccagttctggctggtgggaatggaactggagctccccagcagggctgccaagtatgattgttcaggttgcatactgcacaatcctggaaggctccattcacatcaagtacaatgtgaatggtgctcttggagttgttcagtgcataacatgcatactacacctgctcaggcaaaagcaacctatccgttctttggaacatatagctaaaattcaaccagaaacttactttataatcatagcattgcacatatattaaacttgctgtagcctgtcaagttgcaggaatcagtttataccctgaagactatggacttgacttctaggaaccggtaatgaagacatacttccagggaccaggcatattcttccttgattttctccagtgaagtttagcatggtataaacacatggtatggggtagatatttcatgatgttgtagctgggatcatggagcagaatgaaagggcagaaccagttgctcttttctcaggggcggcattgcccaagcatgaattgttattgagtggccacttagaagaaagatttctctgactggggtgaccatatgtcccagtttgcacatgttttaccagcctaattttcagtaatgttcagttgggatgatgaaccatatggtcgtgtgacctctggcatggagatgggcatctctgctttgtcaactactccacatctgcaaccagcctttccttttattgatgccttggcaattctccatgatacagacacaatgctgagggcacggcaagactcctgtacgcaaactgttctgaaggatcagagtgttgtagggtgacagtcagcctcatccacatcaaagcatttcctttttttcttcaccatttttgatcagtttcatattcctgtgggtactaatgaaaaggaacagcagaaccactatcaagtccagtacttactaggcagatagagacccactggcttctggcctgtgccacttgctgctgcccacactcatcagtggaggagaattccctactaagttttcagtagttataattgccaccaacattgcatgggagagaggagcatgacttgaagtcgtttgcaaatgtatgttcatccaacaacagccaagaagcatacccgagactgtgcaggtgctgcccaagtcctgaacacattactgcacagttgctcagagttctggttcgactgctacctcttgtaccccagtttcttcatgtgtagaatggcaaagagggttaaatctcttacaaagtgttttggacactgcctggtaaatactggcagaactaaaatatagctattagtaagaatagtatcagcagctttgagagccagggaacaacccctaagaatggtatgaagtagggatcagcaactatggcctttggagcaaatgtggtcctctgcctgttttgtaaataaagttttattggaacagaattatgtccacttatttaagtattgtttatggatgccttattgagtagttgggaaaaaaatcatatggcccataaacctaaaatatttattgtctggtactttaccaaaaaagtttactggcccccaattaaagcataagtaagatactcaaaatctcattcctattcctattccactagcagttactgagcactgattaaatgccctgaactgtgccaattttttttttttttttgtaagacagagtcttactctgtcacccaggctggagtgcagtggcacgatctcggctcactgcaacctccgcctcccgggttcaagcgattctcctgcctcagcctcctgagtagttgggattacaggtgcatgcgaccaagcctggccaacttttgtatttttagtagagatgagatttttgccatgttggccaggctggtctcaaactcctgacctcaggtgatgcacccacctcggcctcccaacaaatgttttaacatagattatcttatttaactttcatgagaagtagctcttcaaggttaatggaaatatcccattttatatgtgaggttcagagcacttgtgcttgtgtacaattgcagagctaggattcatactctggtctggaactttaggagttatgaggacagacatcctggaggagttcggtttgcacttgttcttgaagaatgagtatggttttcagtaagcaaggagaagacccaggggagggtattgcagaaagaaggaattgactgagcaaagggcctgaaataggaagcttgggctggttgtctgatttgtttagcctgaagggactgaaggagacaaggtgaaagaagtggctgtatgccaggatgtagagagacaggtacttcctcgaggaagcagctataaactgaaagttcaaggtcaagcccatagacatattgtgtttggcctttactgtattgattcacacaaggatgtttgctttggttttcacttgaatttataaccagcccatcctacatttcatcttctcttaaaagactgcaagatctagccagactcagccacatttccaggaggtgggaactagctagagttgagtttagctgccctctttagatgcagcatctgctttcctatgggcctttactcatcttagactcaagcaagcacagcccccatactgggccctgggctttatagggccttgctctagtcacactcttttctaaggggtgaggagtctttgggccaaggtgacttgcctgctccctacccctgtcccctgactgtgcttcacctcccaagactctgaattgtctcctgaacggtcccagctcacatccagaactcacatgggcctcttctctgcatctgtcttcccaaggatgggccactctgaagggtgtaccaaagggaagcagtttgccttgaaggtagcgtatgtgtggatggacctttgaggtgcaggctagggtgtccaccatgggtgtgcaaggcctctagaggtgcaggacagagcagagggtacaaagagtagggaagaaggtaacaggccacagaatctcgctctgcaccaccaaatctcaatatgggacacgcaggaatccaagaactcacaatttgaacttggccttctcagtcagtatgaagtatatttgccaacttagtaagagagaacataaaatatttaataattttgaatttgatttcagatattgagatatactgtatgtcagcatctatttgtgcacttgctccaagccccagaaatgttcggcataggcctggctgcagccctaccagttcccattgtcttacaccagagctgtgtctctcatggacatgacctgtctggtgcttacaggaatgagaggttttggccctagctaaattggtttagtggtgaagaagattgaaggtttttgatcagggcagattgtgccaaatgggctactgcaggcagaggcagaggcaggaaggccagtgagggagctattgcaggagaccagctgggaggtcagagatttgaaccagtaggagcgagagaagaagggacagatgcaagattaattatgtcttttccttccacaatgatctttaggttaaggtcgccaacttaacccaatttagcctgtgactttcttggtttttgctctgcaagcttctgtcccaggaaaccccacagtactggtcacactggggaggctggcttgcctgcctaccacctaaatatcagccaccatcatattgagctcttactatacctcagctgggaacttgagctcaaggctttggacttgagtataactttgctcctggaagcaaactgtctggctatttctattccttgaccctaaatcaaaaaatggcaaataactctcaggccatggagcttcccttgggtgttacagttacagattttcaagtcaaggatatgttcaggacctaattagctcatccagacacttagaatctagattcatgctggaagggaagaaaatgtctccctcctcacctttgctggacacaaggatgtgtcatctttcatctgtttcttgccattgtcattaccatcaacattgacagagataacacatagaaccttgaattatggaatccttattaagttagatactcatctcttctagaaaataaaatgtttattagtaaaagcagaatcctcaggaaaacagtatttataagccctagacacatggccctggaaaagtcacttaacttctctgaacctctttttcctatgaagtgggactaataatccctacgatagatttgtatggagaataaagtttaaaatgcctcatgcacaaaagaattgagagcaaggactcgaacagatatttgtataccaatgctcacagcagcattatttccaatagccaaaagacggaaaaaaccccaagtgtccatccacagatgaatggataaacaaaatgtgatatatccctacaatggaatattattcagccataaaaggaatgaaattttgatatatgtcacaacatggatggaccatgaaacatagtgctaagttaaacaagccagagagaaaaggacaaatattgtattattccacttacatgagatatctagactagtcaaattcgtagtgacagaaaggttaccagaggacctgggggagagaagaaaggagagttattgtttaatgggtacagaatttcagtttgggatgatgaaaaagttctggaaatggctggcggtgatggttgcacaacagtgtgaatgtacttaatgctatcgaactgtaaacttaaagtggtaaatggtattatgtatgttttaccacaataaaaaaataaatgcctcgtgcagtacctggccattgaagatactcagggggaaaaaaaagagctaaaaagagatattaagatgtttctaagtgttactgagttcagaagtgggagttcatactttaaactaaaagtagtcaacgaaggatttgccaaggaggtgggatttgagatggagtttgtaggaccaggcaagggaaaaggcaacccagccaggaggaaatgtgtaagcaaaccatgaagctcctgtgtgtggtgatggggacccggtgatgatgttgtgatctgttttgttttttgttggagactagatttgggatggggtttcaagggacttggagtccaagttgacctgtttaggtgccaggcagagcagaggcactaaaactatctgggcagggaggatgaaaagatcagtgtcggcagaaagatcaatctggggcatcgtagaaaatggattgaatggtgccataccagaggttcaaggcagccagggcagtgttgcacaagtcctagactaaactaggatggtggctgtgcaaaagaaaagggagagatggagactaatttcagaagagccttgatagacttaagatatcaaggaagaggtggcaaagtgttaaatgtttagcagaatagctcaaccctggagccaggtaccctgcatttagtactgctaatgttctaataccagtactgctgcttatgagcttgtgtgaccttgagtgaatgacttaatctttctgtcctgtttcttcctctatcacataacaatgaatgacaaagtagtgcctctctcacaaggctgtcatgaaggttaaaggagtcaatatttgtaaagatcttacaatagtattcagcacagaatatatgcttgctattttttatcttttaaatctggatggttggtacgttggtgtctgttacgttattttttggtgtttgaatattttaaagcatgaccttaaaataatgtactttcaaaacagtcttgctaagcagtgcttcttaaagcttaacatgcatgtgaaatgtttggcagtcttgtgaaaatgcaggttctggttcagtaggtctcaggcggtactcaatggtctgtgtttgtagcaagctcccaggtggtctggtgccgcgggtctgccggccactccttgagtagcaaagttgttaaggaacggagttccatcacggtgtttctaggattgttctggttgtcttttgccacataacaaatcatccaaacctagaagctaaaacgaaaatgatttatgttctatgctgttgttgttattattatctcttgcagttcagctatgtagttcttgggatctgtcacaagctggtggttagatgtagctggggcaagagtcaagagtcatcctgaaggcttcctccccctcgtgtccggtggtagatgctggctggctgttgggacctcagctggggctgtcagcgagaacatctccccagggcatctccatgtggcaaggggctcttcacagctcagcagctgtatctcaagacagagaaccaggcagaagatgtattaccttttcttgcccagcctccaagtctcacagcatcgcttctgccaccttctatgtattagaagcaaggcactaaggccagcccatatgcaagggtagcgcagtgagactccgtgtcttttttttttttttttgagacagagtttcattctgttgcccaggctagagtgcagtggcacgatcttggctcactgcaacctccacttgctgggttcaagtgattcttgtgcctcagactcccgagtagctgtgactacaggcaggcgccaccacacccagctaatttttgtatttttagtggagatgggatttcaccatattggccacgctggtctcaaactcctgaattcaggtgatctgcccgccttggcctcccaaagtgttggggttacaggcgtgagccaccgcacttggctgagactccatgtcttgaagggagaagtgtcaaagaatttttagacatgtctcaaaaccaccacaatggcctgcttaaggaagctctgggaggaacagaaagtggtggatgagtcaaccagggaaagttgactttgttgtgtttaaatttgtgggtttggggtaccatgaagaccacttgaagttattctccaacaggcaggatggtgtgtgagtatctgagtatctatctctcacaccagatcataagcttcttgaaagcaaggacttggtctttttctctgcaatagttctggtgtctaccacagtgcttggcacacaaaagtgacccaaacaatgtttgtttgatgagggaatgaataaatgaatgaatgaatgaatggtaaaggatttaggactgaggctgtgtggtctgaagaagaaaggatactggaattctggaaatctctcccagaacagtcctctctggcacttctcccagggagagggactcctgcatttgctcagaggccaccatggccctgggggtctggcctgcctgctttgcaacttgaggccctcgcgtaccccataggctgtggaaggcctggatctgctgggaaacctccttcttccactaaatggaaactggaattccaggagaaagcaaaaatcaacaagagctattttgattataatgatatctcatttctaagcagctctctctatttcctgtttatagcccaaactgagagcagaagcgactagatctctcagtgaaaggttttctccgaagacgtctagctatatcatcaacaggaaacagtactctcccaagacaaaagtccctgtctctggccactctgttgggtttcattgcaccctacaaagggaggtgggaaacctgggtttctgaaagaggccctgattttgtgttagccttcagcatctaccacttgtacccagctcccagtcccccaaatttctggggactccatgtgaaatcaatgcacaggaattgtggggggaagccctaaggagtccagccgcgattttcagcgcgattttcagggcagctacatttcacttcaaaactcccagtaagtctgccactaagacccctggaaaggctggctatgtcagccctctgtcttcattagaagaatctcaggatttcttccagtgacagaacatgatcctcagattccagggagtgaccccagacccagttcctctccgggctataaaactgtggagtgtgacacagacagagagactgtggtaatttagagactaagaaaaaaactgactagaaagcaactgaacagaacagctgcaggaatgtaaaatgcaagaccctctgatctgacagtcttttcctgcacctctacaaatgtgcgtgcacacacacacacacacacacacacgactcccagaaaggaccctctgaagacaggacatttcagctgacatctgaaagatgaggaaggcagccatgccaagagtattccagaaagaaggaacagggtttgcaaaagctcagcagctccacagctgctggtctgggccaaataggacagacagcctgtggctctccccacaccttgtgcttcctcactcagccactgtgagtctcctctcgcctgaaacagtctcccgctctgtcctaaccttccagcatctttctcattcactctgtctcctgaatatcacccacaaagggtagcagtatcagtcttggtccacacacttatgcaagaagtgccactttgttttctttaaatcaagtgatatcagactctgtaccccaaggctgctggtctggcaggcagttcaaactcagtcgttcacggggctctctcccacccaaggtcatgcaaaggtgacatgctcatcttggggaaggcccatcatcactggttctcactggatttatccttgggtgtgcattgtcctggttttcagagccccttcagggctgaagtctgtgtggcttctgagccaagcttggagacaggagccttggcagaggctgggagcctggaatcagcatccagcttccctgcttacaccacagtgtagcactcccacatcctcaccccaccccaccccaagtgcagcctacagcccctcccctctactgcttctgggagaaagtgcacccctccccgaaccccaccaggatgcctagcttcatctctttagtgaacttttggcttttgcaaaagacctgaaggcccattgaccaaaagtagcctctgcccaggcaagggagcacaaaacccactcatcttctagaaatggactggagagtgcaacacaggaagtgcccacacagatgtttcctagaccttgcctttagggtccctctgttctcagggatgcagtctatccagccctgggaacttgaactccctgagaacaatgtccctctctatctatggtaaaggattaggttttgttttttttcttttaagcttccagttcatctcagaacagtacttttgtaaagtacaatgaaagtgaatgatgagaaaagtaaaatttttgaaagacacacagaatacaggtactgattttttattattagattcaataaattgttattaagggttctaaacatattctttccatttctgcactcacttggtcaccgatcagtaaccaactgtggagggacacggattggtgggccactcactttgaggagcgctgccttagagcactcaggagggagcagtgagtccttcttcacctctagaaatgtggagcttagtgaactgtagaatcttcaaggggttagggtagaagctggaaacaaggacagcctttacctagtgagccaagaaactaaaatccagcctcctcttacaactacttacaatgcaaaaagaattacagtgtaggactatggagcctgcctctggggcaggctgcctggtgatacattcagcactgccacttactgccttgacccaggatgagttaatagctcacagcctcagtttactcatctgtccaattaggatagtagtactatctcatagggtttttgtaaagactgaagttaataagtgcataatcacatagagttgctcttggaaaatagtaagtgcctgtgaatattaaaaatttcctggccaggtgccggggctcatgcctgtaatcccagcactttgggaggccaaggcagaagaattacttgagcctaggagttttgagaccagcctgggcaacatagggagaccctgtgtctacaaaaaaaatttaaaaaattatctgggcatggtggcatacacctgtagtcccagctactcaggtggatgaggtgggaggattgctcaagcccaggaggccgatcacaccactacactgcagcctgggcaacagagcaagaccctgtctcaaataaaataaaataaaagtttccttagaaagaaagcttcaggaggttagggatctttatttcctgatgtttcccaaatgcctagaaccatgcctggcacatagcagtgctcagtaaatatcagtgaatgaatccatctccttatccaatgctgaacttcaggcttccatgtttatcccactcttagtccctttttttttttttttttttttttttttttttacagagaaaaggggtctgtttgctctttgtgttctttgtgttcatagtgtttccaagccccaggccattcagagcttttgtctccagtgccccacacattcaagaaagacttgaattgcctctcaggtctgaacctgttttgtgcagggtgtccaagctggagtgcaatggaccggtcttgactcactgcaacctcccactcccggcttcaagcgattctcctgtctcagcctcccaagtagctgagattacagacgttcgccaccaagcctggctaatttttgtattttcagtagagatagggtttcaccatgttggtcaggctgatctcgaactccttacctcaggcaatccgactgcctcagcctcccagagtgctgggattacaggcgtgagccaccgcgcccagccaagatacattgttgcagagtgtaaaaccagatcttgttgacctggcatttagaccttccaaaatctgatttccacctgtgtttctaggcatgtgacccactgcacactacacagcccccacagggaccatttctcctaccctgagcaagccattcctccaagacacacttctttgcaactcctgcccgttgaaagattactcattctaccaagccaggcttaaatgctgcctactctctgaagctgtctctgatattccaccagagttcgtctctcatctgcacatctactaattctctgttctcaactcctgttcagaagaccttgtaatcaagttcattgtttgcacatctgtccctttactaaggtggaactccttaaggacaagggaccatatcttcagcagctctgaatagcattggtgcttcatgcagggccttgcctataaatacaacttcaacaggtgggagttgttggtgggttcccacctgcaagcataagtcagcaggcttcacagtgagtggcctaacataggtgtggatcagaaggaaatgaaagcttcattctagcttccccaatactacttgtctcttaccattccgttgtcttgagtattctttggggaacctgctgatataggaggaacagtggcttcaatctgaaggactgtgccagcttagggtgagtatgactcagtctggaagcagaagcagaagggaatatggttttgtggatgaacgtgggagacagcatggcatgaggttagtgctctgaggtctggtgcatctggcttcctgtctaggctctgctgctgactggctggatgacctttagcgtattcttcatgctttgatgcctgtttccccatcagtatactatagacaatgttgggacctcccctaacccctgccactaggggcataatgaagaggaagccaaggggtgtgcatatgaccccaccaccagtctgcagggaatgccacaaagatgctagcctttgcaaattctggtgcagtgttacgaggagacaaagttcacaaacattaccttgcccctgggtaccacgtgacttttgtctccctatatctcctgcacaattgcaaggattaaacatgctaatatgtataacggacttagcaccctgctctccaataatggcttaataatgctctggtttctcttcagatcatataaatctttcaccttttaccaataatggcttaatacaccttttaccaataatggcttaatacacataagcaaaaagactcagttaatataggctataagttggaatcaataatccatgaaagaaaccctggatagggtttttaggacacaggcactgctataccctaatagaatggatcaactttcattcagttaaaaaaaaatctacttcttttttatgccacaaagtgccaccttaaatttatcttagtgattgaatgtcatacccaaaagaatcaaaagcactggagcagttgatctggtagaaacttcagcatgtgtttgttcattccacaaaggtttactaaacccttgctttgtgacaggcactgtataccagttggccttctctctacattatgctgttgcaacaggcaaccccagtaatggtttctttcttgctactggagctctgttctaggtgtcttcattcctggacccaggctgcaggatcagcccctatatggaacatgccattcttatgacagagagaaaggggtactaggagaaccatatagtggctcttaaagtcatgcttggatgtggcacgtgtagcttatattccattggccaaggcaagtcacatggccaagcctggcaccaatggggtaggggagtatcctcctcccatagagcagcactgcagatctcttgacaatgagtgaggatatataatcctcccacagggaaggcagaaaggatttgggggcaataatactgtctgccacatgctgtcatgaatgctatctagttttagtctcttgataactctgtgaggtaggtattattatcctcattttacagagtggaaaattgaggtttggtgtggctaaccaacttgcccaagatgtagccagtaataagcacagctgcctgaatcgaagccagtaccaatggtatatagccagccttgggcttcttgaggactcattttcatatagatgttgtcattcagtaaacattgataaagcatctactatgtgcctggcgctgtgctgggcattggaaacacagtgatgtgcaagacagacactcttcctactctcatggagtttagagtccaaaggaagagagaggcagacaggacacatgtaaagtatgactggtatgtgcttctatgagggagatgcagactaaagcaagagtccatggagagagcatgcaaccagactcagagcataagaaatggacatgtctctgatgactgcacagaatgtaagagctggaggactgggtcacatggctgttgtcaaggccctgcctggcagggtgagtgccaagggcagtttctgattcagaattctaaagggcactcacaagagttcaatgccgatgggcatatgcccagcctgttgctaacgggactggacaaaccagtggctgtgtggcaggaacctaccatgtgcttccgactagtgagtctgacccaaagcccttttcaggcttcttctgggagtgttgcctctgccttacctacactcagagccatgcatgctgaaaaaaaaaacccaaagacccagagatgtcaacaacaacctgagagagaaagagaaacccagatttgatctgattttgaatcggcagagtgacacatgttgcttagactgccaacgcacgccactctcacttccctgaatggtttccattttagtggcattgtaataaaaagaagaaggaaaaaaatcccctgcaatggtttacaaagtgtaccgcaatagtaagaaataccattttctcatcactgctgctgcagcaccagagtatggggcccagcactaggcctgtctttgcaagcaggactaattacatagtaagtgattgcccctcaaacagagatggcatgtgtgctgggaaataggtcacttcttaatgaggtgaagctccagcaagaagcaagcacagatgcagactattcctcttgggatgcaaaaggcatctgaaaggtgagcacatatgtcccataggggagcctctggccaaatgtcacatctccagggaaatgtctttgaaacagatgactctactttcagcttggttatggacacacacaaccttgaaagtttcagaaaatatcacaaagccaaatatatatgtatctgcacgtgcacacacacacacacacacacacgtttgtgtatattaggattcttaagaaaagcagaaccaataagatgtatgtagacatatggaaaaatattatgagggattggctcactcaattatggcggttgagaagccccacgatctactatctacaagctggaggcccaggaaagccaatgatgtaattccagtccaacccagaaggccagaaaccaggggagtcagtggcacaagtcccaatccaggtccaatggtccaagaaccaggggcaccagaagacggacatcccaggttaagcggagagagaaagttcacccttcctccacttttgtgttctattctggccttcaacaaattggatgattgcccacccacactggtgaaggccatctttttactcagtctaccaattcaatgctaatctcttttggaaacaccttcacagacataccaagaaataatgttttaccatctatctagccattccttggctcagtcaaattgatacataaaattaaccatcacagtaggtatatgtatcttcttacccttgattgtatttgaaaactacacatggacactactgggctttgagtgtcgacttgctttaaaaatagtcttggagcttggaaaggagcccttcttggagagacaagcaaactgactcagcccgagggttatgggcagagaacctgcaaaaattgtggttcacagccaccatcatacattccttgctaactctgacacaaatggtaaaatgatgaagagctacacattgctggggaaccacggggcctgtgcattcagggtcagccggtggggaggaggaagagcagattaagcaagtatgtcccatgccccatgcctcaataatcaggataaatcatattttaataatgcagtattttagaaaatcaaattagcaaactatggccatgggccatctgcctgtgtttataaataaagatttattggaagcattttttctgaaactattccaagttttactggaacggagtgtagtgtgcctgtttaaattttacacccaagccaagtccttaccacctcatcttagtcctggccctgcctcatatccatttactcatcatttccttctcatccagcactacagagtgccaggcactaggagacagagctaacagttactgagcacttaatatatgccaagtactatcattagcagtttacacatattacctcacttaatccccacaacaatttcataggtaagaacagttattcatgccattttacaaaggaggaaactgaggcatagaaaggtgaagaagctttcccaagatcaaacaagtaggaagaggtagagtcagggttcatatgaagaagtttgagggctttgatggagatggatgcctggagaaaggaaggattactcagctctgagaggtcatcacagaggaggtgactttaagcagggtgttgaagggtgagtagaagattgctaggcagaaataataaatctaggttgctgtagtgtttcagaagagaaaatatatctggagaggttttctctggcttccctaggcccatgtgttgccctaaaatcagaacagcagcaaaataatacaaataaccaacatttattgagtgcttaccctatgtgctaggtactgaactaagtactttatatgtgttatctcattaaatcctcaaataaacctgagaaatgggcactactcttatttctgtctgacatatgaagagtctgaggctcaaaggagttaagtaacttgccaaagctatacagatagtaagtggctgagccaggatgcaaaaccaggggatgccacagtgtgaaccgcagtgggcactgctcatcttgtagtctgtgcaaaacccaaaaacttggtgccagagcttcaggcttagcaaaagcaatatgccagtggtgctcaaacttcacagtgcatccagttcacctgaagggcttgtttaaaaaaaaaaaagcaagcagatttctaggccaccttagaatcagagattctcatttaggaggtctgaggtgaggccaagaatttttatttctaatgctgctggtcctgggaccagacacggagaaccactgtatcacattgactctcagcaacagcaatagtactgtcctcctaagctgcaccagggaatacaagtacaggaggtagttgaaagaacatgcttcttccttcttagtatatagatcaggatccacttagtgagaaacattcaacctcccttctttttattccagttgtccttttctctgacacttgcatcaattttctgattgcctaggctcttaatattgctttctgttcatgtgggctttaatgacttgctcgacatgctagtgcttttgcagaattaggcagcccatgtcccaccacttctgctctgagcctgatgtgcctcttaaattgacacaaactccagctatcaatgtgagaaggatcatgtgtttcctgatggttctctaggctccacaggggccaaattacaccaaaaagtaattggtttcatgtattagtcaggagtctttgggttgcaagtgacaaaacacaatttgaactgatctggaaaaactgacatttactgacatacatatcctgatcacaggaagagcaagggtgccgctggtctgcaagcgtgacacatcagggctttaaatgctactgggactctgcccttcaccccctgcctctctctgggtatcagcaacatcctttcaggcaggctccaaacagcttcctttgactcccaagctctgttttcagtcccaccttgaaatagggataaacagacctggtttctggattctgggaaagggctcttggtggcctagcttagatagttgtccatccctggaccaggaccttggccattttggatgtctacccatacccaatctgagatggagtgggacagggcttgtagaagatgttagctttccctcaaaccataatgtcagagtgagtgaaggagcatttctagaaaagagaggaagagatatttggtaggaaaataaagccccagaggtgagtgggtgagtggaaggagggatgcatgcctcctcaggaccaggtgctgaggtggcagaggggagatggagagaggggagaaggaaagtctcagccttcctggaactcacagtctagaaaggccaagtcatgccagagatgtcagtggaggttggcagacatttctgtggatcacagcaggaggcatagcaaatatttcatctcaaatattttgagaaaacctgggttcttctggatgggctcatctattcacccccacccccaaccaacttttgagcatctactgtgtgttaaacaacatgtctgcactcaagaagctgagcattaatggaatgccctaaggtggcatcagaccttgtctctagtggatcaatcactcccaaagatgcatttaaagctccctgaaaaggagcatctgcgtcttcactggctactgtccccatcctccttatgttgcctgtaaggactctctttctatatccactcaggctttcacaggccaaggctctacctcacttttgcagggtaatctcactgagaatgaagagtcccctcactgtggctttctattttctcactctgggtctgtaagtggagacagtcttctatctctttatgtcattgcctttgatttccttgggattctccctgagattcgttggccatcttaagctgtggcttccagagctttttattaaaaatggaacaatcattgcaaagccccctcagccattcaatagtgtcactagagacacgcttgactccatttctctgactgagctggcagatgttgaccctgggagaggacaggaggcaggtaccactgggcccctgtttccctttctgtcttctccacaagcctctctgctccaggccttcttttttttttttcttttgaggcagagtgttgctctgtcacctgggctggagtgcagtggtgcaatcttggctcactgcaacctcctccgcctccctgtttcaagcaatcttcccacctcaacctccagagtagctaggactacaggcacgcaccaccatgcccagctaatttttgtatttttagtagagatgggatttcaccatgttggccaggctggtctcaaactcctgacttcaagtgatccgtccacctcggcctcccaaagtgctgggattacaagtgttagccattgcgcctggtctcaggtctcctctttctaagagtctagccatgagggtggaggaagaacgcaagccttgctctcaagccccgcctgtcttaagagtctgaggggcagcatagcctgaggaacttatgtgtggcaacgtggggatatcagtcacctgtctcttaccccactgggaatgtcagtagcccctgtctctacctctgcagcaatgtagtaaaccaagtttaaaggtgtcttgcttcatctttgtactttccatattgaggatacctttctctctgcctgtctgcctgggagcttctatttggtggctgtctttactgtctttatttcctcaatgcctagcatagtgcttggagcacaataggtattcaacaaatgactgatcccattaatggaactaatcaaggaaccatctcaaccattcccttaaaagtaagggatgagtagggacaatattgtgggggcttctgatgttattgttggatttggtgaatgataattaagagcacccttaaattccctttaaattcaaaatagattgaaaaatgagacaacatgagctttttatttgtatggctgattagtgaatatgatttagatctgtgtgctgaatacatcctctgctgaattaaactctcccccagacgcagacaggcctggatgacaccggcatcctctgggaataggctgcttttcaaaggacacaggaaagaagtgtgtcctcaggatattcccaaaagggtagaaaggccaccccacacatgcccatccctgtcatagctgggcctgctctgagctccctaaaccctcactgtgccctgtgcccatagtaggccactccaccatcactcttcttggttctcaagttccaggagctttgcaaacaacagatgcttccctagtataaaggaaagaacaagtctttgggccatgggtcctcctcttctcagtgtccctggataaagtcatctaatcaccctgagccttgctttcctcagtgaaagaatggggctgatctcaaccttgcctgccatcgaggctcagatgacctccaaatgcatcctaaactgctcacattcttttgcaaggagggtttttcttcctcaaagcaaatgggagggccaagtaagagaatttatacaagggctttgaaaagagctctgcatgctccttttggaaactgaggcaagtgagcgctaagtaactttctggaggcctcatcgtacaccagctgggattcagcctcaagttgtgcatgttggcctccaaaagccctgacttctcgctagaaggagccttctcaaatgaatcctatgacgacctaatgcaggctcataggtctcactccagaatactgaatcagagcatctgagatcagggcctggaaacctacaggttaacaggttccttgggtgcttcttactgcagtagctcaagctgtcccatggtgatgggctggagctgccacatacaggccaattgttctactcagttattctcatctctgccatttccataatgacttagcatctatacccatctctaaaatgttaaggcactttgccaaacattattttgtttaattgacagacagaaccatatagtggttaagaacctagtttctggagctaagctccttggtacccagttgcagctggggtgcctcccagcttcgtggtttgtgcctccatttccttctctgtaccatgggaatgcgctttgcatcctacctcataagagttgttagcagtgaagacttcagtgcactaaagtacatagaatagtgcctgttgtggagtaggtgcttaataaatcttcatttattattcctaatgaggaaatggaggatagatttgtgtaggatacagtaaaaagtggactgaccacagccaacacccaggttttctggttctacttctacacttccatgaacttaatctttgtttgcctttcaaagtcacttagaatttaaagcagtagtaaaaatacctcaaatgcagtcaaccaacaaatatttattaggttttactgatgtgtgcaggatgctgtaggaagatatgaatggatgttattagcacacctaagctgcttagatgggcttgaagggttgagagaacagagaagtagcggaatgaaagcagctttgaatggcaggagcttgtctagggagcagaggcctaggtctagctgagctgctcacctggtccccatcgcccacaaagctttaatcaagatattctgatcaggccaatgcttctgaacaggctaataaggaattaacacataaatgttgcttagcaaacttctccctagcatggaactgaaacagggacagtgctgagagggaggttttgttttgttgttgttgttttgtttttgtttttgagatagggactcaaatggcaaacaggtatttgacaaggtgctcaacatcattgatgatccaaaaaatgcaaatcaaactacagtgagaatcatctcaccccagttaaaatggctgttacctaaaaaacacgcaataacaaatgccggcaaggatgtagagaaaagggaacactcttggtgggagtgtaaattagtacaaccactatggagaacagtttagaagtttctcaaaaaactaaaattagagctaccatacgatccagcaatcccactgatgggtatatacccaaaagaaaggaaatcaggatattgaagagatgcctgcactcccatgtttgttgcagcattattcacaatagccgagatttggaagcaacctaaatgtccatcaacagatgaatggataaagaaaatgtggtacgtgtacacaatggagtactattcagccataaaaaagaatgagattctgtcatttgcaacaatatggatggaactggaggtcattgtgttaagtgaaataagctagtcatagaaagacaaactttgtttattttcacttgttggtgaggactaaaaattaaaacaattgaactcatggacatagagagtagaaggatggttaccagaggctcggaagggtagtggggagggggaagtgggtatggttaataagtacaaaaatatgattagatatataactagaatgaataagatctaatatttgatagcacgaagggtaactacagtcaataataatttattgtacgttttaaaataactaagagtataattggattgtttgtaacacaaagaaaggacaaatggataaatgcttgaggtgatggataccccatctaccctgatgtgattatttcgcatcgtatgccagtatcaaaatatataatgtacttcatatattatacctacagtgtacccacaaaaattaaaacagtaaaatttttttaaagagagagagagacagggtctcattctgtcacccaggcaggagtgcagtgcatgttcatagtccactgcagcctagagctccagggctcaagagattcaccagcttcagcctcccaagtagctagggctgttggtgtgtgccaccacgtccagttattttaaactttttgtagagatggggtctcactatggttgcgtaggttggtcttgaactcctgatctcaagtgatcctcttgctttggcctcccaaagtgttaaaaatataggtgtgagccactgcacctggtctttagtctggtttttgacaagaaagagccagccagctgtctgcccatgtctttgagctacatgaagattagatcccattagtcttggagagggagcaacaagaaatagaagagggcacagaactgcacgtagcctcacctacttcaaaagtttcccctaaaaccccttaggcattcaggaatgggtgagaaaagggttttctttctatgagagtggggattcctctataaaatttccggctttcaggatagcggactcacattaaagtgttaggggctagcctgaaaacctaaattgttttccttgacaaaatgtgccatagatgcgaatacctgattctggttaaagagttggtttttgctgattatgtagtataaaatggaatctgttttccactttccttctcttctaccatccctttgctttttctatgctctctcctctctcaccatttgttccattcatgctctctctcttctttttcgtctccttctttttccttctcaccccactcctcctttttttcctctctctctccctcttcttttcctctctgtctatctgttcttgttttcttaaccccatattctacaaagcatttagggtggcttgcagaaatggaaactaatatagtaaaatgtaagtaaaacatgtaagatctggctgggtgcggtctcatgccttcaatcccagcactttgggaggctgaagtggatggatcacttgaggctaggagttcgagaccagcctgaccaacatggcaaaaccccatctctactaaaaataccaaaattagccaggcatgatggcacatgcctgtaatccgagctacttgggaggctgaggcatgagaatcgctggaacatgggaggcagaggttgcagtgagccgagatcatgccactgcactgcagcctgggcaatagagccagaccctgacttaaaaaaaaaaagaaaagaaaagaaaaaaaaattgtgagtcagatgctcaatggcatcaaggagataattcatatagaaaacaagtattcaggaatgaatttattgaataaatcatcataattaatgtgtttttcaggatcaagaggagcaaaataatttaggaacaaatagttctgatgagatgctaaaaacttacctaatgtgtatacgacttcatcttttttcttcagtcttgaccactttttggtgcgaacttctccattgactttgagacccttaaccctatatatttttaataatactattggggtagctaaaataaattagtacagtgaagtatatctctagtctcttaaatacatctctaaataatgaatatattcctgaagatttctttgtatttgtaattattgcagatcaaatattttatttccatagaaaactgaccttctaaagatgatacaaggtgtctctctttagtattaaagaatttatgctttaaaactttagatactgggtatggtgactcttgcctataatcccagtattgtgtgaagctgaggtgggaggatcacttgaggctgggagttcgagaccaatttgagtaacaaagcgagactagattgagcaacaaaatgaggccctacaaaagaattaaaaaaaaaaagttaaattaaaatagataaataaacaaaattttagaaactttgggccaggtatggtagctcatgtctgtaatcccagcactttgggaggccaaggcaggaggattgcttgaggctaggagtttgagaccagcctgggcagcataggaagaatctagctctataacttttttttttttttttttaaagaaaaatcagctgggtgtggtggagtgcctttaatcccagctactcaggagactgaggtgggaggatcacttgaccccaggagttcgaggtttacaaagcactatgatcgtgccactgccactccagccagggcaacagagccacaccctgtctcttagaaaaaaattttaaaaaggccgggcgtggtggctcacgcctgtaatcccagaactttgggaggccaaagcaggtggatcacctgaggtcaggaggtcaaggccagcctggccaacatggtgaaaccccgtctctactaaaaaatacaaaaattagccaggcatggtggtgcacgcctgcagtcccagctactcgggaggctgaggcaggagaatcacttgaatcaaggaggcagaggttgcagtgagccaagatcacgccattgcactccagcctgggtgacagagcaagactccgtctcaaaaaaacaaaacaaaacaaaaacaaaaacaaaaaactagatattttgcacgttacctttttaaaagcctgacatatctgtatgatatccctgcactaaacatttgctatccataatgaggtaaaatgtgcttgggctttttccccaatgtgaaatatgcttaattgtcttgtaaaactgtcttgagtaatcccagcactttgggaggccgaggtgggccgatcgcgaggtcaggagatggagaccatcctggctaacacagtgaaaccccgtctctactaaaaatacaaaaaaattagccaggcgtggtggcgggcacctgtagtcccagctactcgggaggctgaggcaggagaatggcgtgaacctggggggtggagcttgcaatgagccgagatggcaccactgcactccagcctgggcgacagaacgagactccgtctcaaaaaaaaaaaaaactgtcttgagttttctttctttctttttttttttttttaacagtcttgctttcttgcccaggctggagtgcagtggtgtgatctctgctcactgcaaccttcgcctcctaggtttaagcaattctcctgcctcagccacctaagtagctgggattacaggcatgcaccaccatgcccggctaatttttgtattgttagtgaagatggggtttcaccatgttggccaggctggtcttgaactcctgccctcaaatgatccccccaccttggcctcccaaagtgctgggattacaaacatgagccactgcacccggcctttgagttttcttttattccggctgcatacctcccagttaatctgacatctttctcacctcattaaactggctccaactgctaatacgtcatcaaattcaaaagaaatgcgacccgctaccaaaatccagatctgaaaacatttaaccttaggctgtggttcaaggtgcaaagaaagctaatatctaataaagccttggtatagtgtgttccttgagtcaacgtttgagaaactgaatgacatagagctgcgtgaaagtttagggggtaaaagtgtatttgattgaatgtaattaatgtgtttttctgaatgattttcttacagttcacaatgaaccttccaattttacagtaattttcttggccttgattttctgatctgtcttaatttagctgtcaatactatgagtaacaaaattcagtttcattggtgatccttgaaagagaaattccaaaaataaagggctataagcacctcctatgaaaagattcatgcagctgtttcatctaatatggatctgataggtttcctttatgtccagttcttcctttctcaacattttctctgattttcaggcagatgcaaatagaattttcagtgctacggcttctctgacttaaattttctgtttcccttgtgtttgtgccaattaaaacaagactcagtctgtgcttgtgacatatttttggaaattcattgtgtaagaaatattgacattctcttgtattattttctctgagtctttacccacttcatcacaattcttgcctttcttttccttgaagtctgtgtgtttcatatgttttgaaaacttctgtcacatattttagttattataatggataactgcattgaggagaaagctctaaatcataggcttggaatgactagttctagaagcatttcctaaagcacatgcccctcctcaatagacatttctctgccatttattttgtgcagcagttcatatttgtggcctgatgctatctcttttctcagaaatttcagtaagtgtttcaacttgagtaatcatttacagaaacataatgtagtggacattcaataataaactattgccatgacattgaattgtcttatgatctttggtggaagctgtgtgaatatttacattgtcaggatcatgcacctacccgttatgttctgccttcctttctctattcttttcttttcttttttttgagacagagtcttgctctgttgcccaggctggagtacattggcatggtctcagctcactacaacctccacctcctggattcaagtgactcttctgcctcagcctcctgagtagctgggactacaggtgtgcgccaccacacctggcttatttttgtatttttagtagagagggggtttcaccatattggccaggctggtctcgaaatcctgaccttgtgattcgcccacctcagcctcccaaagtgctgggattacaggcatgagccaccatgaccagcctgctttcctttttcataatgtgattttcatgtacacgtctctgtgtttttcagcttcagataaaaacttgctatcttttgggcatttctttgatatatcatctccaaagtgacttattaagtcaaaaatataaattattttatcatttcctggaatgctttttctacaagtaacagaaaattatatctcagttggcttgaacaacaagaaaacaatataattgcccataacaagaattcctgtggtagggctgctatggagttgtttaattttacaacacagtgacatcctcaagggcccagtttgcttccatgtttttgttctgccatctttgggggaacatctctgttgtgaaggatgtcctcatggtcacaaaatggctgccacagcataaacatcaccgtacctcacagatatgacaatgttcagtggaagaagaaaaggaagtttcttcatctgtgtctcttttaacgagcaagaaaatattagagattcctcatcagtctctgtttcattgttcattcaacatttctttggccagtccctttcctaaaccagtccctggcaagggacataggatttctaccatgaatttagtatgggttctgttctacagagtaagggtgctttctgctacatgtcctttgacatgtggcctaggttattattatctcaagaggcaaaactgctttatagtaccaatctgcagtctaataagtgtgtttgttccctaacaaagctaagtttctatatgtttttgcttattgttataaatttgaagggtccttgtataatgaaaatattattgtaatttatgtttcttcagtgataacaaagtcatatgcagtctttttagaatgagttagtttgttttcatttcctctagtgttttacctacactgaatttgaaaactccattctaaccaattttatatagtcattgtgccagaatatttgccaccactcattattctgtaacatttttgagtcacagaccatatctactaaataagccaacattccaaaagtcttccttataagatgttaacatttaaaagtaggggaaaataaaagaaagaaaaggaaggaagggagggaagaaggaaggcaagaaggaagaaagggagggagggaggaaggaggaaggaaggaaaaaaggaagaaaggaaggaaggaaggaacgaaggaaggatcgaagggagggagggaaggaggaaggaaggaaaagaagggaaggaagggaagggaagggaaaggaagggcgggaggaggaagggaggaaggaaggaagaaaggaaaagaaaaagcaagcaaacaaagaagtgaagggatagtaatgtggtttggttgtatccctacccaaatcgtatctttgaattgtagctcccataattcccacttgtttcgggagggacctggtgggagataattgaaccatgggggtggtttcccccactgttctcgtgttagtgaataagtctcacaagatctggtggttttataaggggaaaccccttttgcttggctctcattctctcttgtctgcctccatgtaagatgtgcctttgccttctgccatgattgtggggcctccccagccaagtggaactatgagtccattaaacctcttttcctttataaattacccagtctcagttatatctttatcagcagcatgaaaacagactaatacagatgtgttgagaggtcaaaaattctagatactttgggattgaaagacatattgaatctggagcgaaaaggacaccccatttaacaaactgccaaatgcccctctcccaagggcccctcccttcccacctttatctgaacatcgaagtgtgccatcctgttgtcttgcccaacaatgaatggcaaggcaagcagctgggactatctactcgtagcttgtcacaaatgtgctccaactccagaggatggtgcagtaatttcctccctttttctttcgggttgtgctttctgctactcaaaagttctgctctcctgtgatcaagatggtaagtcctgtttcatgctgttgcccctttggaattgtgccttcaaattccatttgcctggaacagtcacattcttcagagtgatgggcctcaaccacaaaacagcaacagcaaaaaacatttttctctaatatttgttactccaaataggttatcttcaatacgttattgtggtaagagattcttctcaggagtgtttgctgctgtcaggggtaacatggtgaaggatagagcaagccctgccatgctccagtctcagctggctgtgtggattccacccaggaaaaccctgccagcttctcctactgtgggtccatcacagtctgtccattcttgtcccatctaagatataagttgtcatagatggctgccccctccaccattcgccacgtgggcatgtaggtcacatctcaatatgtccctaaagatccctctcctaatctaaatgctgaacttccacgtcagttaaggattgtttctctaaacacacaccaaaaggggaaaacatagttacttcctaaattcttatatccagaatggaaataatttcgggaataacaaactccttatgtttaccactgttccactgtttaagtcactgttttcttttttctttctttctttttttttttttttttcttttgtggcagggtctcactctgtcacccaggctggagtgcagtggtatgattttggctcactgcaacctctgcttcctgggttcaagtgattctcgtgcctcagcctcccacgtaactggggttatagagcccagctaatttttccatttttggtagagacggggttccagccatgttggcaaggctggtctcgaacttctgatctccagtgatccgcctgtctcagcctcccaaagcgctgggactacaggcgtgagccaccgtgccttgcctgaacgcattgttttcttaggggttggctagatgtcttcatgaagatgcaacaggctgcacttcagtgtgtcagaacaggtgtggcacagtgagcccacatatttctgtatagtgtcgtcaaagctctttccattagtgaccctatgtaagcgtaccccaagttgatcctagtctaaaaagcagggtctcagggcagagttcagagccagctcctcagattcttagtccttgcttcaagagctacctttaaaatggctcaaaaattcaactctctgtcaaagtaaaagtgaagccatctggctaggttgaacaaaggcagcttcgctttactgcaataggcatcagaccaaagccacagatcatttgggtgtgggaatgtaaagctgaatcagtgacattgccagaaaatggcacatttgccagaatactttgccttttgttccttgtgagataaacatgagcccagaatcctgtaaatctgtggtaatatttttactcttggagaaaaaaattagaagacaacgttgagaggctttttccgcattttccaaatttccttttggtgccgagtaatttgttttcaactagtgtaagagggccatcttgggctagtagggaagtcctctaagttagggctcagggatatgggcttcctagggcaattaccccttacctctgtttctgactgttgggggttcttgaagcagctcacccagggtgagactggtgcagagagcaacatttctgcctccctggttgggaagggagccaggttatttttttaagtgctacctattgacagcattttctctatgtctcagtttttcttcttcctctaagagctttttataatagccttaaccatcatcacatttttttttttcttttttttttaagacagagtctccctctgtcactcaggctggagtgtggtggcgtgatcacggctcactgcagcctcaacttcttgggctcaaggcatcctctcacctcagcctcccgagtagctgggactacaggcaagcaccaccacacccagctaatttaaatttttttttttcagagatggggcctccctgtgttgcctaggctggtctagaactcctggactcaagcaatcctcctatcttggcctcccaaggtgtaaggattacaggcgtgagccaccacacttagccaccacacttggccaccacgtctttaagattatgaataaaaaggtgtcactttcgaagattctcaaagggagtaactcctccccctaatactgagctgcagtccatcttaagccttgctggtatacatctcaaagaagaagatattgaggatagcttgtgcaacgtagctctggtggccgctaaggaaagagcaaacagctctatggctgcagacatcaggctttaaatgacaccaggatggtgaatgacctaggaacataaacaaagggatgtctcagctgggacataatcgcatcctggaagcttgaaggctgttttgtagaggaagaatagacgtgtgtttgactccagaagaccatgctaggaccagtagttacataaaattaaattctagctcagtgtcgagaagaacattctgacctgaaagttgctaaaaatggaatgggctgtgtattggtttcctaggactgccatagcaaagtaccacatattgggtggcttgaaacaaccttgttttttttctgggttgaaattaatttcttctctcacagttctggagcctagaagtccaaaatcaaggtgttggtagggctatactctctctgaaggtctaggggtgcttccgggcctctctcagcttctgctccccgaagcattgcttggcttgtggtagcataactgtcatctctgcctctgtcttcatgtaaccatcttcttggctgtcagtctctcttcttattaaggactcccagttatattggattaaggcccaccttgatgacctcatcttaacttggctacatctgcaaagatcctatttccacataaggtcatattttgaggtactaggggttaagatttcaaaatatctttttaattttatttactttgtttatttattttgagacagggtctacttctgtcgcccaggctggagtgcagtggtgtgatcatgactcactgcagccttcctgggctcaagtgattctcctatctcagcctcctgagtagttgggactgcaggcatgcaccaacacaaccagctaatttttgtattcaaagtatctttttgaggaacacaattcaatccataacaggctgcctttatgaaagtgagttccttatccctggaagtgtgcaaatgtaatcagagtttttcaaaatacttgaagaggtgtaagcgctaaagagagaatgcaactagatgacttctagcatctcttctgaccatagcatttcctaatgctatgagtcctgtagtaaatgactctactaaatcctgggaccacacttgggaagaccacacagtcttggtgaaatgtcacatgcacggaagcatagtctagcttccaaaaaccattgaaaggagtttcaatcttttcttttaaattcatatatatgtatatatatatatatagagagagagagagagagagagagcagagagagtttatttgggccaagcctggggactgcaacccaggagcatagattcaagttgccctaaatatacactccctccttttaattcttaaagaacatcaatgaagatccctttttctgtcccctgcagctgctcctcttggagtctctctgttcagtactcttttggtcacacatgacagaatcctaattcaaagtgccttaaaaaaaaaaaaaaagataatatcttcttgcaaatttgaaaagtccaggagttgttgttttgggttggactccatttcccagctttgccttcctctctgtgggctttctcttctgcatagtgtttccactaagaggtggccaccagggttcccaggtgttatttagcaattgagcaatttagcaaactcattgagaagagtttccttcttccagcattctaagggaagtcccagggctggctctcattgggccaactctgtcacgtgcatttatcacatgcccatccctaaacttgtcagtaggacactgaccacctcctgaggaagaaaacttaggaatggaggcacctctatgtgagttgcataaactaggaatagaagagggtagcagcccaaagggaaattggagtgctattaacataataagggggagtccgtgttgggagggccaaaggccaaaaccatcactgtctactctgattcctcccctcacaccactattctctcttccttcctctcctcattctccctccccttcctctctccctttcttctctccctctgtttttctctctctcctttcctctctctctccctcttctttttcactctctttctctctgtctccctttcttctcctcctctctcttttactctctccccctctttttctcccctcacatctctcttcatctctccctgtctctcaccctcttcctcctctccctcaagtctaggcagctcagcctctctcttttttctcctttctttttcctcctgcctctccagcttatctcttcctacttattttcccaattcagtattataaatacctagctactgggctggcaaatactgaactctcccttaagggtaaggacgggaaagaaatggagcctgccagtgccaggttcctttagcagctaaggggagggaggacgggaggaactcccattggtaacttttattcacatcgtatatcaaatcatcagagtgatcctgtgtcattttgagttgtgagtgctttaaaaatttgcatgtgtgtccaggacagagatagatgaatttgcacatgacggcagaggaagactttgggatgtatccactttgatgctaagttatggatacatcccaaaagactagacaaacagtatctgtgttttagcttccagacttctgtagtgggtccagccaaactcccgaatgggtttttaaacttgagaaacctcaggcttttttgtttccaatcatacaagcactcttgaattgaaagcaacactgggtcataaagcaatatgaaaactacataactaatatcttgatccttctgctttcagcacatttagccccacagcagtttagactcaaaccctctaaacaaaccaaccccctcaccccactcacaaacagcctgccaagagcattgagcgtccagtccctggactccatcctgaccacctcctactcccccgtcctgcatcactggtcttgctttggtcatctctgtgttctccattgctctgtctcccctccgccaccccacacccacaggcttggtgagttgtcccccaacactcatatttagactctcccttcctcaagcccccttgctctctgactctgctgggaggctctgatcctgagccctgccatggacctggttctgggagttgacctttgccccacacccatcagctgcgagtcaggggctctcttgttctatgccttgacctggtggtacccaagtgcattcatttgctagaattcatttgccataacaaaataccacagcatgtctacaagccaccagggctgccatgtataacactgggtggatgattaccctaaaacccttctggaactttccagataattcttttaaaaatattctcttttataggcttctacatgattcaagtgagtttcctaaatggctgggtgagctcccataggtgacctgacactgccacagccctctcccacccagggactggagaggaagctctggcaggacacccagaactcagggtggaaatggaacatcctggccacctacccaggagaggcctcatgtagtaagaaaagggagaggaaggagcagtgctagaaatcagattatacagacagaaaaccacctcccagactgcctgatggcagggggtgggtctttccatcttaatctttccagcccaagcaccatgcctgcaacacaacagaaatgcaaggaatgcagttgaggtggtgcattagtctatcctcacgctgctaaaaaagacatacccaagactgggtaatttataaacaaaagagatttaattggctcacagttccacatggctagggaggcctcacaatcatgacagaaggtgaaggaggagcaaagtcacatcttacatggcggcaggcaaagagagcatgtgcaggggaactcctctttataaaaccatcagatctcacaagacttattcactgtcatgcaaacagcatgaggaagacccgtcttcatgactcagttacctcccaccaggtccctcccatggcgtgggcattatgggagctacaatttgagatttgggtggggacactgccaaaccatatcaggtggggagtgatgtgagcacagctacatttctgaaaaataatgatggtcatggaatggaagacagatctgagctgaggaccttggaggcctgaactggtgcacttgccatgaggatggagaggaaggatgaggcaggaaagatactgcaggtcccagcttctccatgaatccaagggctttgctctccactctgccttcagcctagtgacacaatttatacagcaagagaaggaatgtcacagaccaccagatgggtagctgacccttccaagagcacaaagactctaaatatgtccctgtcaccacctgctgttttaacaactagttgtttaatacatctcctctggatggaaactagatccaagacagtgactctgggttttgtttaattttatgtcacatttttagggagcaaatgttaaatatgtttccagcctagtaaaataagggtggcaaacttaatcattagagtatgtggagaatataacaggatcttttattggacctggaaaggggccccactgaatggtaatatttgtgaaataattggagaggaaaccaagttttaagctattagttctctaacctttgagtagggaaaaggaacagtcccttgaacttgctgcaagtctcatggttgcttaaaaaggctttaatttctgaggactggcacaggctagccaaaacaaaccatttccaaaattagtttgggcctcaagggtcctgtaaaactcattttaaacaatgtaccatgatccttttttgctctcattttgtgcaattggagtctgcttccttcttcatatacagaaggatgtttaaaacgcacctttgagggtagggtgttgaaacacccagttttctgacccactctcagatgctatgacagagaaaagctcttttctccttcaagagaggtccaagcttctgagtgtactgtggtagctggaaagctattgcagcttcatgcccagatatgcatctgtgtgtgcacatgcacatgggtgtgtgcatgggctgtgcacatgtatgtgtgtgggttggcatgcgtacacacaagcctgcacataaatgtctaagagtgcatgtgtgtgtgcatgtgtgtacataagaacatatgggccaggtgtggtagttcacgcctgtaatcccagcactttgggaggctgaagcaggtggaccacttgaatccaggagttcaagaccagcctggcgaacgtggtgagaccccatctctactaaaaatacaaaatttaactgggcgtggtggcatgtacttatagtcccagctacccaggaggctgaggtgaaaggatcacttgagcccaggaggttgaggctgcaagtgagtcatgatcacgccactgcatgccagcctgggtgacagagcaagagcctctcttgaaaaaataaataaatatataataaagtaataaaaagtaaataaataaatattgattccatcacttgttagctcagtcattttaacttttgcaagcctgttttctcatctgcagagcggggataatattgtgtctacctcatcatgttgtatgaggattaagtaaggtaatacacataaaggctatatatagtacatcctctggatagtctcgctgtcattactgctactattgcagccccgctggcaaacagagcaagggggttgagaagacatggggccacactggcaagacattgagggttttatatacacatatatatatttgagatcctttaacatccactcagaggcactcagagaggactcccctactcaaggagaaatagttggggttgcaggagaggtttccaataacctatggtgagttcgagaaaaataacttatccaaaagatggaccttcctgtttctcaatgagctctcctaagagagagcagaagagggagagggaattgccctctatttggaggccgcagggcctggtcctcatagctatcctaaggaagagaaagctcaggaccaaggaagagccaccacctggagtggggagggtgggacggggttgcatcctgccctcctccttcaaacccggggcagagcttcccatccagaggaagcaggccccatcagcttatcctggggtggggcttcctaaagccaagtgtttaaaggcagatcattgttctgaagttccgctaagttctaatgcccaccctgctgagaaatcctccaagaacaaagtgagattttaaaaatccacagggttacttggagccaaaggcaattaagaggaagagaaataactggccaagtctcaatgtgatggctgtctgtgcagagactctagtgaggaagagagctaaccccattctttttgttgtgatcaagcaagatgattccccagtgggccaatcttttgcctataaaatggggttgatatgattttgtccaggaagaagtctggtttaggaaaagcagaggcattcttgtctccttcagtcccagcttagtggctactgactgtgagactttgacaacttattttccaactcagagccttgtatctctccttgaaacccaaaaggccgggctccagacttcctcaaagttcctttgctgtgtctatgacagtgggctgatgaaggtagaagcaggggtgtgatgaggacgagaataatcaggatggataggaaggctggaaggctgagaagggtataccaaagtcccagcaaacaaaagcgaacactcaatagccgtggagggcgcctcaccatgtcctctccataagccaggctacataggtcatcatctgggatcttatttttctgaattgtttgtggctcagctcttcttaatatggtactttctgaccagggcgggggagtggggagcctgtagtctcagctactcaggagactaaggtgggaggattgcttgagctcaggcattcaaggctgcagtaagctatgattgcaccgctgccgtccagcctgggtgacagcgagaccctgtcgcaaaaaaaaaaaaaaaaaaggggggatagtccattctagctgcccaatgtgcatgaccttgtgaggtagtaagaaccatgaccaggaaaaggccatgtcatccatcaggtgactttgtagaggaggcttctgccctgatgggagagtagcttaggcagcctcgaggccccttccacttcaatttgggaaatatttaatgagctcccactgtgtgccagcccagactgtgctgactgaggcctggggtgggacagcagggaggacagtccctatcttcaaagtgctcagggtctggctgggcacggtggctcacgcctgtaatctcagcattttgggaggctgaggtgggtgcatcacctgagatcaggagtttgagaccagcctggccaacaaggcgaaatcccgtctctactaaaaatacaaaaattggctgggcttggtggcgtgcacttgtaatcccagctacatgggaggctgggtcagcaggatcacttcaaccttggaggtggagattacagtgagccaagatcacaccaagatcacaccactgcaccactccagcctgggtgacagagcaagactgcctcaaaataaataaataaataaataaaataaaaacaaataaaaataaaaaaaatgtgctcagggtctcaccacccagacatggtctagtctagtccacccatgtggttcctgcctctccagtttagggggatggactgaggcctgggaccatctgttcccagtgccctctgccttctctcttgtagcattcttcttttctccttcggcactctctgaagctcctgtcgcccaaaacttcctgcccagaactaacacttctcatttaacaaacacttggatgagactaactgtgtataagcccagttcctgcccacaggtgctttgcgtggagaacggcccgctgaagcagcatcgaccaggaagcaccatgagacacatgtcagggctctccctgcctaggccctaatttgtgtcccactaaatggggccatgatcagaactgtgagttcccagcagagggtggaggtggagatgccacactggggctgagctaagacaccaccaaggaggagctggcagcagaaggctgagtcccaggatcccctgtgtacttagcttacacaaatttgagtgtagattcttccttttctttccttttttttttttttaaagactgaaatttttgtatttattgaatggaccattccatttttctctattttttttctttttttaattatactttaagttttagggtacatgtgcacaacatgcaggtttgttacatatatatacatgtgccatgttggtgtgctgcacacattaactcgtcatttaacatcagggatatctcctaatgctatccctcccccctccccccaccacacaacaggcccccggtgtgtgatgttccccttcctgtgtccatgtgttttcattgttcaattcccatctacaagtgagaacatgtggtgttgggttttttgtccttgccatagtttgctgagaatgatggtttccagcttcatccatgtccataaaaaggacatcaactcatcattttttatggctgtatagtattccatggtgtatgtgtgccacattttcttaatccagtctatcattgttcgacatttgggttggttccaagtctttgctattgtgaatactgccgcaataaacatatgtgtgcatgtgtctttatagcagcatgatttctaatcctttgggtacatacccaataatgggatggctgggtcaaatggtatttctagttctagatctctgaggaatcgccacactgacttccacaatggttgaactagtttacagtcccaccaacagtgtaaaagtattcctatttctctacatcctctccagcacctgttgtttcctgactttttaatgatccccattctaactggtgtgagatggtatctcattgtagttttgatttgcatttctctgataaccagtgatgatgagcattttttcatgtgtcttttggctgcataaatgtctccttttgagaagtgtctgttcatatccttcgcccacttgttgatggggttgtttgtttctttcttgaaaatttgtttgagttcattgtagattctggatattagcccttcatcagatgagtagattgcaaaaattttctcccattctataggctgcctgttcactctgatggtagtttcttttgctgtgcagaagctctttagtttaattagatcccatttgtcaattttggcttctgttgccattgctttttgtgttttagacatgaaatccttacccatgcctatgtcctgaatggtattgcctaggttttcttctagagtttttatggttttaggtctaacatttaagtctttaatccatcttgaataaatttttgtataaggtgtaaggaagggatccagtttcagctttctacatatggctagccagttttcccagcaccatttattaaatagggaattgtttccccatttcttgtttttgtcaggtttgtcaaagatcagttagttgtagaaatgtggcattatttctgagggctctgttctgttccattggtctatatctctgttttggtaccagtaccatgctgttttggttactgtaaccttgtagtatagtttgaagtcaggtagcgtgacgcctccagctttgttcttttggcttaggattgacttggcaatgcaggctcttttttggttccatatgaactttaaagtagttttctccaattccgtgaataaagtcattggtagcttgagggggatggcattgaatctataaattaccttggacagtatggccattttcatgatattgattcttcctacccatgagcatggaatgttcatgcttttgtttgtatcctctttgatttcattgagcagtggtttgtagttctccttgaagaggtccttcatgtcccttgtaaattggattcctaagcattttattctcttcgaagcaattgtgaataggagttcactcatgatttggctctctgtttgtctgttattggtgtataagaatgcttgtgaattttgcacattgattttgtatcctgagactttgctgaaattgcttatcagcttaaggagattttgggctgagatgatggggttttctagatatacaatcatgtcatctgcaaacagggacaatttgacttcctcttttcctaattgaataccctttatttccttctccttcctgattgccctggccagaacttccaacactatgttgaatgggagtgatgagagagggcatccctgtcttgtgccagttttcaaagagaatgcttccagtttttgcccattcagtatgatattggctgtgggtttgtcatagatagctcttattattttgagatacgtcccatcaatacccaatttattgagagtttttagcatgaaggttgttgaattttgtcaaaggccttttctgcatctattgagataatcatgtggtttttgtcattggttctgtttatatgctggattatgtttattgacttgcatatgttgaaccagccttgcatcccagggatgaagcccacttgatcatggtggataagctttttgatatgctgctagattcacatcaaataaaatactgatgtgccagtattctattgaggatttttgcatcgatgttcatcagggatattggtctaaaattctctttttttgttgtgtctctgccaggctttggtatcaggatgatgctggcctcataaaatgagttagggatgattccctttttttctattgattggaatagtttcagaaggaatggtactagctcctctttgtacctctggtagaattcagctgtgaatctatctggtcctggactttttttggttggtgagctattaattattgcctcaatttcagagcctgttattggtctattcagagattcaacttcttcctggtttagtcttgggagggtgtatgtgtcgaggaatttatccatttcttctagattttctagtttatttgtgtagaggtgtttatagtattctctgatggtagtttgtatttctgtaggattggtggtgatatcccctttataattttttattgcgtctatttgattcttctctcttttcttctttattagtcttgctagcggtctatcaattttgttgatcttttcaaaaaaccacctcccggattcattgattttttgaagggttttttgtgtctctatatccttcagttctgctctgatcttagttatttcttgccttcggctagcttttgaacgtgtttgctcttacttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtacccagtagtcattcaggagcaggttgttcagtttccatgttgttatgcggttttgagtgagtttcttcatcctgagttctagtttgattgcactgtggtctgagagagtttgttataatttctattcttttacatttgctgaggagggcttcacttccaactatgtggtcaattttggaataggtgtggtgtggtgctgaaaagaatgtacattctcttgatttagggtggagagttctgtagatgtctattaggtccacttggtgcagagctgagttcaattcctggatatccttgttaactttctgtctcgttgatctgtctaatgttgacagtggggtgttaaatctcccattattattgtgtgggagtctaagtctctttataggtctctaaggacttgctttatgaatctgggtgctcctgtattggatgcatatatatttaggatagttagctcttcttgctgaattgatccctttaccattatataatggccttctttgtctcttttgatctttgttggtttaaagtctgttttatcagagactaggattgcaacccctgcctttttttgttttccatttccttggtagatcttcccccatccctttattttgagcctatgtgtgtctctgcacatgaggtaggtttcctgaatatagcacactgatgggtcttgactctttgtctaatttgccagtctgtgtcttttaattggagcatttagcccatttacatttaaggttaatattgttatgtatgaatttgatcctgtcattatgatgttagctggtgattttgcccgttagttgatgcaatttctttctagcatcgatggtctttacaatttgacatgttttcgcagtggctggtaccagtttttcctttccacgtttagtgcttccttcaggagctcttttagggcaggcctggtggtgacaaaatctctcagcatttgcttgtctgtgaagtattttatttctccttcacttatgaagcttagtttggctggatatgaaattctgggttgaaaattctttcctttaagaatgttgaatattggcccccactctctcctggcttgtagagtttctgctgagagatcaactgttagtctgctgggcttccctttgtgggtaacctgacctttctctctggctgcccttaacattttttccttcatttcaactttggtgaatctgacaattatgtgtcttggagttgctcttctcgaggagtatctttttggcattctctgtatttcctgaacctgaatgttggcctgccttgctagattggggaagttctccaggataatatcctgcagagtgttttcaaacttggttccattctccctgtcactttcaggtacaccaatcagatgtagatttggtcttttcacaagtcccatttttcttggaggctttgtttgttactttttattcttttttctctaaacttctcttgtcacttcatttcattcatttgctcttccatcactgataccctttcttccagttgatcgaattggctactggggcttgtgcattcatcacgtagttctcgtgccgtggttttcagctccatcaggtcctttaaggacttctttgcattggttattctagttagccattcatctaatattttttcaaggtttttaacttctttgccatgggttcgaatttcctcctttagctcggagtagtttgatcgtctgaagccttcttctctcaactcgtcaaagtcattctctgtccagctttgttccattgctggtgagctgcattcctttgggggaggagaggtgctctgatttttagagtttccagttcttctgctctgttttttccccatctttgtggttttatctacctttggtctttgatgatggtgatgtacagatggggttttggtgtggatgtccttgctgtttgttagttttccttctaacagtcaggaccctcagctgcaggtctgttggagtttggtgaaagtccactccagatcctgtttgcctgggtatctgcagcggaggctgcagaacagcagatattggtgaacagcaaatattgctccctgatcattcctctggaagttttgtctcagagcagtacccggctatgtgagatgtcagtctgcccctcctggggggtgcctcccagttaggctactcgggggtcagggacccacttgaggaggcagtctgtccattctcagatctccagctgtgtgctgggagaaccactactctcttcaaagctgtcagacagggacatttaagtctgcagaggtttctgctgccttttgtttggctgtgccctgcccccagaggtggagtttacagaggcaggcaggcctccttgaggtgcggtgggctccacccagttcaagcttcctggctgctttgtttacctactcaagcttcagcaatggcaggcacccctcccccagcctcgctgccgccttgcagtttgatctcagactgctgtgctagcaatgagcgaggctctgtgggtgtgggaccctctgagccaggcgtgggatacaatctcctggtgtgccgtttgctaagaccattggaaaagtgcagtattagggtgggagtgacccgattttccaggtaccgtctgtcacccctttccttggctaggaaagggaattccctgaccccttgcacttcccaggtgaggcaatgcctcaccctgcttcggctcatgcttggtgtgctgcatccactgtcctgcacccactgtccaacaatccccagtgagattaacccagtacctcagttggaaatgcagaaatcgtttgtcttctgcgtcactcatgctgggagctatagactggagctgttcctattcggccatcttggctccacctcttttctttttttttctttcattctttctctctatatctcttctctttcctctttctctcttttcctctcgcctgcctgccttccttccttccattttctctctctctcttcctttctttctttcctttccctccctttccttccttccttctctttctttctttctttctttctttctttctttctttctttctttcttctctctttctttacaagatcttactctgtcatgcagtgttgcaaacacagctcactgcagcttctacctcctgggctcaagtgatgatccacctgcctcagcctcccaagtagctgggaatacaggcttagacctatgccaccatgctcagctaattttgtttgtttgtttttagagatggggtctcgccatgttgcccaggctggtcttgaattcctgggctcaagtaatcctcccacctcagcctcccaaagtgctgggattacaggcatgagctaccattcctggccctgagtgtgtatttctaactaaattaatgagaacgagagagaaaaaaatataaatttatataacataagtgattctgcctgccattccaatctacatgtgcatcctcttgtgacagactgactctactaagtgcttagctgatggccccctacctattcctgtcgttgctagtcaagatcctgtttcattccttttttcatcctccaggtggccacatcctcagggaaggctgagaccttcctcaacccagggtttattcttggttcattaactccaagccagttttgatgattctattccctttcccttattggtttaggagtaggtttatgctgtatttttgatcagtgagactttgggggttcagctttggtgaggggtagggggtgctttggggaaagcttcttttttcttaaaaagggaggagaggagaatcctcccttttcctgtctctgaacattttaatgacacatggaacttctgtgtccatcttgggacatcagagaaaagccaggagaattgcagagaggtcaaactgaggccatcagggcattgagccactgaattagccacctctggtgccatactaccttgggacttgttatatgagccaatcaatcctctgttgtttaatgccccattaaataatctttctaccacctgcaggtaaaagcattctaaatgatacagtatgaggatgactgttcccacagttggtctcagcatcttgtatctctcaaaatctgagcatcaacaaatcccaagaaattctagagtttcaagatacatatttttgtacaacatgattcttagtacaagccagcaacatcatctggtatttaacatgagaaaaggaggtctgttcctaagctggaacttttgggttttagtgaggtatgacactatattgtacttattgggagatttaaggaattttcaaggggagttttgactatgcaaacttctgccttttctctttagaacctaatccttttctgagatgccactgtagggaactgaaaggaactttccctttcaccctgtgaaggttcactgaaaaatcaactcacgaaaggctaataattggtggaaagacgtataaatttatttaacatgtgcatgggagccttcagaaggaatacccaaagatagaggtgaaattgcccatttttgtacttagtttcaacaaagtttggacagccatgtagatctaaaaaggatataatctaatgttaatagacagtgaggaaacccagcaaggcctgtctgtctagattcttcttcagcatgcatcctctaagcatgcattccttccttctgagtgtgaggcaggaccccttctggaatgggggccttatgactatagtcaaattaggtaggtcagataatttttcatggccagttgttacacagaaaggtggtgggaaagtttgagttatacctgtaggttttgtggctggctctgggggaataaagtgttctggtttctgtgactaccctttggggaacaggggttctagtttctacggctagccctggggaagaatgagaatgagagacaggaggacagaagaatgtcagagaaaaactgttgtttctgaggttttcattttagggtatgttttctgagtcccaacacaactaaaccgtgcaactgggcacagtggaaacagagagtggcccaaaagaagtataaagtatgagccattcaagaccagcctgggcaacatggtgaaacctcatctctacaaaattaataataattattataataataattaaatttatttaataaaaaagaaagtatgggccattataacctggttgaggagaaaaaacttaaatggcaggattgattttgaggctagaacacagcaaatttatccaaaggagtctctatcatgggacttggaggttgatggggaaggcgagtctagaaggactccttcttcccatgaggctgggctaggctatgctggtgtaataaacaatccccaatcctgtggcttcaaacaatagcagtttagttctcactcatattacatggccaaggtgggttgcttgtgtctctgtgctgcattgcccttacactggggcttaggctaacagaattgccactatctaggattgccagttgctgtggtagaggggcagggtcatgtgaccagttctggccaatgggtgtgggcagcagagacatctattacttctgggctggagcatttaactgctgatgtaggacaccttgctgcccacatccaatggccagaactggtcacatgacctcagcaactctaaggaggccaggaagtgaaatcctgttacatgtctgcaaggagaaagaactgggaatatttgcatgagcggcattaatggccaccagtcaccctctttgtccagtgatccatctaaaatctgtgtagacaatgagcgagagcaaatttccactctcttgcacattcgggtccattcagacttgtctttctctcttactctgttttcacgtggtggtgcctggtgattacagggagtgtgggtacagtcagtgtccttccatgcgtgccactctctccctctgaggctttgaccctttaattttacttttacttttattttatttttagtactaaccaaggtcagagctaaggaagtcacccagtgattttttctggaatgccatccattgctgcttcaccaggtctctttagccgcctgacgccttcattgtttactgttacattgtctccctttgttcaaagatgcaaagttggccgggcgcggtggctcacacctgtaatcccagcactttgggaggccgaggcgggtggatcacgaggtcaggagaccgagaccatcctggttaacatggtgaaaccctgtctcaactaaaaatacaaaaaattagctgggcgtggtagcgggcgcctgtagtcccaactaccccagaggctgaggcaggagaatggtgtgaacccgggaggtggagcttgcagtgagctgagatcacgccactgcactccagcctgggcaacaaagtgagactctgtctcaaaaaaaaaaaaaaaaaaagatgcaaagttattttgtctacagggtactctactcaaaccctcatggcttcctgctaccagcccaaatccctctccctgcagatcctcatgtgtgtccctggcttctccagctggggcctgaactcagctcctttgttctggtggcacacctctgtctgccctcacatgcactcttcccaacagaagttagtagcagagagggcagccatgtaagtcaacagagcacgccctgtgaatggagacacagatgttggcgctaaggaattggagcctgggctaatggacttattcctctgactgtgcagctaggtgagagggtgtataaaaagcaatacaaaaaatgttatggtggttgatttcatttatttctgagaggtctttataaaactgtccctgatggatatttataaacataacctcagctacaagtagacaggtctcaatttctcctatcgcagggaaatgcaaacttattctcttctttcctcaaggtttggtcttgtattttaaaaatggaataaagattgtagtaatgttgctagggattataggaataatataaatgtaatttctcttctcaaagacattataagtaagaatttcagcaaagggagaagaggaatgtaagaggaaaatggttgtttgaaagtgcagtatatagaagtataatatctatttctatatatagagatagaatatacaattaatatacatactatatatataatatgtattatacatactatatatgtatagaatagttaatatagcaatatataatataattatataaattctctacatatataaattctatatatagaatatataaattctctatatttctatatgttctatacattctattccatatattctattctatttatatattctataaatatatagaatacttaaatttatagaatacttaaatatattttaaaatactaaagtatatttatagaatgtatatacttttgggctgggtacggtggctcacgcttgtaatcccagcactttgggaggccgaggcaggtggatcacctgaggtcaagagttcgagaccagcctcaacatggagaaatcctgtctctactaaaaatacaaaattagccgggcatggtggtacatgcctgtaatctcagctactcaggaggctgaggcaggagaattgcttgaacctgggaggcggaggttgccatgagccaagatggtgccattgcactccagcctgggcaacaagagcgaaactctgtctcaaaaaaaaaaaaaaaaaaatatatatatatatatatatatacttttgtatataagtatacaaaagtatatttatagaatatataaattatatatttctctatatattccatatatattctctgtctagaatatataaatgtatatatgtggagaatatgtgtaattttttatatgtatggaatatatatattaatttatatatggagataatatatataggatttatgtatatttctattatatatatatatacttttttccccaagttcttaggtcagattctttatataggttcttcccctacaaccagaggaaactgtgtttttataactaataatagaaatacatcagcctagaatatgtgtcttttacaattgaacatctaagctttgcaaatgttggtgctatagttataaaccatggatgttagtcgaggggaaactcttctccggaactcaaacatgaaagctgatgttaaaagtcattgctaaaattctagagctgaggggattacaaatcagcattctaagctatcctcctacccactggtccaatgcattacatgttggcagaatggaaatcattttggaaaagggaagtggcattttcagatgtataaacatcttcctataaagaagtgtctgtcattttctatctccaagttctcaagaagacagggtctcctgccccttggtatccaaataaaattggcctgtagtctactgtgcgcagtgtgtgggttaagtgctttctccaagattcttagcattgtgtcctccttcgactccacattctccgggagctcccatgggcacacagctgctctcttgtttccatccccaagtccaagtgggatgtcattcagcttccaacagacaactctagcacaagatactggtgtagaacagatctccaccataggtacgagagtgagggaagaattacatcatgacacagcataataaatactttaaaatgaatttgtaaacattgctgttctgaaaagccctttttaggctgggcacggtggcttatgcctgtaatcccaacactttgggagactgaggtggttggatcacttgaggtcaggagttagaccggtctgaccaacgtggcaaaaccctgtttctactaaaattacaaaaagtatccgggcatggtggcgggtgcctgtaatcccagctacttgggaggctgagacatgagaattgcttgtgcctgagaggcggaggtttcagtgagccgagatagtgccactgcactccagcctgagtgacagagcgagactctgtctcaaaaaaaagaaaaagaaaaagaaaaagaaaagtatttttttattaccccctggtaatttcttactgccaatttttgccctaatttctttcaatttctttccctcttctgactgcacctcttccttcttatcttccttctgtgatgtgggacccacattttcacacccaaatggtccatagagttgctttgttctccaaaatacagttttctccttggaaggaattttacctctagcttttaaaataacatttctgttcttacaaacttatcatcaggattaatcacatttttaaattaaaatgttattactaaaacacttaaaactaaaatagcatttttaaactaaaatgctatgtctgttttctctcactcttgttatgaaatgtttcctaatgtgaagtgttttcttgatggaagactaaaatattgagacaacatatatatttatgtctcacatctccttcttatggccatatagcctttaataaaggtagtgttgcttacaaaaggaatgattgtataatagcagagaaaaaattctttccaaagtgaaataatagagatgatagagatgaaaaccaacacttgtgaatgaaacttttatatgcagaattatattagcatagttaaaggtaaaaatacttgatccataatgattttcatttataattttggttatagattgtatctattagctattgttacaataatgctgcttgacaaaccatcccaaaactcattggctttcgttgtcatgcatatgcagttggctggggcttggctgatctagacctggcttggcttccaggtgcagattggatccagatctgctccccaggactctcatccacttgcaggctgactggggcttgtccttctcatgctgtagcagagtgcaagcctcacctcttaagcccatttcaaacctttgcttgcattatgccctctaacatccctttggccaaagcaaacatcagtgagacagggaagatcatttctcccacagcaggagaggaggagaatgaatatttgctgaacagtaattcagactcttacataagtgaagtatcatctgattgtccatcatgcccaacatctgtgtctctctgccagccaaatccaacaggtatcaaaagtggcttaaagcaggaggggttattagtcggttaaaagcaaagcatgtcaaggaaataatctattcatgtaggagcaaagatttttcttctataaacttgcatttaagataaagctgacaatctccttgcagcaattccttgagaagaaagtgtagaacaaggcacaacactcctctgacccaattcctgcaacctagtcagagaggacaactatttgcaccatgaattgaattatagccaaacaggtcttgagtaattcattgtgcatatatcctatgaaatgaagctctcaaggacccagaatgtaaactttaaaaagtaaccagtgttaatacattaaaatttcattaatttcgtattaatttacttaaagcatcatgtaatttcaagtaattattagtcattcatcaccttttgttcagttgattcttactagaaatgctggagtatggcaatcttacacatctctgggttcttgatttagcacagaggctggtagagtacatctcatgggacaaactagctgtttttgtaaataaagttttattggaacatactcatgctcatttgtttctatgttgtctgtagctgctttcactctacaagggcagattgagaagttgcaacagaaatgctatgaactcaaagcctaaaatatttactatgtgacgagcagaagaaagatggccaatcctgatttaacataatgctagacagttgaaattttggaatttgggttattcacacagttctgggatgaatattgttcttgagctatccttagataactatctaaatacttagagaaaagtatttttttaggaaaatcaataatgtaaacaaatattacacagataattttaacctccttaagaaaataatctttttaatacattaggttatgagcacttatttctaaacagttattataccaatcataaaatttgtatttgcttgttaaaggagactctgaaaaactctatcaaatattgctttattaacctttaaggagatgattattcttgcaataaacctacggtttttaaaaatatacacttgccagttgggcacagtggctcactcctgtaatcccagcactttgggaggctgaagtgggcacatcacgtgaggtcaggagttcgagaccagcctggacaacatggtgaaaccctgtctctactaaaaatacaaaaattagctgggtgtggtggcacatacctgtaatctgagctacttgggaggctgaggccagagaatcacttgaacctgggaggtggaggttgcactgagccaagattgcaccactgcattccagcctgggcgacagagcgagactctgtcctctgtctcaaaaaaaaaaaaaaaaaaaaaaaaatgtatatatatatatatatatatatatatatatatatatatatatatacacacacacacatatatcttgccatttcttcaaacttttcaccaatgtagatcattttaactctattcacgtacataactgcatctgaattagtacaattttactatattgtgtttaaagatatttcaaaacaccacactggcccctgatcttttctttgatattagaaaaaacaaaatcttgtgtcttgccggatgtccactcttggagacaatcgggtagctttagaagaaagaaacattagcatttctaaagacttggagagagaacatgggcagattttaaaagtgacgacacattcttagttatttccagtagatatattgagaacacagaaaaatctggagtcatatctattgggtattgaattagatgtgtgtatttctgtgttctgggattcactttaaagccccaaatgagtctcaatatgaggcctgaactggagaagaagaagagttcgtggagaagaacagaagggtggcttacacctgtaatcccaacactgggaggccaaggtgggtggatcaccggaggtcaggagttcgagaccagcctgggcaacatggtgaaatccccatctctactaaaaatacaaaaattagtcaggtgtggtggcgggtgcctgtaatcccataatcccagttacttgggaggctgaggcaggagaattgctgaggcaggaggcggaggttgcagtgagccgagatcatgccattgcaccccagcctaggcaacaagagtgcaacttggtctcaataaataaataaataaacaaacaaataaataaaaatgaaaagaagaagacgaagagttcatcccagcctcttctccaccctgggctaggaatagctctctataagatataggatttagacaatggatcctaaattggagattaggtaaaaacaaaagaagtgctccaggactacacttctgaaaggaagttttcctagcccagtaactgcaagataggtatagagctataggtcatcatcagctccctttacaagtcacatgggattgtaatctgagcaataacaactgtgtatccatgtcagctgaatgacttggctcaaatggcacttcttttttttctttcaggagtcgggtgggagaatgtgctgctaaaggaaggtgagtcagcctcgaacgccacagaaacatccggcccagacatgactatcaaggtaagggattctcttcaggttgattctcaaagtgtatctctagagtaaaggcagccgatggcaggtttttctgggggcaaaatgaacactaccaatccaccttgctagagttctctctctactcactgaggtcttagggaggcaaccgtacataagattttctgaaatttgggatctggtctacagccgtaccaccctgaatatgcccgacctcgtctgaaacttgggatctggattaggaaactgcttgaaaaccagaatctaagatgtgatttccaatgggcctgtcgtagggtcttcagtgaatatctacacgtaagctatttgtaaatggtaaccccagtgggcacagtggagcaaatctgaaaattctgatctgagaattcaggccccactgtgcattgtgaggaaaggtcagagaggcataaagtagctttgatcttggctcaagatttccactgatgtcagcaggaaggcagcacatggcccactccagctgaaacactaatggccaaaggtttacaaaatgagtcatctagaaatccacttaactatcactgttcaaattaaatgcatcaatttgtaagcactggccagaataaagaatctgtagcaaaagttatcagaggtgccaccatttcccctctgttacgggattaaacacaaaggaatgatcttcctctcttagaactctgctaacatattagttaacaaaggatgggggtgggagggctttctaacattcttgcttgaatgattataatttgaatatatgctacttatgaatttttctttgaaaaataagaagtaatgtcttattttatatagagctgtaactggagatatttctttttttttgagacggagtctctctcttttgcccaggccggagtgcagtggtgcgatctcggctcactgcaagctccgcctcccgggttcatgccattctcctgcctcagcctcctgagtagctgggactacaggcgccagccaccgtgcctggctaattttttgtatttttagtagagacggggtttcaccgtgttagccaggatggtctcgatctcctgacctcgagatccgcctgccttggcctcccaaagtgctgggattacaggcatgagccaaactggagatatttctctcctggatctattagtagaagttgtacaaaagaatatacagcatggatttattcaagttttcttttgtaatgtgaaggctaaacttgtgttgtctatgttacaaatggtagagaaagcaagcaaatgttaccatagtaaagctaaatgaaagataggatagtagcctgattagtcaaaaagtcaactaatctaagtggtaactatccagtgctgaaagaactatcactacgtttagcagaatttgtaagacaataatataaattgcaatgacatgttggtgttttattggctattattgcaatgattgacaagtttcagtctatgaccacattggacgaaggggaatgggtgccaatagtaaaacctgttggatttagatttgttatctcaaaatctgttatcatctggagaattagtttttgagaagagttgctagtgggagagaagacagcatgttgccagtgtagctgcagatgtggtacagacagacattcaagtagtcagaaagactggagtttgcttttataaagcaaacggcatattcctttttttttttttttttaagacggagtcttgctgtgtcgccaggctggagtgcagtagcgcagacttggctcactgcaacatccgcctcctgggttcaagcaattatcctgcctcagcctcccgagtagctgggactacaggtgctggacacaatgcccggctagtttttgtattttcagtagagacggggtttcaccatgttggccaggttggtctccatctcttgacctcatggtccgcctgcctcagcctcccaaagtgctgggattacaggcgtgagtcaccgctccaggccacaaatggcatattctaatagaagcaagtcttgtccaaatcccatttgataagattgctacttaaccaggctactcatccatggtaccaggatcttgactgaagttgtatttgggtccctctagtttagacatcattctcgatctccgtttctttttcttttaatgaatacctgaaaatttctcacaagaaaagatttcttttacccctgccctaccccaggaagatttttcatccataagaactgaactcattctgaggaataaataccatacactttaaatagttgagcaaaatagaaatttatttctttattcattttgaggcagagtcttgctctgtcacccaggctggagtgcagtgtggcatgatcgtggctcactgcaacctccacctcccaggttgaagggattctcccacctcagcctcccaagtagctggaattataggcatgtgccaccatgcctggctaattttcgtatttttagtaaagatggggtttcaccatgttggccagtctggtctgaaactcctggcctcaggtgatctgcccgcctcagcctcccaaagtgctgggattacaggtgtaagcctctccacccagccagcaaaatagaaatatatttaaacacatcaataaacccctacaaatattctagagttcttctcttaatgccagttccttctcactaaggaatttgtgaattttctaggtggatataactacagaaaatgcttgtttctatcttctcctttaggattcccaattacggagcagtcattgacttttttcctttgggtataagttgtttcccaccccacattgccttacataaccatgatgtctttgtatctaaatgaaagtattattttttctgctccacttcgttaatcagagaaatgcaaattaaaaccgcgatgagataccatctcacgactgggcatggtggctcacacctgtaatcctagcactttgggaggccaaggtgggtggatcacaaggtcaggagatcgagaccatcctggccaacatgtgaaatgccgactctactaaaaatacaaaaattagccgggtgtgatggcgcgtgcctgtaatccaaagctactagggaggctgaggcaggagaatcacttgaaccagggaggcagagattgccgtgagccgagtctgcgccactgcactccagcctggcaaaacagcaagactctgtctcaaaaaaaaaaaaaaaaaaaaaagagagataccatctcacaccagtcagaatggccattattaaaaaggcaaaataacagatgttggtgaggatgcagagaaaagggaacagttatacactgttggtagcaatgtaaattagttcaacccctatggaaaacagtaaggagatttctcaaagaacaaaactactgtttgacccagcaatggatatctacccaaaggaaaataaatcgtcttatcaaaaagacactcacactcatgttttctgtagcactattcacagtaggaaaatcatgaaattaacctaagtgttcatcagcggtagactggataaagaaaatgtggcatatatacaccatggaatactacatagtcatataaataatgaaatcatgtcctttgtagcaacatggatgcagaaggaggccattatcctgcaagaattaatgcagaaacagaaaatcaaatactgcatgttctcccttataggtgggaactactacacatgggcataaagatggaaacagtagagactggggactctaaaagaaggggcaatagagaaaggagaaagggttgtaaaactacctattggatactatgttcactgtttgggtgatgggttcagtagaagtccaaatcccagcattacgtaatataccttgtatcaagcctgttcatgaaccccctgaatctataataaaaaaattaaaattaaataaaaagaattattttttttctctctgtatataactgcctggagctcattaagcacagactccccctcttacatttagctatagctattcctacttctaatagctactttatatatccttgcaatatcagctattcctgccttttgcctgagaaaacaaaatattctgttaataaaacctgatacactgacacttttcaagggaaatatcagcagaaattacaaagatagttgggtttcttccatattgctcttcttgtgataaaggtgtctattttagtatttataaattttctttctgaaaaaggaatacaatgttttgaaggtgcttgctttctctttgccttccatttcccttgccatgattgtaagtttcccgaggcctcccagtcatgcttcctgttaagcttgtggaactgtgagtcaattaaacctctcttctggctgagcatggtggctaatgcctgtaatcctagcactgtgggaggccgaggtgggtggatcacctgaggtcaggagttcaagaccagcctggccaacatgatgaaaccccatctctactaaaaatataaaaattacccgggcgtggtgatgcatgcctgtaatcccagttacttgggaggctgaggaaagagaattgcttaaacccaggaggtggaggttgcagtaagctgagatcacgccactgcactccagcctgcatgaccagagtgagactccatctcaaaacaaaaaacaaaaaaaccctctcttcttcataaattacccagtctcaggtaactctttacagcagtgtgaaaatggactaataaacctgtgaatgtgacttatttggaaaaaaagtctttgcagatacaattaacaatcttggctgggcacgttggctcatgcctgtaatccaagcactgggaggctgaggtgggtagatcacttgaggcctggagttcaagaccaacctggccaacatggtgaaaccctgtctctactaaaaatacaaaaaaattaggcatggtggcacacgcctgtaatcccagctactccggaggctgaagcacgagaatcatttgaattcaggaggcagatgttgcagtgagctgagatcacaccactgcactccagcctgggtgacagagtgagactctgtctcagaaaataatactaataatcttgagatgagagcatcctggatttaccagatgggccctaaatccaatgacacatgtccttataagagacaaaagaggatactcatatacacagaaggccatgtaaggggactgaggcagaggttgaagttatgcagcccaagtcaagaaacacgtggatccaccagtagctagaagaggcaaggaaggagtcttctctagagcctttggagggagaggagtgcagccctcctgacaccttgaattggaacttttggcctccagaattgtgagaaaataaatttccgttgttttaagccaccaagtgtgtggtagtttgttatggcaaccctgggaaatgaatgcactcagattctgccaagaatcacacctatgcttcttgagtgcaaatgccatagaggctgataaaccaatattacgaagatccacataattttcttattttactctacttacccttataaattgttttttacctgttcttgttttgggagaaccactaacttttttcagcctatatttatcatccttcactggaagaaaagggtagctgtatctcagaatagcttctattttatatcctattctgttttgttgcttgtccagacattgaatttaaaaaaaaaaaaaaacaggtatggatcagtatttcttgaaatgcctgaccctgagaatcacctgcagcaatgtagaaaacaacaataacacagcttgccagacatctttcagaattcagattcagaagacctgggcttgagaattagcatttttaataagtgctccaagtaactttcatgattagtttcagaaaatcttgtcttagcacaccactaatgcagtctgggggtggcaatgtgagccctactattgctcttggctctccagttgtccaaccaatctgaggcaggatttggatacttccctattcagtgccctttgattacttcccatttcaacactgaataagcctcaggcttcccctgccttctagactttcttactcttaacttcagtttcatttttagcattgtctttcactgtgtctctctctgtacccattcttgccctctttatccggtctacttgtagcctggatactgtagctttctttttaaaaagctgagttgagctttgcacggtggtgggaagattgcttgagcccaggatttcaaccctagcctgggcaacatactgagactccatctctaaaaaaataaatgaaaagatcaagctgataatatccctctgctaaggccctgctggccttcccatggctcctggaacaaagaccaactcttgcaggcactgtgttttttaaaagcccctggctttcattcacttctcccttgatcttcctgctctccctctctctttatattcacatctttggctcaaatattccctcctccagtggcacattcttttctttttttttctttatttttattttattttattttattattattatactttaagttttagggtacatgtgcacaatgtgcaggtttgttacttatgtatacatgtgccatgtttgtgtgctgcacacattaacttgtcatttagcattaggtgtatctcctaatgctatccctcccctctccccccaccccacaacagtccccggagtgtgatgttccccttcctgtgtccatgtgttctcattgttcagttcccacctatgagtgagaacatgtggtgtttggttttttgtccttgcaatagtttgctgagaatgatggtttccagtttcatccatgtccctacaaaggacatgaactcttcattttttatggctgcatagtattccatggtgtatatgtgccacattttcttaatccagcctatcgttgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttttttcctgactttttaatgatccccattctaactggtgtgagatggtatctcattgtggtttcttttttttttttttttttttttttttgagatggagtttcgctcttgtcacccaggctggagtgcaatgacgccatctcagctcaccacaacctctacctcctgggttcaagcaattctcctgctaagcctcctgagtagatgggattaacaggcctgtgccaccacgcccggataattttgtatttttagtagagacggggtttctccatgttggtcaggcttgtcttgaactcaccacctcaaatgatccacccgcctcggcctcacaaagtgctgggattacaggcgtgagccacagcacccagctccagtggcactttctaacaagcattgcttgtttcacattctcataggacctaacagctctccttcatagccactcacatcaataaccatagatgtcgggcaggtgtggtggctcacacctgtaatcccagcactttgggaggccaaggtgggtggatcgcttgagaccaggagttcgagaccagcctgagcaacatgacaaaacccagtctctacgaaatacaaaaaaattagctgagtgtggtagcatgtgcctgtagttctggctacttgggaggcaagagatgggaagatcgcttgagcccagggagattgaggctgcagtgagctgtgataaaacaaaaaataaaataaaaataaaaataaccataattttcattgcataatatccagttgcccttgctacaatatcatttccgtaagggtcatttttctgtttcattttttacttgttagaggctctaaattgtagttctttttttaaataacacaactttattaaggataaaatttgcatgccatatggttcccccaggtaggtatatgattcaataatgtttcataaatttactaaccatcacacaatccagttttagaacacacacagttttaaataatttccatcattccaataagatccctcatgccctcctatagttaatctccattctaccccatccccaaacaaccactcattcctttctgtttctataaatttgcctgttctggacatttcatataaatggagtcatacaacatgcagtgttttgtatctggcttaggatgatgatgattttttttttttgaggtttatccacattgtagcctcaatcactatccctttcactctttttaatgctgaataatatttcatttaattgatatgccaggctgggcatggtggcttacgcctgtgatcccagcactttggaaggccaaagtgggtagatcactagagcccaggagttggagaccagcctggacaacatggtgaaactgtgtatctacaaaaaatacaaaaattagctggatgtggtggcatgcatctgtagtcccagctacatgggaggctgaggtgggaggctcacctgagtctaggaggtagagagtgcagtgagctgtgattgtgtcactgcactctatcctgggtgatgacagagtatgaccctgtcttaaaaaaaaaaaaagatatgccagtgtcttgggttttttgttttttttttttaacagcccagaggtcttttatttatttattttttaaacacctattatgccatgaattcatagggaataggttccagcagttcaggctccttcccattggttctcacaaagtgtgcttctctgggtggagcaggctggcacttcagttgaacccaggtacctttctctttggcttctttctttttctgatcattttccttcacacatttcaggaagctatctcggctcagagtgcttaatgtgctcaatatgcacattaattctcttggcaagaatcttgcccttaacttgtttgtttacaataccaacagcatgctgggtaacattgtagactcttccagttttgccatggtaacacttgtggggcattcctttttgaacagtacccattcccttgatgtctacaatatcacctttcttatagattcgcatatacgtggccaaaggaacaactccatgttttctaaaaggcctagagaacatatgtcgggagcctctcctctttccctttgtgttcgtcattttggcgaattactggaagatggaggttccgcccgaaaggctttttttttttttgttccttcacaagttgatggattttgaggttgtttctaccttctggcagtaagtattcttgctatgaatagttgctgctttggatagtcacatgtaagcctttgtgtggacgtaggtcttcctttgtcttgggattgtacctaggagtagaattgctgggtcatatggtaaatctgggtttaactttttaaaaagctgtcagactcttttccaaagcatctacaccactttacacctcaccaacaatgaatgaggcttccaagttttctacatcctagccaacacttactactgtccatcttttgattataaccatcctagtgggtgtggagtcgtatgtcattgtggttttggtttgcattctcctggtggctaacgacactgagttattttcatgtgcttattggctatttgtatgcagttaatttttaatggcttgatttccttttttgccatagtttgttcaattattaaattgaagcactctctcattgcagctgcccagtcagtgttttctgagtgagggaccctcttcttgactgtggcaggagggtgcactcaactcacacttcccctttaagatcactgccctctccaccactacgtccctctgcaggggttgcatcaatctctcttctttctatttcttttctttctctcactcttttatttatttctttctttcttttagacagggtctcgctatgtcacccaggctggagcacagtgtgatcatggcttactgcagcctcaacctcccaggcccaagcaatcctcctaccttagcctcctgtgtagctgggactataggcgtgcagcaccacacttggctaaatttttattttttgtagagaaggaggactccctatgttgcccaggccaatcttaaactcctgtgctcaagtgatcctcgttcctcagcctcccaaagtgtgagattacaggtgtaagccatcacacccagcgattatctctcttttctattttcccttcacatcttagccttttttctttaatttttttattagcctaatcaatgctattttttattgtggtaaaacagatataacatttaccattttaagcacttttaaagggtacccgtctgtggcgttaggtacattcaaagtgttctgtaaccatcatcgtcatccatccttctccagaactttttcaacatcttcttcaaccaaaactctctacccattaaataccagccccccattctctcctactccagctcctgtcaaccacctaaatgttgcattttacacctaaaatgtattactatttaattgccttctcaaagggatttttaatacattatgttaatagtaaaaagccagtaaggccaggcgtggtggctcactactgtaatcccagcactttgggaggccaaggcaggtggatcacttgaggtcaggaattcaagaccagccttgccaaatggtgaaaccccgtctctactaaaaatacaaaaattagctgggtgtggtggcacacacctgtaatctcagccactctggaggctgaggcacgagaatcgcttgaacccaggaggtagaggttgcagtgagccgagatcgcgccactgcactccagcctgggtaatagagcgagatgcagtctcaaaaacaaaaacaaaaacagaaaagccagtaagatggctacccctcagaaataaagtaggaagctgctacaagctagatttttaaagatattgctggttacaaaagttcctttcttctgtggcgtgaactgtccaggaccctcatactggaaatgtcttggccttatccagctggtgccttgctgcaagtcccaaatcacacctgcttggctgtgcatcattttcttgaattttgtttatccaacgactggataaaatgacatcaagtaatccatgttaaagaagtatctctaggataaaaattttgtgatttggctgtcatttccatcaaatacaccaactaaatcgtagatgctctctttatcttgccctcttgtccatatatactaagactaaaaactaagtgtttgcaaaaaagaatacaaaaaattttagcacagcagaattttcctcagaatgaagtctggtattcttatttacatgttcaatatttctcatttatgcttgaacaagaaacaaggttggtagcccttaggcaaactagagattctggctgtaaaaccgtttgaaaagggtacatttctattcaaggacatgggaaagccacatttaaaaaaggatgttgcttctctacacgtaaaacttgttggaagacagattatcctcctagaagagcagatgttctctattacaaaagaggaaaagcatttagactcttccggtggtgaatagaggccacaggttacagctttctttggcctttgcttttaaaaaaacattctgctgaaggccttttgttgccagtggtgtccagccggttgccctttgtatttgatgatgacgacattgaaaggattgttttgtgcagggactctggacaaaaaagagacatttgggacagaaaacctttctacattgtgtatatacataaagatcgctctaaatttggttccttgccaaaggaaatattttcgaagattttttaaaaatccttgaaactattcagggtagtggatctcagagggggtttggcattggtgagtaggaggcatatcggtactatatgggtcagtttttataatacatgtctttgagaatcattgtcttgaattttctttaaaatgaatatgaagagctctgttgtaaactgtaataaactatattattaatggttatttattgttcctgtgtgctactccctatttgtcaaataaaataaatgtgaaagaaatgaagtcacaaccattgacagctttcaataatctatgtgtagataaggaatattcgtggcaagtgaataatctcaggtaccttcttctttgccgttttatttcttcgctgtgttctcttgccaacaataatagctaacatgggttgaacgtttgctttgagctgagtactgtgctacacatacaccatctcgtgtaatcctccagatgactctgctaaggagaaactgttattaatcccattctacagatgtggtggctgtggcacagtaaagtaacttacccaagatctcaaagtgagtgtgtggtggagccaagctttgaacccagatggaaggacactttgtagcctctctgtttgggttttaataagtgcaggtttatttttttttaattagctaaagcaggggagctccaatgacagggcaagggtagcttagccagataaaatattagatgtccagttcgatttgaattaaattgcatgggacatacttatattaaaaaattatttgttgtttacctaaaattcagattttactgggtgttctgtatttttatttgccaagtccagtggccctaggcaagaggagtgttgcaaaggaaatgaagggaaccgcgtaatgtgttttgattattgtcctttgggattatttgtggttttgggttctttttgaaaaaaaaaaaaaaagacttttttcattttaaacatgacaatgtattttattaagctttaaaccagacagatgtatattttaaggacttgtaatatgctgataacctatcaagggacatcccttgatatgcttctttgctaggaatccaaatctgatccatgccaagatttgtacctcattggtttctctatgaagtgaaactatgagaaacactaccctctatttgtttgtttgattgttttttcttttgaacaacagcaacaacaaaaaccctttacctcaatctgggtatatcatgactttttggaagccttattctaggatcttctttttagttgggatatcagtgttagcctaatttcattttctgcagatagcttcatcatcccaatttttaaaatgttgatgaaatactcttgtgcttttatcaactcctacttggtaaaatcccctatctctgagtggtcaccctaaaatacatgacatgggcatggatattcccagcaaaagttctgacacattcacaaatgcttcctgaggacatctgtctgtttccttctatgcacattttgaacattccagcagtgagaatgactaatgatgctaaagctctagaaactgtcacgtgttgctgttcagtatgtcagagcctgtctgcagataagcctcatttcttaagaataatctgtcccaatcaagctagttttgcaacaaggctcatttgcaagtaccaaagtctatgacttgtgaaagaaccaagccacgcaaaccaaacacagaacccagtgacagaaactattggtctttagtgcgactggaaggtagccaacctggttcccatttaggcagggaaccagtttgtctctccagttaatgtctgaataaattaccattcatgtccctgagggtttggaatgattgcaaattatttctgaaatcctgggtagaactcatgtggccacttacgataagccttgtccttctgcaactggtcaggtatcagagaggtctcataaatcaagattgtagttatcaggaaaagttgttggattcatagagtaggggccaagggaaaactttccctttgccctctgaaatttcgttgaaaaatcaattgacactagacagattaacgggagaaatggcatagaagtttactaatgtgcaaagagagaaaattacacacaatggggtacagatggttatatacccttcttcttagaggaaacggagataggaagtgtggagataggaagtggggggaagggcagtaaatgatttttacttgaagaaccaacagtgacctgggacaaagtctgttgggcccacagaacagacaacaatttgtgacagaagtctgttcagatgtgttgacagacttcattcagtctttcttcctgctatatgagttgctaatggcaactcaaggaagagaccagaagtaattgttttcttctctggagggtaagattttaggtagataagggaacttcacagaaccatttcatcctgtgcgtaggggagagacagaagattgagagacaggagtgaggggaggtcagagagaccttgagccttcttcaggttcagaatatcaaagcatcatatttggggatataggtttctgagccctaacaatgggaagaatgatctttctgtatcatatgaatactgaagattgttgaagtgagcatctagtgctcctatctcgataaattatccaatgcctttcccatctctttctcctacccattctctagtggcctgcccccttgccctttttattgtagtgaaaacttagtagtaaaaaatacacttggtaaaaatcatgacatcatgtaaattgtatgtaaaaagatgacatgctcatacaagatgcttgattcattgcctagcagagcaggccactggtaggtctgcataccacgagctggtctgtttcgaggtcacttatgcttactatcattgcaacaactacttcttcctcagaaattagtcagtggagatgtgacatttattttatctcagaatttttatgtctgtttctgaaaagaaaaaggtaccagcagctgcagttcccactccgtctcccaaagggatctgggctagagggtagggtattggatttgtcatcatattttccatctgctcacagattgtgaggtttattattgtttctgttattgttttttgagacagggtctcaccttgttgcccaggctggagtgcagtggcgccatcttggctcactgcaacctccacctcccaggttcaagtatttcttgtgccttagcctctagcctccctggtagctgggattacaggtgtgcgccaccaggcctggctaatttttgtatttttagtagagacagggtttcaccatgttggccaggctggtctcgaactcctgacctcaactgatccgcccacctcagcttcccaatgtgctgggattacaggtgtgagccactgcaccccaccagagtgtgagttttgatctccaacagtatgcattttctagtgaaattcggtttaataaaatgaataatgagataatagctaacatatattgagaacttcccatgtgtcaggtagtgctctgggtgtttagggtattctattatttaattcttaccacaaccctatgaggtgggtactaggatatctccagtttacagagaaaacaaggtgcagagagattaagtaacttgtctaaggtcacacagacaaggagtgctggagcctaggtctaagccagacagcactagatcttcatgactttgtcacagtgcttcaccttggagaataatgagatgatgctggtatgtagacatgctaaggaggtcttccttgcctcacagtcctgatcaatatggaggcttttatgtagttctgtttgcgttcattcttccaatgcaaagctggagtttacctagtgggataagatttgattttcatccttgagaatgagttgttcttcaggctggcccatgagtcttcatcctgtcagcattctgattacatttctcattatcattctcctgcagtgattcatgagtatgataaaaccgaacagccttctcagtaaataagcaaagcttagcttacggggaaaaaaaaaaaaaaaaaaaagtagagctttccttgaatctggagaaattaagcacacaggtgtcctgcaatattagttaagagactactgcacccatcatactgtagcttaagacagtttcttcttttagttttttctaaaatgtctccatgtctgtgttatgccacaaataacacagccttggttaacttttggactaaaaaaaatcaacttattggccaagcatggtggcttacacctatgattgtagcactttgggaggctgaggcaggaggattgcttgaactcaggagtttgagaccagcctgggcaacttggccagacatcatctctacttaaagaaaaaaaaccgccgggtgcggtggcttacgcctgtaatcccagcactttgggaggctgaggcgggcagatcacgaggtcaggagtttgagactatcctggccaatatggtgaaaccccatctctactaaaaatacaaaaattagctgggcatggtggcgcgtgcctgtagtcccagccactcgggaggctgaggcagaagaatcgcttgaccccaggaggaggcggctgcagtgagctgagattgtgccactgcactccagcctgggtgacagagtgagattctgtctcaaaataaataaataaataaataaataaataaataaataaataaataaataaaataaaaaataaaaaaacaaaaaaaataaaaaaataaaaaaacaaacaaactagccaggtgtggtgtgcgcatgtcgtctcagctactcaggagacaggtgggagaatcacttgagcctgggaggatgaggctgcagtaagccacaatcctaccactgcactgtagcctgggtgacagaaggagaccctatttctattataaataaataaatttattgaatgtcgtattatatgtagcataccatatttaagcagggtcaaatttttggtctgacttttcaaattaatgtgaataagtcactttgaaattttggagacaaaaccttatttaagttgagaaatagacaaacattcatccactaagaattattctttttattatttttagtgtgtttgagttggttcttgcaaagaaaatataaacaaatcccaaatatgaaaaagtttctaagtttatattaagtgtatcccatgagtgacacaggaaaatcccttttaagagaaatggtattgcaaaagacacagcaaatctttttctcttttaaataaaaatatgcattctgtgtctaagcattttccaaacctttctcctttgtgtggcttttactaaaccttcaatcctataacagtcattgacttcttcctactttcttttcctctctttccttctctcccttcactccctttctttttcccagtgtttactgtgggctaggcactgtgttaaacactttacctgcatttctctctttaacactcaaaatgacaccatgagataggtaccattttttgtcccattgtgcagatgaagaaatcaacactttgagaaggtaaagactttataaggtcacaaattctggaagagcagagtcagaattcaattccaggtttgtcatatttcagagcccacagtttattgctttctgtgtaatgagtaaatatttcttttagaatcaaaaaatattttaattaaaatgtaatgacaggaaaatagttttgatcctgggagcaagaattagtcaagaatggacctgatctaagaccactgtagttttttggacaggctatgagccagtggactggcacagatgaatacaaataacacatagctaatactaattgagaatctaaaaggtgtattctgtggcctttataagcatgaacttatccaatgagttccatgaactcatgatatagatactatacacttgttcttattttaaagactaggaatctgaggcacagggagataaagtaacctatggaaggtcctgctcagaatcagtggaagaatgaggattctgccttcattcctagcattcttcatgtggttagcatagtcccctaaccacagtgccagggcacctcttgcctgtgatccctaagtgctcttctgcaggtttctttctttcctttttttctattgtttttttgagatggagtttcactcctgttgcccaggctggagtgcaacggcgtgatcttggctcaccacaacctctgcctcctgggctcaagcaattctcctgcctcagtctcctaagtagctgggatttacaggcatgtgccaccacgcccggctaattttgtatttttagtagagacagggtttctccatgttgttcaggctggcctcaaactcccgacctcaggtgacctgctcgcctcggcctcccaaagttctgggattacaggcgtgaaccaccacacccagcctcttttgcatgtttcttggggaatgcagagccagttaactttacaactagccattcacttggaattcacatccacagcatagaaaagaccatagcgtatgctttccctatggagagaatccaataactatcaagccatatattcccctttttttttttttttttttttttgagacacagtttcgttgcccaggctggagtgcagtggtgcaatctcagctcactgcaacctctgcttcccaggctcaagcgattctcctgcctcagcctcctgaatagctgggattacaggtgcccaccaccatgcctggctaatttttgtatttttagtagagacggggtttcaccatgttggccagtctggtctcaaactcctgacctcgtgaactgccctcctccgcctcccaaagtgctgggattacaggtgtgagccaccacgcccggctgccatatattctttgtataagtgacaggtctgaaaatagctgtgtttatgattacggagttaaagggaaaagaatgccatagctaatgggagagaaaaatgaaaggtcaattgaattcgcccatggtaaatgttagaaatttaagggtcaatgtgatcctttcatatgaaatactaagttcttggaatcaacttacgggaaaatctagtatgtttagtgttttacaagtgcttttttttctgcctaaaatttaagaaatactttacccaatgtactaaatatatatgtgtgcatgtgtgtgtgtgtgtatatatataaaaaatatatataatataatatataattatattatatacacacatatataatatataatatacatattgtacatatgtataatacatattacatacatatgtattatatgtataatacatattatatatattatatgtataatacatattatatacatatattatatgtataatacatatacgtatataatatgtataatacatattatatacgtatattatgcgtataatacagatatatgtatatatatgatatgttgtgtgttatatataacatatatatgatatgttgtgtgttatatataacatatataggatatgttgtgtgttatatataacatatataggatatgttgtgttatatataacatatataggatatgttgtgtgttatatataacatatataggatatgttgtgtgttatatataacatatataggatatgttgtgtgttatatataacatatataggatatgttgtgtgttatatataacatatataggatatgttgtgtgttatatataacatatataggatatgttgtatgttatatgtaacatatataggatatgttgtgtgttatatgtaacatatatatgatatgttgtgtgttatatataatatatatgatatgttgtgtgttatatataacatatatgatatgttgtgtgttatatataacatatatatgatatatatattgttttggtgagttggtacttttttttgttattgttgagatggagtcttgctctgtcgcccaggctcaagtgcagtggcgtgatctcagctcactgcaagctccacctcccgggttcatgccattctcctgcctgagcctcccgagagtacaggcacccaccaccacgcccggctagtttttttggtatttttagtagatactgggtttcaccgtgttagctaggatggtctcaatctcctgacctcgtgatccacccgccttggcctcccaaagtgctgggattacaggcgtgagccactgcaccaggccctgtgctttgtttttttaaaagaaacttcctagaaaccctgatcaagtgggagtttttttgaacccgttaataagaacactttattgtaatgaaaataagaagtatttgggcatgcatctgataattatgtgttgaatgccttctgagggcaatgctttgtgccatgtgtcatgtgcctggtgcagcttccacttccaattatgtctggaatctgatttcaccattgatgtcaccactccaccattaccattctgctttcagccattatcatctcttgcccagattattacaatagcttctaagtgctctcccggccactcctttccctttctgtaacacagactccacccagaaacagccacagtgatgttataaaaatctaaaccaaatcaagtcatttttctgcttgaaataatgcagtggcttctcatcttattcaggaaaataggtaatccaaagtgcttatcaaggtttgcaaggaccttaggatctggctcactgccagtcttctctcacccctcctttctcagctctgaagtcctcctggctgctccaaacatgattgctcagtgtccccacacctgctgttccctatgctcgaatgcttttccccttgatgtctccctggctcacttccttccattctccaggtctctgctcaaatatcacctcagtaaagagtctgttcttgaccattacataaaatagtactcacctcctactgccatcaatatctatccctttaccctgttttatttttctttataacaattaccgcctcctgacacaaaatacatttcatgtatctgcatgagtgaattcaattggccttttattttctttcctgttatctatgacattcttctcttgcttattgtttttcttacctcattgtccatgccatattaggttgtaagctacatgaacatggggactttcctttttttttttccaacaaatattttttgttgtttgtttttttgaaacagagtttcactcttgttgcccaggctggagtgcaatggcacgatctcagctcaccgcaaccacaacctctgcctcctgggttcaagcaattctcctgcctcagcctcccgagtagctgggattacagacatgcgccaccacgcccagctaattttgtatttttagtagggacggggttactccacgttggttaggctggtctcgaactcccgacctcaggtaatccacccaccttggcctaccaaagtgctgggattacaggcgtgagccaccgcacccggcttcaacaacaaatatttaatgagcacctactctatgccaagctctaggcatctagaaattaacaaaagagaccaggtcttgtacttatgtagattacacttcagtagggtgagatagacaagaaacaagcaagtaaatactatcatatgaaagatggtgattaatgctctggagaaaaatcagaatgctgtagaatatgggatgatttggttagggctaaaaggatgacctgtctttaacaaggtaggcaagactataggaggagcaggttttgagaggaaattaagaatttgcaatatacttgttaatttaaaaatgccttctaggcatcccgtggagaggttaagtatgagtctggagttccatggagaaaataagctgacatataaatttgggattcacctgtgcacagccattgactggatgagatcacagagagaatggcctgagggatagaagggatcaagcccaagtcattgctcatcccaaattaaagatttgtaaaatgagaacgaaccttaaaagaggactaagaaagaatggtcagtgagactgggcacagtcgctcatgcctataatcctagcactttggaaggccctcaaggtggcaggatcgcttgagcccaggtgtttgagactggcctgggcagcatagcaagacctccctctctacaaagaacaaaaaaattagccaggtgaggcagcacacacctgtcatccaaggctgaggtgggaggattgcttgagcccggcaggtcaaggctgcagtaagctgtcattataccattgcactccagcctgggtgacagagtgaccctgtctcaaaaacaaacaaacaaacaaacaaacaaacaaaaaacaaaaaggtcagagagcactgaggagaatcaagaaacagttgtgaaagccaaatgaagaaagcagtttaaatgtgactgactgactgatggcctgtgttaaatcctggtgaaagatcaggtcgggtgagtttggagaaatgaccactgggtttggcaacctcaaggtcactgatgactttgacaagtgctgtcttggtgaaaaaaacatctcttttaagaacttttgctttgaggggaaacagggaattgaggtggtaggatcaagagaatttctcttaaaaaaattattgtaggctgggcatggcggctcatacctgtaatcctaggactttgggaggctgaggtgggcagatcacctgaggtcaggagttcgagactggcctgtccaacatggtgaaaccccgtctctactaaaaatacaaaaaaattacctgggcctggtggagggcgcttgtaatcccagctacttgggaggctgaggcaggagaattgcttgaacgtgggaggcagaggttgcagtgagccgcgattgtgccactccagcctggcaacaagagcaaaactcggtctcaaaaaaaaaaaaaaaaattattgtcctagaaaacactaataacgttggcctggtgtggtaaaccagcaatttgagaagccaaggcggggaattgcttgagcccaggagttcaagaccagcctgtgcaacatggggaaagcttgtctctacaaaagatacaaaaattagccaggcatgctggcacatgcctatagacccagctacgcaggaggctgaggtgggaggatcactcgagcccaggaagttgaggctgcagtgagccatgatcatgctactgcactccagccatagtgacagagtgagaccctctctcaataaataaataattttaaaaagaaaattcataatatacaatctatcctcttaaagtgttcatttagtacagtattattaactgtgagcacaagaaaaattttttttgatagaagaaatcacagcatatttgataaagtgaaagaaaattcatgttttgggaaggataaaattgctggaacaatgtcctagaggagataagaagggagggatggcgaggctgagcgattttcctaaggtcacatagccagtaagtgacaggtcaggattccaatccaggtcttctggctctctgttttttactgacattttgctataccgtaaaatgagaaaaatggcttgggcaacatgtaactttcctcctagttctaactttcatgtctctaacattttgatatgccttcacccatcccaagcatgtaaagaaaattccgaagtcaaacatagtagcagcagcagcagcagcagcacctatctgaacccacagttctcgtctaggtgctcacctatctcatctcaaccactctatgaattgcttagcagtcagcacttggactcatcaacgcctgagccctctgtgggaatcacaaactgtttctgatacctggcagctttactcatttatgttatctgtctggcttcctaaggtatttgagtttgcaatgcttgctcctaaaattaactaggcagtggtctaacaagaaaaggaaggaagggagggagggaaggaaggaatgaaggaaggagagaaggaaggaagacaggagaatacaaagaaaggaagtacaaatgaaggaaggaaggagaggagaagagaggagagggagagggagctataaagaaggtatttacttaatgagttggaaaatcttcaaaaacaatatgggtataggtactttagttgattgtattataagctattgtggtttctaaagtgattttatgttggccatggtcccaatccaacagaggcttttaatatgctatagaagctattattattctccgtatttaaatgatcttaacaccttataatcgtaatagttacttagagaagtaattaatttattctgtgtatataaacataatatgccttcataatattgtcccatcatcttcagtgaagtttacgttaatgctaggaaagccatttaatatgttcagtatactagaaggaaaaagcccatttctcagtggatagttctcaatactaaaacatttgacaagcaaatcaagactaccgcaaagactatctctgagagaatcagaattcttaaaacttaaaatctcaagatttggtctttttccccctaatatgactggaaaatcttatggttcttcccttaaattaacagcctgtgcttaaaagttctgagggaaacacttgcaaattactaggaaaatgttacagtcgtattttttttaacaaaaactaagaaataatttcctgttttatccaaaattgaaaagaagttaagcaccactggaaaagaaaaatacatttgcatctaaaacacaggtccctaatgagaagaaattcgcttggttgactcagtaagagctgtcttctgggactccacactattggcactgttttccagcattctatctgtgaacaagctgtgtacattccaagtatattaggcatattttatgttttcagtgccatgcttaaagagtaccttgttgtatgctgtctctctattacagcatgaactctggagtgtttactagattttttaaatgcttcagttgctaaatgagataaaagtctcagccaagaaccaaagaacttggacctcataggactttgctcctgtttattatcaaagtgatacatggctacattcatgtcattattccacaagatttgaggcctctggaatcaaggtgccatcttgctttcttcaccaggggactctgtcctctgggctctttctcatttcccaactctgtgtttctcctacatagatacccacttttcactctttccaacacaggtcttcccatgctgcttttttgttgttgaagattttagttttgaatagtgttttttttttttattagtatactggtgccatttacatgtatattacaatgggcaatttgggtggtacaatgttatgtcaatgtcgagaaggcacagcccagctacagtctggaacacagtgtaaacaattccatggggaaatgttgcttgggttttggaatgtttcttatgggtgttttaaaatgtcttttaaagaggctcaagcagctgcggtgaatataatcaggtcaccatttccttatgtttaagggtttggcggaggagaggccaagtgcgaggatgcagggaaaggaaataaatgtggaacaggcaggaaagaaacttacttgggcacaggaagccagagaccctggagaggaaataaaggaaaagcaggaaccacaaactaggctaagaaccacagtaaacacagtctgagagccaagtgttctcttatgacaccatccctgtttctgtgtttggttctctgtcctttcttcaagtaagggcgactgtgtccacctccggtggttcccaaatcaggctgtcacagaatcagatggaaagcttaagcaaacacagattcctgtgctctggatcacctagagaaaggaacctggaaattttcttttcttgttttccagctactcccaatgtaagccaacttggaaacaactaatttataacatcttaaaagctgaccaccttatcttagggagaggtcaaccccttggagaagagatggtttagaagggtgtttttaattgtataaaacacaactataagtcaatgcaaacaagaccatagactaacatatgccagtcttggatgtgcattccgaaagttgatggttaaaatagtctatgggggccggatgcggtggctcaggcctgtaatctcagcactttgggaggccgaagcttgcagatcacctgaggttgggagtttgagaccagcctgatcaacatggagaaacccggtctctactaagaatgcaaaattagctgggcatggtggtgtgtgcctataatcccagctacttgggaggctgagggaggagaattgcttgaatccaggaggtggaggttttggtgagccgagattgtgccattgcactccagcctggcagtaagtctatggatggatcatgcctgctacagaaaagccaatgatgcttaatccagagatgacctttttgccattaagtaagaaccagagatcagtgagaaatgtcttactttggaaatccgtaaacatacaaatcatccatatggatggtgtaaaaccactagttgagctagagtaagcaaatgatctttgtggattctaggaattaattgactaaatatcccatgtcctcctgcttacactcctaccaacatagtattggaggttgtctgatgctcaccccactatttttatggatttttatcttgaggcacaatgggttggggttagttctcctagactcttgttgttctgatttcctatttcttctgaattatttttttaaaattcttttttaatttttgtgggtacatagtaggtggcatgtaatgtataaataattacatcagagtaaattgggcatccatcacctccccagtatttttcttttgtgttacaaacaacccaattatagatttagttatttttaaatgtacaattaaattatttttgactgtggtcaccctgttgtcctagcaaatactaggtcttattcattctttctattttttggtatccattaatcatccctactcctctgcctccctgctacctttcccagcctctgataaccacccttctaccctctatcttcgtgagttcatcctctgaattcttacttgttacatccattttgcctcctatgcctggtcttcaccccacaccaactcacacataaaccccttccttccctttggtgtcccagttttcaaatgctgttatcagaagtatagggggttacaagaagtgtttacatcacaacataacactcaaacaactttaaaagtgtatattaaatattttcttttggccctctctgtgatctggaatttcttgtttactgactcctccccaccactctggtctttcatccaatttgagagattttgtaaacttctgaattccaaaaatgaattgcaggtgcaagtgtataaacattttctatctctagagttatcaccaaattatctttcagatttaccaatttattatcaatctgtatgcccatcaataaagtataatcacttgattttcatcattcccttgccaaaaatacatatttgtattttatatatttactcatattgtaggcaaaaaaaaattagtccaatattttacttgcacttttttaattatgaagagtttgagtatctcttcacaagttcaagggtcatttttacttatttatctgtaaactacgttttttttggtgttttttttttttttttttttttggagacagtctctcactctgtcaccctgctggagtgcagtggcacgatcatggctaactgtagccttgacctcctgggtccaagcaatcctcccatctcagcctcccaagcagctgggatcacaagcatgtcaccacaccccgctcattttttaattttttgtagagatggggtctcaccatgttgcccaggctggtctcaaatttctgggctcaagtcatcctcccaccttggcttcccaaagtgttgggattacaggtgtgagccaccacatccagcccaggtttgttttttctattaaggagttggtagttttcttcaattttcttattgatttgcaaaaactcttcacatatgaggagtagtaactcattgtcatatatgttgcaaatatttcccccagtttgtttcttctctgaaattttcagtggtgcatctgatcccatgaggatccccctgggcttgggattactgctagcttttcagtgaggtcacccactgtttggtgggaaagccccagggacatagagctatttgtttagtgtgagcgagtctttttgtttctgttgttgtttgcttttcctgctttttctttttctttctttctttttttttttttttttttttttttgagatgaagtctccctctgtcgcccaggctgaagtgtagtggcctgatctcagctcactacaacttctgcctccagggttcaagtgattctcctgcctcagcctcccaagtagctgggattacaggcacctgtcaccacacccagctaatttttgtatttttagtagagacggggttgcaccatgttggccaggctggtctcaaactactgacctcaggtgatccacccgcttcggcctcccaaagtgttgggattacaggcgtgccaccacacccggccttccctctttttcttacttttttttttttttaaattttcagccaacttttattttctgtaggacatatttagcacttgtgaattactcccagctgatactttttggtctttcgccttgctaggaggaggaaatagtaaattcccttttatgatgcactgtcttgcccccaccttctggttttcagatcagttctctgagacacttctaagtctatttttcagcttctactgttctctaagtttgggggcatgtgtctactgctagaccattattatttgctggatttagttcattttgctcagtttggggagagagggagaagagcttctctcaacctgtatctaggctaacttcctccccagaaagctgttctttactttgtgtgtttttctagaaagaacattctacttcttgggtcccctggctcaggggtgtagtttaaagtgggccagcagcatgggagaggcaaagtgagtaaaaatgtacacttaggccacagtgaaagaaatcttcatctcctctccccctaaaaaaatttccatggaagattttgtgcccttgatggtatagggcctgtgggaacatgtaacatttacacgttcgagttatatttctctcacataattaatagccatttattttattcaaatatgctcctaaaatacatctaggagagtaaatatgcttcttttattataaaatattctcagctctaataatcattattatgttaacacacgtatgatgtgatgaaccacaagcaggcagtgggtgataaagctaaccttgcccattgccagtgtttcccaaactttcatgtttttaagaatcatctgggagctgttaacgcagtttccttggccctgccccacacattctgattcaataaaggtggagcccaggaatctgcctttcttttttctttctctttttttttgatgcagtctctctctgtcgcccaggctggagtgcagtggtgcaatctcggctcactgcaatctctgccgcccgtgttcaagcgattctcctgcctcagcctcctgagtagctgggattacaggcttctgccaccacgtctggctaatttttgtaggtttttagttgagatggggtttcaccatcttggccaggctggtcttgaactcctgacctcgtgatccacccacctcggactcccaaagtgctgggattacaggcatgagctaccacaccctgccggaatctgcctttttaacaagcactatctgtggtctttagtactggcttcgaaaaattctggggcaagatatctcaacctcagcattactgacatttagggctcaataattctttgttggtggggcgctgtcctgtagatgccagtagcaacccccctaatcgtgacaataagaaatgtctctagacattgccaaaatgtcccctggggagttcaatcaccctcaattgggaaccactggcctaggagaaaataaatgagaaaatgttaattaaaaacagtgtttacttttgcatgcagccattcatactcttgcatggatttcattgaacaaattaaacaactatttctgagcatctggtatgtaccaagccttttatattaaaaatgtttaatcatggctacctctttaataatttggaaggtggaagaaaatgttcttataaattaatatctattaagcatatatttttcctaaattaatattcctaatagttttctgaagaatattctagaactttaaaattaatattaacaaagcattgacgttgttttagtaaagaagcaattcagaataaagttggtatgattgctttactttttttttttttttttttttgagacggagtttcgctcttgttgcccaggctggagtgcaatggcacgatctcggctcactgcaacctctgcctcccacgttcaaacaattctcctgtctcaccctcctgagtagctgggattgaaggcatgcgccaccacgcttggctaattttgtatttttagtagagacgaggtttctctatgttggtcaggctggtctcaaactcccgacctcagatgatccgcccacctcggcctcccaaagtgctgggattacaggcgtgagccacttcacccggccttgctttactgtttctaataatgaaactaattttgtttgtaaattttacacttattctaatttaggaaaatatgagaagggagtgatgaagtacctgccatgatattgtttataacatctcacatctgatgtaattctaaaattcttccttagagagtctatggtccatataaataaataagtgatatccaagcacactcattttaatgtgagtttttcacatgatattaaaatgttaaaaatagatcagtatgtagggcatccaagcatttaattccttaaatcggagacatgaggagaaaaaaatgaaaaggaagaaagaaaagaaggaaaaggaaggaaggaagaaaaagttgagtcaaggctgaagctctggcatctctaaccactggtcagtaaattctattgaaattcaatagtataagagacaaacaggcaaaaaggatcgtgaaaccatttccaaataccaagataaaggaggctattgacattcaggaaccctgagaacagctgatgtcccattgtagacttcatcctcttccttgggtgaaagtgtgaatagcgctcaaggcagggaagaagtcttttctctgaaggtgctatttatggtgcccttggcctggatgggctttctgggtagttcccaagggtatcatttctttgtattggaaatcagggacctttgtgggttaggaaagtagaatcaggccatggctattgtctttccctgctgtgtttcacatgtaaaattgactcccagaagagcatcccagggccttgtcaaggagtggggaaaatagcagactgccctagggtggaaacctaactgagagtgcaagggcgacttgcaaagctggggagagagaattactgggaaaatcgtgcctagggcaaagctgaattcaagaaatctgacttttgtgatcttcctctgctgagaatgaatgcggccacctacagcagagtaagaccacagcttgcttttgaaagtgttgctctctaggtggggtgtttgtttgtgtgtgcctgtcctctctcaggatttctagacggttcattttcaaagggtcattaacattatttaaatattcatggtggaggaggggatgagagactgaaatttcagacatctcaagagtgagggatggctggccacccgcctaatacagccccagtctgcggatcagctgcctccttcccctccgctggctttgttagcacacgcgctctgacaccgggccaccggctgccactacacggagggcagcaggaaggctctggcgagccagtgagctggaagcatctctgtccacacctcagcctctgaaccccatcgggggagtcctcaaacacgcggagacaccattactgccacaaagacgcacttcgcaaccagttccgggagtcgctctgaccctgaggacagtcgtggtgctaggtaagggacgaggggctgtttccccgcctgagtgggaactcagcggctcctggcatttgagcgcacacaggcactcacacacttccacatacgctcatgcgcacatatgtgtacaccaacacacacgtccacatgcacacacagcgacacgccaccccgctccaaagccccgtgcgctaacaagtatccatatacccagacacagcgctcccctgagttaggaaacactcagctttgcccgccccatccatccctccgtctttccctctctccagtctctgcattcattcatttcttcgtttgtgcatcgattccgccgaagccactgagaggagaaggtgtgggtagatggggaggggaggggagggaggggcggtccgtgggcgctgggctactggaggggaagcgaggaggcggggaaggggcgggccccaggagcaggcgggcggggctccccgccctccagcgcgcccggaggctaccactccctgcagatgcgctggccccagcccggggctgccgctcgccttcccccggagtctcctggacccccggagtctcctggacccccggagcgggaggcagcggccgcgcggcgctggactggagcagaaccccaggactgcgcccccgggagcgggcgcccagaggtgggtgtccaagctggggaggggaggggctggagtgtcctcgagtgtgaggaaggggtggccgaggaaggggttgccgaggaagggctggaaatctgggagtcctcggaagcaccgcgggcttttaaagggctttttgtggtccttgtcgagcggagcgtgtgctgggagagggcccgggtggaggggctgtggccatgtggatttgaattcctaggtttgtgggagggccaagcctttggctgctttgttcaatgcttatcatttatatatgctttaaaaactaaacgcaggactccgcttctccctgtatacacacagagctgggctgtgtgtccttttcaggaaaagcagtgaaatcaaatgtggtcgtggccgcatctcctgccccgggagcaccgggaggtgcagccgttccttctagctcgcgaggaaggcgcgggtcctgccttttgggtggcagagccgggggcattttcgcaagtcctgaacttttcagagagactgaagtcagggagggccgggccccggccccggtcccggccccagccagagtctttcgggatagggtccagggagctgaactcaggagatgatgcaggaggagccagcagcctcttctgccctgggagggagaacgcggtccgggtccgagctgagccagaagtttggcctgaggctgggacctcagcagttagaatgtggtatcttatccgagataaagccggagtttgcgtctctgtgggcccttcttggggacactctggggtatgggaagagcagaccgtgggggagagcactgggcaagccgtacctgtaatgtccgtggaggcgacgcgcctgcaagaaccagagcaaggagacactggtggccccaagaaatcccagagaaacggagtggataggaggggagtaaaacggagcccgggagagccggaagcccgcagcagggagctgtggcgctggtggccgggtgaggactgaaggcaaagggcgaggcggcgtgcagccgggctgccgagctctccaacgcggatgccaggcgctcgccagcctgagggatccctcctgacccacaaagagggcgtctgggaggtgactcgtttagagagatggtggattccctttccagacccaggaaagcccgtttcccgtgtggggtagcatgggtttggctctgataggctgcgtggtcagatcagactttgacatatcactacccttccccgtagcagttttaaatgcagcacaggtgatttgggaagacttcctaaatgtataatatttctttttgaaaagaaacttcacctactcatacgtctatacacctctctctgtattgcatcttggaatctgtgaacaagcccatgtctcccgggaagcgctcttctatcccaactcccgtttcacaggctcctggagactgcatgaatacaaactcctctcaccattgggatcccagggaatttgcttccttgtcttttgttctgattagagttcatttaagcatcacacttttctttctggaaatgttcttaatttaaatttaactaagcttccctttcttccagtctggcagcttccccaacattcatgaatacaatttcataataatatgtctagaaatgaggagtatccagcaaggagttttactctgtttctttaaacataaagacttggcctaaagagtgttttaagcaatgctccgctgccggttgtctcctccccagttttgacccttggccctttctctgtttttcttttcttttctttttttttcttttcttttctttcgaagttttgctcttgttgcccaggctggagtgcaatggcatgatcttggctcactacaacctctacctcatgggttcaagcaattctcctgcatcagcctcccgaatacctgggattacaggcacccaccaccacacccggctaatttttatatttttagtagagatggggttttgccatgttggccaggctggtcttgaactcctgaccttaggtgattcacctgcctcggcctcccaaagtgctgggattacaggcatgagccaccacacccggcctggccctttccttaaagggcatcttctcctttgagtggaggcacaccaagtttcctgcaattatcttggacagcaccaacaaaattagtcctgagccagggacaacaaaagtaaggctgcctgtctcccagtctttacttaaccaactctgctggagagttcatttcactttctttctgggatgctgagatgctaggatgagaggaatagctgggctttgagatgggacaaacattttgaaatactcattatctcatagttctggcatgacagttggcaccacttcctgcctgcagagtctgaagttatttcactttcataagtggcttattctgactcagtagcctcaggacctctggctaataaagtgaagtaggttgtcttaacttcgttgtcaaatgaagggagaatgaatccactggctttatttctgaaagtttgaatattttcttatagaactaacattaaatattacttccaaaaatgcaaacactttggtctttctagtcattgtaattattgtctagataattacaataatccaaacaataaccattacggatttggtgagctcttaaaatacccatgtcccagatttctgtcacggttattaccagtctctgcttattaaggtaatgagaaatgtttcaaatgaagatgaaattgaatttggatggaggttgtgttgagggattttaacagttgaaacaggagcatgctaaaaagttacttctgaagaccaaggatagactgtttagttccagtctttagctttatacatgactcaacgccagtagaattgatgctgtatcttgaatcagcttttggaatgattgttttttgatcttaagaaacatagtactcactgcttagattgttgatcagggattctgtgtcagctattggaagtttgaagtaattgattagtatcttgatgagcttcaacaatttcagtaagtttgggtagcaaattgcacccttttttttttttttgaaatggagtctttctctgttgcttgggctggaatgcagtggcgcgatctcggctcactgcaagctccgcttccccggttcacatcattctcctgcctcagcctcccaaatagctgagactacaggtgcccaccaccacgcccagctaattttttgtatttttagtagagacagggtttcaccatgttagctaggatgatctcgatctcctgacctcgtgatctgcccgcctcggcctcccaaaatgctgggattacaggcatgagccatcatgcccggcccaccattttctttatactgtgcaaactcaacacccagaggcagaatttctgtaaagctaaaaataaaggaacaacttcaacttcagtttctctcattggcatgagcctcacccagcagcacttcgggtagcttgggcctcagggaagaatgttaccatggaccatgatgggagttaaggtaatccatatacatgtatatcttactttgtaaaataatcccctctatgaacatgtaagactactgttcacaatttggacattttcctttcaaacacatttttcatgaatatattataggaaagttaaaaccatctctattctaaaaggaaaatctaccatttggctcagagagaaagttactgagtttgtctatgtgattttaagtagtatttgattagagtattaaagaaatggggtacttcaagtaacataacacctgatatttaaatctaagttttaaaaatgtatttcacccattgttaatgaaagtgtttctaagatgtaacccctggttagctattccgtcttcttgccttgatgggttgactggtggtgaatgtgctgttgtcattccattgacagttcgggattttgtggtggtctcagcatattagcatagatgtgagttgtaattttataggattatggaactgtaattgtggaactcctgcagggcagactctggaggctagctttttagaaaactgaaacctccagtataaacttaatttctgtcatttgccccattttcttgaaagttaagtgccagaaaagaaaaggatcgagtctctcttttctttctacaataaaacagaatatactttctccagggtttggtggtgggttcctttttcctgttgaggtggattctgagattgaggaggggctggagaagacagagcatgagggaaagagactgagaacatactcaggctgccctcgcctccttttccctttcgtgctcctgtctcccatctaggaggaccagggctaccagtccttgtggggacaagtttgagtaggatcaagagacatgtaactgcgccaggcgcggtggcttacacctgtaatcctggcactttgggaggctgaggcaggtgaatcacttgaggtcaggatttggagaccagcctggccaacatggtgaaaccctgcctctactaaaagaatacaaaaattagccaggtgtggtggcaggtgcctgtaatcccagctactcgagaggctgaggtaggagaattgattgagcctgggaggcagaggttgcagtgagccgagatggagccactgcactccagcctggtgacagagcaagaactctgtctcaaaaaaaaaaaaaaaaaaaaagaaaaaaagaaagaaagaaagaaaaagaaaaaaagagacatgtaacgggaatttgttcccatcttggtgacagtttcagagtgccccgcataggccgtgcaactggagaaggtgccctgtggaggcagaatgctgctgctggggtccttaaccaggcagaggttggatatgaagatgagatgatgtagcttcttttgagtaggtttgaggggttgggttttttgtttgttttttcttctaagccttggaaggatgcatgaactcgttgaagggggtgtgacatgaatgccagggaaggagagagacctgtggaacttactggggaaggccactatgctttgaacccttcttttttcttagatatgggcaggggctttgtggttgtttttgatgcctgattggagcagatggggtggcaaggccaaatacgcagatattgtggtgcgccctttatccagaaccagggcatggccaaagcaccctagtgcctcagccaagttctctgtgagatcttggtctgtcacataaacaaaatcttagttcattcatctataaaaatggagataccaggctgggcatggtggctcacgcctataatcccagcactttgggaggccgaggtgggtgaatcacctgaggtcgggagttcgagaccaacctgaccaacatggagaaacccggtctctactaaaaatataaaattagccgggtgtggtggcgcatgcctgtaatctcagctactcaggaggctgaggcaggaggatcgcttgaacccaggaggcagaggttgcggtgggccgacatggtgccattgcactccagcctgggcaacaagagtgaaactctgtttcaaaaaaaaaaaataccaaaacctacctgttcaaaacttgtgtaaaatcagatggttatggaagcaccttgtacatgtattcctcctaaagttggttgttcttaaattaaccaaagccttctttcatcttcattacagatgcaaatgataagtaaatagtttttaaattaattatttttattattattttttgaaacagggtctcactctgtcacccaggctggagtgcagttgtgtgatcatagctcactgcagtctcgaacttctgggctcaagtgatcctcttgtctcagcctcttgagtagctgggactacaggtgcatgccaccatgcctggctgtttttctattgtttgtagagacagggtctcactacatcgaccaagctggtcttgaacttcggggctcaagcagtcctcccacctcggcctcccaagcagttccacaattacattcccaaagtgctgggataacaggcatgagccgccatgtgctggcctaaagttaacacttaaaatgctagcaattgtgcagcagatcaattgttcatccttcacactgattaagtagctttgaacatggaaattctctaagcctgactgccccccgcccctacccgccagctgccattctcacccctgaagcacttgcactattgagaattcttctatttttcattagttgatccttctttaagctttgagtaattcaggaattggtcttcattgggacaatggaccgcaattttcagaaccataatcctagttttttagtttttttttttaaatttttatttatttatttatttattttttgagacagagttttgctcttgttgcccaggctggagtgcagtggcgcaatctcagctcacagcaacctccacctcctgggtttaagccattctcctgcctcagcctcctgagtagctgggattacaggcgtgtgccactgtgcccggctaatttttgtatttttagtagaggtgaggtttcacatgttgtccaggctggtctcaaattcctgacctcaggtgatctgcccaccttgggcaatcccaaaatgttgggattacaggcatgagccaccacgcctggggaaggggcctcttttggtgaaaaggcaagggcactactcctattcattagtgttctacgcttacgacctaatcacctcccagaggacccacctcctcattccattgtattgggaattagtcttcaaaatatgaattttagggagacacaaacattcagaccctagcagggaccctggaaaggattctcattgtgcagagtatggataaacagtgatgctagggcagtttttccagggttgtcagaaagggctgaactagaagtttccccactgtgcctggagtgccctgggttggttgagtgtagggtttcgaagataattttgtcaggactctttagtttttagtcttttatgagttagaagagtgtgcatatgtaactgccaccataccacagcaagttccagcaagagagaggattcctcaggtggccatcctatccaaactccatggctctttccagggcgtttgtgggaaacctgtggggctaggactgagctagactttttcagtagctgagactggtcctgcagacccatgaaaggtgccatgccgtcacccagtagggggcagggagggaccctcatttgcccctcttcccgcccaacagttgcctgacttcagccttaatgcatagctcatccagagtcctcctgagctcccacctggtgaggtgtgtgtagaaggtgtgaggaaggccaaaccacattttcctggcagtggttaactgaccgttttcagcccgcctcccagtgcagctgactgcgtcagcttacattaccgtgatgtcattcccatggtgggataatatagcatcttactttgtctggagtggtgcctcccataagttttttgataccgcctacaaatggagaaagacatcattgtttagccatttttatttgggtgggttggaggaatgactttcccaaaggaataaatcttagttaatattccagaaaattcaagtacttttcaaccctaattgaaaggcactctgtgtgcgtgaattaaaatcaaggtggagtccatgtgccatgtgctgtgtgattctaaagccatattttagcttggcctattagtattttgcatcagaacattttatacttgcaaaggttagcaagaattttcctcagacacattacagatgagcagaatttattcattttgggggaaaaaatgaacagactgtatttggaaacttagatcatatccaaagcacttgatgattcctgtttggaatcatttttccttcaaagaatagttcagatcagtgttaaatgcagggcagagatggactcaagagtgggaggcattgcttttgaatggaatcacaatgtgtatatcattttaagtattatttttatggtatgtttcattatcaaaaccatctatagcctccaaaggatgacaggtgttatagtgtgagtggcgtagagggtgttgagatagaggaatgaaaagagaagagatcgttccctttccactcaccattcatagaggaactaagttttaccttctagggaattccctgtaattcccagggacgccttgtccttgcggttcccaggcaggatggtaggaggagctaagtgggagggaattaatatttcttgagtgtcggctggtaagttggttgctttacctccacttttttagagacagggtctctccgtgtcacccagatggagtgcagtggtgtgatcatagcttactgcaaccttgaactcctacctacactattttacttaatctttatagtcaccagcatttttcaaatggagatactgagacatttggaagtcacataaccatccaggggtcccacagctacataatgtcaggtcagttttcctacccagctccttctctgttttttttttttttgtttttttgtttttttttttgcaacagagactcgctctgccatgctggagtgcagtggcgccatctcagctcactgcaacctctgcctccccggttcaagcgattttcctgcctcaacttcctgagtagctgtgtctacaggcgcgtgccaccacgcccggctaatttcttgtatttttagtagagacggggtttcactgtgttagccagggtggtctccatctcctgacctcatgatccgcctgcctcggcctcccaaagtgctgggattacaggtgtgagccaccacgcccagccctctccttttcttactaaaccagtgctgtaggggcttgctactccaagtgtggtctggggacctgcagcattcctgtcatccaggagcgtgttaaaactagagtatcctgagccccatcccagacctacttaatcagaatctgcattttagcaaaatccctaatgagtcctgagcatgttactgtgtgaggaagctctgcttagaggaggaaagtctgacaattacaactatgcatcctggccaagactcaggacttgaatccatggactggacccgaaacattggtctatctcagtgagggaggaagggtgctactagaatctgatgggtagagaccagggatgcagctaaacgctctataacacacaggacacccccttccaccaacaaagaattatcctgcacaaaatatcaatggtgccaatgttgaaaaaccctggtctaattgtctagatgtagaattcacatcctgtagatatgtttcgtagcctcagatgtatgcaaatctctaggaagtagatcttaaaggagttgatacaaattgcagtgtgctatgcaaatgggaatatttttattgggacttgaaaagagaaaaagagcttaaactgaagcatgaaagatttccattagagttttgagagtgtcagactctcaaacaataatatcagggatgcagtggaaaagtttctaagcatgtactgagtacccaccattgagggtgctacaaggcaacattccctcccattcccaatcctgcctggcaacagtgccttctgtttcttcattttattcctaagacttgccctggcctttgtcctacctttccgttctcaagcaggatatgctgggtcagttgtgccacctggaggctgggggaggaacgcaaataatgaataattggtaaagggaaccaaagcgctgtttctaccatcttttcctccctgcctgcgtggatccacacctcactgtttcttactcaactccttcaatgccacgacactgtagccacttccactggtggacacatatcctctctccctccttccttcccattctctttagatcctggcccagaacatctgaaaagatctgtcctccctcccctgtctctctccctttttttcttctctttcttccttttctgagctgaacagcaacctgtatcaatactgggaagtaaaatgagtatgcttattgtatactgatggaaagttttttggttttttttttttttttttttgagatggagtcttactctgttgccctgctggagtgcagtggtgcaatctcggctcactgcaacctccgccccctgggttcaagcgattctgctgcctcagcctccctagtagcagggattacaggcatgtgccaccacgcccacgtaatttttgtattttgggtagagacagggtttcaccatgtttgccaggctggtctcaaactcctgacctcaagtgatccgtctgcctcggcctcccaaagtgctgggattacaggtgtgagccaccgcgcccagccgatggaaaatgttttgaagtgaaattatatccaataaagagctcctgtcattcatccagttgtgagagtccctttgagagttgccagaaatgtctgctgtcttgtttttactcttaaattaacttgctctttctcgaagtacagaattctaaaacagagttggtgtttttgttgttgttctattatgtcctcctgctttctttagttgttggtactagaatagtcattttctactactttttcatggacattatccttgaaataggttattctagacaagttttggaacccaaactggatttaagaccaaggcattccaagaaaaataaaatctttttgcaatttctatgcatcatctttttataactttcattctcctttgcaaaggaaatgtggggctgtggatgtgaaaggaggtgggggcagtgaccggccagctgcagaacattcaagcctggcctttggactcagagactagggcagaagaagccagagtgctaggcttctggccagagtggaatgtgtcttcccaggagtgggaagcctgtgtttttccaccttaccatctgatctgctccagagggctctgcattagaaaaatagggagctatggggaatgactagggggtggagatcatgagagcagtgtctatggaggattatcagttatgctcagaaagggaagatttggcacctggtcatcgatttttagtacagtaattgtcttgagaaaagtatttgagaatcaatattagaaacaatttttaaaatatatcagtcttaaaggtacataaatgagaggaagaaaatcagagatcagggtgtctgcaagatggtctactaggctttttattattgtaatttgtgattgaatgccctctgtggggccaggtattttgtttttgtttttgtttttgtttttgtttttgttttagatgagtcttgctgtgttgcccaggctggaatgcaatggtgcgatttcggctcactgcaacctccgcctcctgtgtttaagcgattctgttggcttggcctcccaagtagctgagacaacaggtgcgcaccacaacatccggcaaatttttgtatttctaatattcaccatgttggccaggctggtctcgaactcctgacctcaagtgatctgcccaccttggcctcccaaagtgctgggatgggccaggtaattttattttagcctgacaactactctttggggtccttggatagtttttaattccattttgaagatggaaaagtgagatgaattggtcaaggtcaggcccacaggccctatttttttccccttgcattgttactgtgctgggtgacaactggtgctgagacagctgctgtctccatcactctcatgaggaaagagggtcaacaggtccaggagtttttgtttgtttgtttgttttagatggaatctcactctgttgcccaggctggagtgcagtggcgcgatctcggctcactgcaacctccgcctcctgggttcaagccattctcctgcctcagcctcccgagtagctgagactacaggtacatgccaccagggctagctaatttttgtatttttggtagagacgggatttcgccatgttggccaggatggtctccatctactgaccttgtgatccacccgcctcagcctcccaaagtgctgggattacagcaggagtttttactctaaatattaagttaagcttacaagttaagctacttgtaagctgtctgaaggtctatttccctgactttgcagttccttaattttgaaggcaatctctgcctgtatgtcttcttccttagagacctttgtcccgttaaggtaacctcctctcccagcccacaccttctaaagtaccttgtcacgtctcatgaactccacaagggtcctcttgggcatgataatgtgtgtcacctcttgcaagatccactaaaccctctttgccacaagttatgcttttcaaagtccgcctgaaaatatgctaacaagaatcattgtacaactgacttgcaaatacttgaacaaatacaaattaacaattactgcagctttatgaagaatgcatccaaaccaaggacagagtggaggaagacataatacaatgtatgggtacaatttaataaaaccttgaacctttaacatgggcccattttcatgcatgcattgtgatcaagttttgttcagaagggtgtaacttaactttgaaaaaaactatacatttttatgtgttttcagtgagtttaaccttccataagcacagatactctgttataaaagtgagtttaagctgcttcttgataatgaatgttgactgaaagtcaggccctatttccagtgtcatatgtggattgtcatatttaacccccgtaacaacctttgatagagataccattattttatatatatatataaaatatatatatttatttatatatatatgtgtgtgtgtacatatatatatgtgtacaacaggtacacaccaccacgcctggctaatttttgtatttttagtatagatggggtttcaccatgttggccaggctggtctcgaactcttgagctccagtaatctgcctgcctcggcctcccaaagtgctgggattataggcataagccaacatgccagacaaatattattataattttttgttacagatgaagaaacagacacaagggtttagggcaagggtacacagctagtggcaaagccaagcttggaatccctataggctagtggttagagacagtctcttaatcattcctgtttttactatgctgccttcttagtgcttaatacaaactaagcttgttgtctccttttactatggttgggggtataaatctcagtccataaacaaaggcttacaaaaaaatagcattaaaaaaattttattttaagttccaggatacatgtgcaggacctacaggtttgttacataggtaaacgtgtgccatggtgctttgctgcacctatcaacccatcacctacatattaagccctacatgcattagctagttatcctgatgctctccctccccaccccctccaagaggccccagtgtgtgttgttcccttccctgtgtccatgtatactcattgttcagctctcacttgtaagtgagaacatgtggtgtttggttttctgttgctgcattagtttgctgaggataatggctttgagctccattcatgtctctgcaaagtacatgatctcattcctttttatggctgcatagtattccatggtgtatatgtaccacataaaaaatagcattttaaaacttatgtaaattaattttatctccaagccttcaatctgtccaactataagaaaatgtaccccattatttttagacacacccaccctaggattacctgcaggacctaaggttttagaatgtgctaggttgtgggaagtggtccatccaacacctatctacaatggtttcaacagtgatttctagcacatgtgttatattagtttgctaaggctgccatagcaaagtaccacagcctgggtagtttaaacaacagaaatctattttctcatatagttgtaaaaggaagttaaattttgggaccccaaactcatttagccaaagggaaaagtcaagctgagaactgggtcacgcaaacctgcctcccctctttggttcctaaataagatggctacaagatgaaaaaatacctgccttccctatattttgcccacagggaaattcctggtgagctgttaaaacttcaccatggcaatgcaaattgatagtttatcttatacaggcgcagtcacccaggccctgccagactcaaaagcatatctgattgttcccctaccccattttgtctgtgctatcttatgtaaaatgcagattctccacattttttcctctgccccttttgtttatgtgaaaactgtgtgcttctcaatatcccaccttttctcctttaaatttggaatcctcaaaatcatctctggagaaaggcatacatctgtctcccaggcatgttcttaactttggcaaataaatctaaaatgattgagatttgtcttgtcattttcttccattgacagaggctagaagaccaagatccaggtgtttgcagggttggttgcttctgagggctgtgaggagaggttctgttctaggtcttggcttgtagatgggtgtcttctcccagtgtcttcacatggtctctcctctgtgtatgtatctgtgtccaaatttctatttttttttttttttttgagacagagtttcactcttgtcacccaggctggagtgcaatggcacgatctcagctcactgcaaactctgcctcccaggttcaagtgattctcctgcctcagcctcccaagtagctgggattacaggtgcccaccaccacgcccagctaatttttttttgtatttttagtagagacaaaatttcaccacgttggccaggctggtcttaaactcctgacctcaagtgatccacccacgttagcctcccaaactgctgggattacaggcgtgagccaccacgcttggctcaaatttcctcttctgtaagaacaccagtcatattagactcatccactctaaagacttcattttaatttaattacctctttaaagaccctgtatccaaataccatcacactcagaagtattgggggttagggcttcaacataggaagtggagcaagggttggggtaggggtgcacacagttcatcccatttgaggctctttaccagttcatgcaggcatgggacaggtcagggaaatccttggtaagtctgggaacctggagcccctcttctctgaagccttgccagttcccttaggagcttccacggaccaaagtgaaacacccaggggtggagggggtaaggagcttttctagaacaccttgcaaatcttgttgatggcttagatgtttacaaaactctagaaaaatcttatctccttgatatgagatcctggaagcaaggagttaaaagcctggctgcctacctaaggaggaggaggaaggagtggaagtaaacgaagacattgattatgatagaaaaaatgttaatagaaggcgatttttggaagccaaagagaaaattcagcttgaatcccctagtagtgtgtatgctcatcttcccaagacggaagtgcctctcctgtccgacctcctagcccagcctcggtctggaacacattgggtcctaggcacccagcagtgaattggctcagaaagtgtttgagggctcaagtgagtccaggaacgatggctcacgcctgtaatcccagaacattggaaggctgagatgcgaagattgcttgaagccaggagttcaagcctgtgtagttagtggtatgtcctcagcagaagccacaggactgtgatttgaagagaaggatatggggttgaactgcttcttactgccacggcagctctctggccccggaactggggcagttccttcattgtcccacctctgtcatcgcaggaatcccaagctgtcacacttctcagtattgtttcctttgcaatttgatgtggacttggcacatttccaaggtggaaacgacccctcattcattatttttgggacctcggtggccccgtgataagggaaatgatggatgcctggacttgtcttctggcattgcgcaccagatatcagggccctccacaggaccagcctatgagacaggaagaggctgaggtcttaaagacatactttcttgggagtttgatgtttcctcttgcttccacagctgtcagaaagggcttgttctgagggtgacctgcaggttgcaaggctgtggaaacatagcagtgacagcgttgaatggcttgtccccatcagtaagctttggtgtcacaccagccggatgactttctggtggagggccagcttcctgcacttccgtgacagcagcctgacagccccatggaggcatggctgtagacattaagacatttctgtagacatttgttctagttgttgtccttttttgtctgttatttattatttatttatttatcattatttatttagagacaaggtctcactctgtcaccaggctagagtgcagtggtgcaatcatggcttattacaaccttgatctcctgggcccaagcgatactcccacctcagcctcctgagaggctgggaccacaggtgtgcaccacaatgcctggctaatttttaaattttctgtagacagggtcacaccatgttgtccaggctggtctcaaactcctgagctccagcgatcctcccaccttggtgtcccagagtgtggggtcttaggtgtgagccatcgtgcctgccctgtttttcattttaattgtgtgacataaaatgtaaaatgtaccctctaaaccattttttagtgtccagttttgtggtattaagtacattcacattattgtgcaaccgtccccaccatccattcacagaactctttcaacttgcaaaactgaaactgtatgcattaagcaataactatcccttccttctttcctcttccccagctcttggcaaccaccattctactttctgtctctatgaagttgtctactctagtaacctcatataagtgaaatcacgtatttgtctttctgtgactggcttatttcacttagcataatgtcctcaatgtttatccatgttatagcatgtgtcacaatttccttcctttaaaaaaattgaataatgtcccattgtgtttatatgccacattttgtatatccattcattcattcgatacttgggttgcttccaccttttgtcttgcccttgtttttgagaggttaatccatctatgaggtcctccaggcatcaaaagagttccccagttccctactttggagaagttcactatccctagcaaagatgcaaagaacagatacatgaaaaagtaaatcatggtgcaaaagttgtatgagacaacactttaagatgtatcctatgagcgtaggtgtagatttgcaaaatggctggtgtggagtttctggaagaggatggcttagagagagtatggacttaaagcagagttaaggagcccaagctgaaatcctggctttgtgacttcctgtccttgtcactttgggtgaattattgaacctttgtaagctttagtttcctcatctgtaaaacgcagataatagtacttacctcatagagttgttgagaggattaagtgagtaaatgtaagtaaaagatgggcgtggtgattcatgcctgtaatcccagcactttgggaggctaaggcaggaggattacttgaacccagaagttctagaccagcctgggcagcatagtgagaccttgtctctaaaaacaatttaaaaacttagctggtcatggtggtgcacacctgtagtcctggctgcttgggaggctgaagtgggaagatcccttgagcccaggagttctaaggtggcagtgagctatgatcacaacactgcactctagcctggggaacagaccaagacattgtctcttaaaaaaaaaaaaaagtaggtaaagattgaaacaggctggcacacggttagaactcagtactaaaatataaaggagataacatattgcccactaacattttggctatttttaatatattgttcttgtctttttaatgaccacagatactctttagtatctgtttgctgcagtttttgcaggtattcatgatgcctgttatgcctttcctattttacctccttttcagattatgatagttttagcaaagaagtattcagttctagagactcattatcaaggaaagagagagctcttcatttggttttatcagataatagataataataaatatggcctggctttctttgcactgggaagatagagaatgaggaaggagaatgactattagtcattctaacgttagtctgttttatcgaactgaggagggagttagctttctccaactctgggcagattaccgagagtaggatgccaggttacattctcttgggagaacagtgctatcatggctgatctctcaattaaggacttcatatttagattatttaaatctcaaatattgaaatactctcatttttctaacaatgataattaagaaaactttgtaaagttacaaataaagtgaaattgaaaaggtttgctgaatgaagtattttactattgaaaggtcttctagaatgtaagtttcaaacacatcgtctggttggtgcattacttaatctattcctgtttggctgctgcttggtatttcccacgcaggagttcattgacttcaaggcaattgaatgcattattagccagaagaagaaaacatgtgagtctccttcacccaacaatagattttttaaaatacattgtgcacagtcctcttaaaaaaggcatcaatggcaggtgggtgtgaacagaggaatttcctcctccaccctggctgttgctgagctgtaagctgtaaacattgtgagagacaaaaagtatcaaggtctcaactttctttcggatattgctttgtatttctgtttactagtatgaatgaaaattttcctgaaaatgctggctaaaactgaattttggtgttgtctttctaatggaatttctgatcaacaatttcctttatgttggcaattgcttaatctgctgaagtaggtaaggtagttgtgctgccttaaaatttatttttatatttgtcattaaaaacaaacatgaaacttggaggttaattttgtctgtttaaattttgatgctttcattttgacaaaatcttttaagaataatgacgaggctgcagtgattgaaatacaatttgtgtggcttttaggcaagtgagcatttagcaagtaagaatttcccagattgggtttagagttgtatttgcttatgttccaaactctttttttttttttttttggtaagataattttgaatatcagtagaacttggggcagatagaatgacagaacatggaatgtgtaatccttttgggatttgtatcttagttaagtaaactttcatgatggattaaggaggacaaagtctccagcagatttcacttggctgattttgtttttctgttctttttctgttttcctgatgaggcttctgtacttctccctttaaggaggcaactgaatagcatgaaaataaggggtatgggtggtggtagttgctgaggggaatgacaatggatttggtaacacagcatgctaatatcatgcaaataatgagatgatataggaatctctgctctagtggtgggtctgaggtttgctctagtggtgggtctgaggttttctctactgagggcaaaattggagcttttttaaaaaaaaaaaaaaatttaatttttttttgagacagggtctccttctgttgcccaggctggagtgtagtggtgccatcacagctcactgcagcctccatctcccccaggctcaagcgatcctcccacctcagcctcccgagtagctgagaccacaggtgtgcgccaccatgcctggctaatttttaaattattttgtagagagagagtcttgccttgttgcccagactggtctcgaactcctggcctcaagtgatcctcctgccttggcctcccaaagtgttgggattataggcatgagctgccacacccagcctggaactttcttaaaagagaacttctttcttggtttgccacacctctgggttaacaaggtgccagagataattagcccttgattgggagaatgtgggactgttcactatggaaggatcttacagtatagaaatgaaaccctagtgtaggaagggagctgacatttttcagtgttaccttgacttaatttgcaaaatgttttattttctgaagccacagtgtaattcacagatgcaccaagatcaaaggtctctaagaagaagaggttgtggggaaagagcccagtagaggtagggaggccacaatgaacccattgagttattccacctgtcaaaaccttggttttgtaaactgcaaaataggaccagtaatacctatgattagctgctgctgttacgaattaagttcagtaacaagtccgacatggctggcgcatgctgttttcaataaatataaattctgctcccaaccattcaacatcaaatgagttgatctgcaaaaagtgttttgaaaactacagatactaattttcatttgtgtatgcctgttagttgacttcaaaacatttgtttgtcccaggaacagaagagaaatatcctttgatcatgagacaggttcatttttagtatgttaaggccactccatgtcattcttgtggcttgttaatgtggttaattgaaacccttccatattcttgatggggcagaaccttcagctgttttcatgttcatgttcaggggtgtaaatttctagacgatcttgtgggcctctgtcagctctgagattaaatgacgtgtgcatttgcttatcggattcttaactctaaaaccctgggatgaggactaggaaggagaaccaggaggcgctgagggaacaacagcttccacatggcccatctgctttgcagaacctgtgtctttggggtacaagtgagctggaggtggagctgcaacagagtgagtccccgtggtcagtcacatgcaccggcttccgcctggtatgatttatcagcagtgatgcaaacatgattcagagatagttttataagaatttttacttcggttaaatcataatcaggcggctatttccgtttttctaatgtcacttgattagctcaagatgcccaacccttattgtcctgactcatggagggaggctgcttgctaagtaatcgtgagacccaggagaggaagagggttggcggccatccccactggaggggcatcctggaaaactccagagagggaagcttgtgaccatgactcctagcagagcggtactgacaacctagtacaaaacccatagtggaaacactttcacctactctcatacattcatcttcccctgagaggaagcagagctgacattgtccagtcccattctgcactcaaagaaatgcagtctcagagaagctacgggaatggttcaaggtcacatgcttgcatatggcaaaattccaaatgcagacagaccactgaaattaggggagaggggagatcttctctttctactttaaactattttatattgtttgggtagtttccaaagaacaatgactattttaaaaagaattttaaaaagtaaatttaaaaactaaaaagttttagaaactaaattttaaaatctctgtttatttgtgattattcaaattttagaaaatgaaaaaagagcctcaccaattctttcagtcgatcctctcatttttacagaccagaggactgagaaaagtataagttggtcaattgtgataagctgggtattggcagaaaatctgttttaaaacttagtaggctcactgggatgattgaagctctgtgttctgcttaatacatgtttagctgcctgaactaactcagatgactccatgctgtaccatagagagaggagcctgacctttggctttgggatctatgcgaccccagtcagaacatggcacttttgatgtcttcatgacctttggcgtgctactcttcctctttgcatttctgtttttttcgtctgtaactgggaataatacccatccggcaagtttcgaattagaaattagaggccaggtgtggtagctcatgcctgtaatcccagcactttgggaggctgacgtgggtggatcacttgaagtcaggagttcaagaccagcctggccaacgtggtgaaaccccgcctctactaaaaacatacaaaaattagccagacatggtggtacgtgcctgtagtctcagctatgtgggaggctgaggcaggagaattgcttgaactcgagaggcggaggctgcagggagcccagatcatgccactgcactccagcctgggcaacagagcgagactctgtttcaaaaaaaaaaaaaagaattggtagaacccatctgaaattgccacttttataggtcaaatggtcgaatattagaaatttcatgtagttgaactcaacatttagagagtctgataggtactcagtaaatagttactattagagatgtaatagaggatacaaataaaattcttatggttgctttagcgaggtcccaaatgttattttcttctcccaaggaaatgactaacaggaatatagcttttcacttttttacattggtaaagatcttctctgactttggaaagcctgccacttactgagggccacctctactcatggctcccaggatgtagtctatcttattgacgtctttgacagttcataactcagttcactttctccctgtctatgcttggtcacttggatggatacatgtcctctgtaactcctccttctttcagttctctttcaatgaagatcaattatttttcatttaagaatcttcctgtgcaatgattgctctatgccctgatacatagaaaatgggcatattttccaattagcactaccattgtttcttgtgggtaaatttcggctaaaattatgtctataaaattcccttagacttaagtagtattattgagtgataggagcctgagggtgatttgggagatacttgtgttctgcccatcactgtgttattaactaaccttatatagtcttcgtaggacttgttcatatatgtacaaggtcagtaagatcattctaagtcaaacacttggctatctgtgattttctcaccattttgtgtttatagatagttcagacagtgagtgttagggaaacagtgaaaggtgagttagtagtagttcatattattaactcattttattggaatttccaatttttccttcccaaaatttttctctgaaccagtataaccctaaacctattggtaaaatatagaatcttaagcctattggtaaaatatagaatcttaactacattccaatataaagcaaactgttgatgtgggcaaaaatgagggggaggagagggagaaagaagtggaagagaaaatgagaaattctaagtcttcatcactttccacaggactcggccataacccaaactcaagctgcccactgttgcttgggatggcgggctctctctggaccagctctgtggctaagggtggcaaggggcccatcagaatggagcagtccctgatctatcagaggtctcaaaaaactgcctgctactaagcttggatctttccagaatcatgtggatgatagaatttgcctatagtgtcatgcatggaaaaggaagagaaactaaaggcagactttaaaggaattacttatctgtgccctctagcatctctgagaattgtgctaaggatttgttgcaaggatggcggtagatgaagaagccattggtttgagtgagatttggagttaggcgtagtaatccttgggtgctggagtagtgtcttgtttgagggagcagtgttcatagggcataaatgctatagaggtgtctgaaccacctggagccacaatctgtcctcatgatcttgcccttcaaatgcagccgcatgcccacataacccaccttggggagtagccaatactcaggctactctgtgggctggcattcttggtctcctgacttctgccccagctctaccttggttgataccccaaatgccccttttcctctggcctacctagcctgctttctccccttcttccttggttaactttgcacgtgaccattttgattctctaaagagaatcattcaattaggaaatggaaatctgaggcaatgagagagaggagacatgcatcactatttatttttagaaacttcacacaacaccaagcccaaactgttaagcattgccttaggagaggtttctaccattgtgcttgccaggtataagaaaagaaaattacaattgattctgtaatttcttttgtaataatcatcatagattccaaaacacagaatgagtctttagtgcgaagccctgaagcctctgtctgcaagtccattttaatgacagtttttgttctgagcaagaatgcgtcattgctggtcttgtgttttcagacaaacacaaagcttttaggaaataagaagcttaagtaaaaagactacaggttgttctctcctgggagttcctggacaccctctcaactgggacacttgaagtgagcctcatgacctgagctgagaattgccatggctgaaacagcttttatagggtgttttacatggacacttgacactctttggatcacattgtgtgtgatccagactcaagccagggttagcctagcttgttgttttatctcagttaaaagccttttgttaagagaacaaacaagaaagttcagataggtcaagaaagccagctctgaggatatatctagagggcaagtcatatttatttttcaaagtttccccaggaattaaaggttgcacatctaaatgtcaccacttctgtgacttttgcagataaacattagatttacctttggcaaactgcagtgtctacattatgggatttccctccccagagtcttttctctggggaagttctgaaaaattgtttcagggatactatagttcttaaatataactaacaaacatattatgaaatgctgttagtttttttctggaggctgaatattgattgctacttagtataccttttttaatgattatattgtcccaccaggatatttacacagcttcatgtgtcttcccacaaaatacacatgaattgcaaagggaatatagtaacttggcagtagagaaacttggcagataccaccctaatcaaataatcaaatctaacaccattagtaattggacaaattggcagtgtgcaccatttgatgagatgcacagaggaaaacacagcatcgcttctgtgatattcctgcacaaatgcatgagttagatctaatcatgaggaaatatcaggtaacctcaaattgcgggatgttcaacaaaataacttgtctataatctttagaagtcccaaattagctgggcatgatagctcacacctataatcctagctacttgggaagctgaagcgggaggatcccttgaggccaggagtttgaggccagtctaggcaatatggtgagagcccatctcaaataaataagtaagtaaaagtcatgaaagacaaggaaagactaagaaagtaccccaaattgaaggagactagagacatgagacatgggagcctagattggatcattttattagtaagaacatcattgggaccaagattgaaatttgcatgaggtctatggtttacatgtagaattccatcaatgttaattacaagattttgaggctggactgtggttaggtggaaaaagtccttgtttttcaaaaatgtaccttgaagtattaggaataacgaggcattatgtctgcaaaaagactccaatagttcacaaaaaaattataaacacacacacgcacatacacataccatgtagcattctaatttttagaaccagaaatgagcttttaaaaagtcaccataggctgggtgtggtggttcacgcccgtaatcccagcacattgggaggctgaggcaggtggatcacctgaggtcaagagttcgagaccagcctggccaacatggtgaaaccccgtctctactagaaatacaaaaactagctgggtgtggtggcgtgtgcctgtaatcccagctacttgggaggctgagacaggagaatctcttgaacccaggaggcagatgttgcagtgagccaagattgtgccactgcactccagcctgagcgacagagtgagactccatctcaagaaaaaaaagaaaaagaaaaagaaaaaaaaaagtcactgtaagagatgaattagaagaatgtgtcttgaatgcgggcacaatttatttttgttgtcaattgacaatcttgaaaaaattctggccgaatgtcggtgtgccagctgtttcatgcaccagacctgtagttcacccctactcttttacctgtagttcatccctactcttctaaggcttgaatggaaaataatttctaatttgttgtaaaatttaccaatttggtattgctgctgtaaacaggattttatctagggtttagatgccttatcttcaaattccactatcaagctagtacataaaattgtttgaaaactgaatcagatgtttatgtaattcataaaaacatataatttccctctaatatttcatttttcctaattataaaaataatgcatgcttattatagaaatgtagacataaaaaactataaaaagaagaaaagaaaactcaatccaaatcttaccactcagaaatgacgtgccactggtaacatttagacttatttcctcctaatatgtatattttaaactgccctcattctctttttttctttctttctttttttttaacctctatagtcgctcctgtaaaagctgcccctatgcttgtaacattattctacaatggacttttggatcctaatgtttttactcactttagcataagcattttcccatgtagcaaaatttcagatattttacctttttattttaaaataattttaaacttagaaaagagttgcaagagtagtacaaagaatttttgttttctcttcactaattgttaacatttctcatatttgacatgttatataatttatatatgtctatattatatacagatgcataatttttaatatttttttctgaaccttctaaaaataagttgcagatatcatgcccctttatattactttatatagtctcaaaagtgttaaaaaaattcaggaaatttgacattgatacaatactattacctaatataaacttggtttttcaaaatttgccagtttttgcaaagtgacctctagcatttttttaccccaacaccaggatccaatcctggatcacactttgtattttgatattgtctctttatcaccctctaatctgataaagctcatcagtcctttttctttgtctttcatgacattgacatttgtaaagaatatttttccttccatgtgaattagtctggtttctacacgtggtccttaatagctataaaatattccaccgaattttacctagataaatgctttatgttggtgatttgatggtttctagtgtttatcttcataaataaggctgcagtgaacatccttgtatttatgttttataaacatccctggttattttctctctgatagaatcctggaaataaaatactgggtaaactagcataggtatataggctcctgaggatatataggtatatcatatatattctacatatatatatatatatataggtatatatacctccaaaaggatgcttttcaaaaggatgaaactggcaagaataaaatctcactagttgccaaatgaaacttcatttttgaaacacaggagtataaaataaaaacttacagaatatatcctatgttattatttttcagttatctgtaatattttggtcagatgtgctttattaagtaaaaatatagggtcccaaatcatgcacacatgatgtttagatgcatatggaagaccagctagacaaggccacctccgagttttgtgtgttgagccactttttatgggttacttattcatttgaaattgatcctggcatctgtcaaggtaacattacagtatcactgcttggggctccctttcacttgcctgtatggatagagctttaatgtttatttcgtgggcaattcataacctgtagcacatgaaggaggctgtcacgcaatgtataccacccctgtggtaggcccaggaccggcgtttgtctcaaacaattccagtaggccttttattcagtgaagtggatagatttggtggataccactcagtgagtcagagttttggaatcaatgttctccatagctcatagcataagctctggagcctgacaatcctgggtgtgattctcagcttaactacttgctgtgtgacaacaagcaaatcccttaacctctctgagccttggttcctttatctgtaaaaggaagactgtagtcgtactcctctaatagggcgataccctattagatgtggatgaaatacaataacaaataggaagcctttagcatgttacttggcacattgcaagtacacattcagtgatagctttcataattactataatagtacattcatttcgaggttgtacattgacagtgagcaaaacactttaacatcttgtgacgtgggcaagttctcccatttgacagatgagaaaccttagacagaaagcgggttatatgaactaacaaagccatgtgtcaggtaaacggtgaggctgggcattaatctcacgtctctgactcatgggtcagcgggtcagggctctctcttcaggatatccagtgactgttccataactcgttacctggaagtccaatgctgtttgggcaaattttgaataaacccagtggttctcctacagatacatcttgatttagaataggcattagcaaatgttttctgcaaagggccagacagaaaatattgtaggtcttagccgagtgcagtggctcacgcctgtaatcccagcactttgggaggccgaggtggtcggatcacgaggtcaggagttcgagaccagcctgaccaacatggtgaaacgctgtctctactaaaaatacaaaaattagctgggcgtggtggtgtacgcctgtaatcctagctactcaggaggctgagacaggagaatcgcttgaacccaggaggcagaggtttcagtgagccgagatcgcgctactgcactccagcctgggtgacagagtgagactcagtctcaaaaaaaaaaaaaaagaaagaaagaaaatactgtaggccttgcaggccatatggtctctgttataactacatttctcaactttgctgctcaaacttgaaaacagccttagacaatatgtaaatgaataggcgtggctgtgttataataaaactatttactagaaccagcggcgaccagatttggcacatgggctgtctttatcaacccctgatttagacagggtgtattctggcagggggcacatgcatttcattatattagttacatgacaaccttcttttgagttcttagacatagtgaagaacactccagaaccttgagtctggcatgtagtaggtatttggtcactgtttgctgaatacaggaaagcttctctgtctatattttcctatggtgaatttttctgaatttatgtattcttatctatttttaaataactgttttattttagcacttatgaatttttaagttttgtttttgtttcacattgttctgaaaggacattaaaagcagatcgggaaaagagcatttagccccaaatgtaggtttaaacatattttcagatattcttagtgtttgtcgtgtatcagtttgttattttattttcattctcttgcactgagggtaatttccaataaaaactctggagaatttagacagcttttgttttaattaggaagctatttcacttgcactcttgtactactgttgactcaaataattaacagtaatggctgaataatttgttctttaaaagtaaacaacctccctttgtaatctagaaaagaatcagctggtgatacacatggagtgtttgctccaagaacatttctcatggtgtggaaaatggcagtggtggcctcctggctttcaggctgaaatacatttagctgatctttgtcggcaaaggtgtccaacaatagcaactgcttatgacaactaattttaggaaacgtgtgtagttaatttgaaatatcgccctgggccgttcaaccttggctgaataaggatgttttcttttaaaatcagtactttgcttccctcagtgattattccctattagcctgccaagaaatattatttcccttttgtatgatttgatgaagtacctcaaaaatctcctggttatggtcaacatttcatctgataggaagcgagtgtatctttctggtatacagtgaggcatgaggacacacagcttattttaatcttcaagctcgcctgtaatcctagcactttgggaggccgaggtgggtagatcacctgaggtcaggggattgagaccagcctggccaacgtggcgaaacctccactctactaaaaataaaaaaattagccaagcatggcggtgcatgcctgtaatcccagctactcgggaggctgaggcaggagaatcgcttgaactcaggaggcggatgttgcagtgagccgagatcgtgccactggactccagcctgggcgacagagtgagactccatctccaaaaagaaaaaaaaatcttcaagttgagatgttaggttaatcttcagtctccctgtgttttcccacaaggaatagtgtggaaaagacttggggaaaaaaaaatcatcatgattcagccaatgaccagggcagaggtataaatggagcatgattctatgtatctgtctagaaggcatatatggagcatgattctatgtatctgtctagaaggtatatatggagcatgattctatgtatctgtctttctgtacttgttgcctactgagaaaatacagatttttattagaaggttgctgggcacggtggctcacgcctgtaatctcaccactttgggaggccaaggcgtgcagaaaacctgaggtcaggagttcgagaccagcctggccaagctggtgaaacctcgtctctactgaaaatacaaaaatttgctgggcgtggtggcaggatcctgtaatccaagctacttgggagactgaggcaggagaatcacttgaaccggggaggtggaggttgcagtgagctgagattgcgccattgcacttcagcttgggtgacagagcgagactctgtctcaaaaaaaaaaaaaaaaaaaaaaaaaatagaagattaaggatccctatctgaaaaatcaactttgttctttctcttcatcagttttgtcagtgtacattcagcagctactacacgctaggcatagtgccaggcagccctggggatataaacatgtaatctatcaccgctgttaacctactggtgatttgaagactgcatcccaggagaccaatgatagtgatggaaattggtagggaaggttgctttaaggtctttagtatcttctatttgcctaagagaaagagaacttttgggagaagaaaccatacattttatctcttttcatctttatgccttatgttatcaggaaaatatttaataggagttgccaataaggttgataattctagaccatcaaaaccatagaggtgtgatgtcaggtgtaggaagagatgggaaacacgatgtaaaatgtctgcgtggctcacataggaaatctgtgcttagagtgctgtggcagaagtagaaattgctgtcagccaactgattttctgattcttctgtctataaaagctgtgcccattgttaacttaggtgataagttgaatttttagtttttttaggttttttgtttgtttgtttgtttttgaggtggagtctcactccgttgcccacgctggagtgcagtggtgcgatcttggctcaccacaacctccgcctcccgggttcaagcgattctcctgcctcagcctcccaagtagctgggattacaggcacccgccaccatgaccagctaatattttgtatttttagtagagatgaggtttcatcatgttggcaaggctggtctcaaactcccaacctcaggtgatccacccgccttgggcctcccaaagtgctgggattacagacgtgaggcactgcgcccagccaaatgttaaaagtatttttgagcttctcagaggaaaccaatgaactgaagttcaataatctgtggtttgtgttacaatattttgaatccttccggagactgaatgaaagatacatatttaaagtgaatgcagtaagtaggaagaggcactgcttcagcctggtaacatgcagttattgctttgagggtcttgcagaaagaatatgcacattgagtaagtaggagaaggtgtgtattttggaaaaatcaatcaacttagttcaacttgaaggttttcctatctgaaaagggatgtatcaaaagatattttttcttaggaggaaaaaatccacaactcgcaccagagcatttcattgagaattactgttatttacgttttggaatttacattgttaaaaagagagattttggaaaggcaggggtgggactagaattgtggcttgcatgttgcctataaacatagattcctttttttagatgtctgtgtttcttagtggattatgttcttaaaatagaacataccacattactctctggtttggcagggtgtggtgttttgtttactgcttgggtcaatgttctatgaacatgaatcttttcacagagaatcccagggctaaaagaattcttagaggtgagccagtcgaggccccagcacccgcttcccaaaggctcttcctgccagccaccaggcctcatgctccagtggcagtccagcccaagcgacaggaaactctcccttcttttaactggaatctcacatccagtggcttctctgcttgtgctgggtccctgctggggcttcccagaattctgtgcaactcctctttcctgtgagagccctcacgatgttagagatttggggtggggttctcatgctcactccaaagcccctacctctccaaaccttcctcaccatgctaaatagccccagttcccccatatgtgttcttatttgatagttaaagccctttgccactgatttcaaccttttaatgtgtgcagtcaagagagaaacctgtgttctggtctagaacatcacctatctggttctttggttcatacttttctgaatatatcccaaggtagtgcaagcagtggctttttgttttgttttgtttttttgagacagagtctcgctcttgttgcccaggctggagtgcagtggtgtgatcttggctcactgcaacctctgcctcctggatttaagcagattacagtagtgtgccaccacacccgactaattttgtatttttagtagacacagggtttcaccatgttggccaggctggtctcaaactcctgacctcaggtgatccacccacctcagcctcccaaagtgctgggatttacaggcttgagccactgcacccagccaagcagtggcgtcttaacataagagggtcaggctctaaaacaccgtaggaagtgaaatctgatatggtataaaaatcacccttgagatcacctataaaataaagtatataaaaacaaccagtagttttgtgtcagaaccctttgtaataattcttacgtacaataaagtttagaactgctgatctggcctaaagagtagaaataaggggaaaaatctcatctacaaaagacttctgcataaagatagtggattgaacacaggcatctacttgcgcccaccaccaaacaaaacatcatttaaatgatacaaagagaatttttggttttggttttgtggtaaaatgtatgcaacataaaactttaccattttaaccatgttaaggtatacagttcagtagtgttaagtactgaacatattgtgcaactgttgccaacatttttgtccagaactttttcattttcccaaactgaaactctgtacccattaaacaatgactctgtagggctgggcgtggtgactcacgcctgtaatcccagcacgttgggaggctgaggtgggcggatcacctgaggtcgggagttcgagatcaccctgaccaacatggagaaaccccgtctctactaaaaatacaaaattagccaggtgtggtggcgcgtgcctgtaatcccagctacttgggaggctgaggcaggagaatcacttgaacctgggaggcggaggttgtggtgagtcaagatcacgccattgcactccagcctgggcaacaagagtgaaacttggtctcaaaaaaagcaaaaaaacaaaaaacaaaaacaatgactttatattcctcacttcccccagcccctagcagccacccttctactttctgtctctacggtttggctactctaggtaccttgtatcagtggaatcatatagtatttgtccttctgtactaacttatttcacttaggggagttttttttaaaaaggcataagtctataaacacaagcataacagaaaacgaggcaacaacagcgtggtttttggcattaggatacaggggtgtgtgtggctaaaataaggaggcctagtctgttttaataatgttgaaacatttctgagcctttgcacttctttagatgaatcagttggttctcagccttccccattgacagcctaggatactgttttgtttttgtttttaagtctgcaaagttttttgttttttggtttggtttgttttttttcctacttatctgtctgctttctatcttgccaagttttgttgaaaaattccattggtagcaaagagaagatcctacctataagcttccagggggataaaatagatcacatacaaagagtcaagaataaaaatgggcttgacttcttaacaccaacactggcagctagaagacaatgggaacaaggcctttgatagcatggaagagcatgattttaaaactagaattgtatattccatcacactcttgtgagggtagaataatgcatttcacacataacaagttttcagaaagtaactggagaagatggtccactgagatgagggagtaaaccaggaaagaaaactaccagcggtagagcaaatgggatatccaacctgagagaggcagaggaaatttctagatgcctagggcgggaactcccagctgaccgctgtgctcctgaagcatgccagaggctcaggaagtgacttcctttgtaaggtggagttgatagaatatgtgaggcatcttggtgtcatgagaagagatttagagatatgatggaaaagtttaggcttgaattagcaagagctatataaaacactaagcaaaggtggggaaatactgttactaatgctgaaaacagtaagatgttcaggaaaggaaaactgaccatcattcaccatgtggcttagctgaaagtaatgttatgttattataatactgatcttcaaaagtttccatataattatattgggaagagtaccctcatatggtgagggcatagataggaaaaaccattaaattatcattctccatattgagaagttaataaataatgccaacaatggaaaaatcacaaagaagcaatgtaaattgttaccaaaaattacctaaaagaggttaaagtaccaaggatatccttggtaactatgggggggttggttccaggagcttcctcagatacccaaatctacagatggtccttaatatagaatggtgtagtatttgtgtataacctctgaagatctctagattacttatgatagctaatgccatgtaaatgctgtgtaaatagtttttatactgtattatttagggaatcatgataaaaaaaagtctgtgggtgttcactacacgtgctaccatactttgtttgtttgtttgtttttctttttttttttgagacggagtctcgctctgttgcccaggctggagtacagtggcacgatctcggctcactgcaacctccacctcccgggttcaagcgattctcctgcctcaacctcccgagtagctgggactacaggcatgtgccaccacgcccagctgatttttttttttgtatttttagtagagatgggatttcactgtgttagtcaggatggtcttgatctcctgaccttatgatctgcctgcctcggcctctcaaagtgctgggattacaggcgtgagccaccgcgcccggcctagatgcaaccatactttaaaaaatatattttccatcgtggttggttgagtctacagtgtgtaaccacagacgcagagggccaattgtacttactcttgggaggaaaaatcggagggaagcaggccgaagtggtgacccgtaggaattgttgttttctgtactattaggcgctttaaactatgtaactgtatgtctttaataaaaaatagtaattaaagttaaagagaatgtgtacaaaggaaagggaaaggtactggaggatatggtccagcaaggtgaaggggtaagttgaaaaagtataagaggtgggatacaggaaaccagggatatagaaactcaagaaaatataaagtctagcagtcaactaagcaagactggagcaggaagacccatggctgtgggacacaatggaacaggtggatttcttgatgtatggatgtagaaaatactactgtgatgtttcaccgatctggaactttgggccgagttagcaatatgtaagtagaaaactaagtaattgaggaatatagttaacttcagaggaaaaaacctcagaaaattagacaagaaaacatagtatactctgtaagtcttcagtgcacaaaatttatatgaacctaataataaacactgaataataaatttgtgaagtaaataaaaatattgggaggacaagttgagggggatgccaatggataatgcctaaaactgataaatagaaagcaagatagcctaaacatcatatttagaaaagtgtggcaagtaccaaaaagaaataactacagcccatgcgaagtggctcacacctgtaatcctagcactttgggaggccgaggcgggcggatcacctgaggtcaggagtttgaggccagactggccaaaatgttgaaaccccatctctactaaaaatacaaaaattacctgggcatggtggtgtgtgcctgtaatcctggctactcgggaggttgaggcaggagaatcgcttgaacccgggaggcagtggttgcagtgagctgagattgcactactgcactccacctgggcaataagagtgagactccatctcaaaaaaaaaaaaaaaaagaaataactacaaagagttgcaagtggtataagactgagaagtgggagggtgtggggcacttgtttgacaatttaactcttaaactctgtttgatttttaaaaactatgtgcttgctatttgcattttaatctaatgaaggtaaaaatggattaaaatataaaaaagaaaagccatctatatgcagatgtctgggcagtataaaaggtctgagagatgtgcttaatactatgattattaaagaagttaatgtctatgagagcacccagcacatagtaggcactaaataaatgtttgctggatttgaatctaaagcatgcttgatcagacctacatagaggcaattccttgaaaagctgcagagaatgacttgtaccatttgctgactttccaagatggcatttcttgctggggctccactgattattactgttgtacctgtgggcattgggctcatgaccccataggtgcgtgtgtgtacatgcacatgcattaagttgcaaagtcagtctaaatgacttgactatcaacctgtctttggcagccatatcacttttggcccagttggcaccatcaggtttctggacacagaggcagtattttccatccctgtcctacagagtgtatttgtctcaagtgttatgtacttttccagtttctttgcccccagtaaatctctagggtcatgaagatcattacaaaacagatagtcatttcatctctcttcttaaagcctctcacccattgccctaggaagaagaccccaaatccttggcattcaaagcctaggtggtcaatgatttgaccccctacccattgctctggctttatttcttgccactccagacttcactgtttacactcaagtaaaaccaaagtaattgcaattctctgtaaacactacgccattccatacctcaggtgactttgctcttgctatccttcctgcctggactaactatctcacatctccctgtcacacccaactcccaattctctccaccatgctggtccttctctctaacatggctaactctaccccactttaagactcagctttatcagcccttgctatgagaagcctttgttgatcaccccaggaggagaaaggtgtccccttttgtgctctccatcaagagcatcacagaactaatgcatcatcttaatactattaatgtgtctgatgtgtcggagaggccccaaaggtttgaggaccatgtttgtcttgatcactgcacagtacctgacccagctcattcccagtagggctgggactaatcttgcaggtcttcacagttgcaatcatttgttcagaggtggctcttccccagtctattacagaagcctcatgtctattcttggagagtcccaagaccatggcctctaaggttccagccttatcgtggtttggaggctccttcagttccttgtcatttgaatgcagaactggatgctgtgaatgagttctagaacatggttccatggggcagagttctgactttaaaaaagccatttactaaccaagctgcatggatttctcttttcccatttcatcaaggaagcaccccggctaggtgagctggttcatttcattcattgactcaacaaatatttactaagtgtctgccataggccagttactgttctaggcatgtaggagacagtagtgaggaagatggatgaggtttctgtcctcagggacctgagatcgtagaggagggaagcaaacacagagccatttggagtggtaataagtgctgagaagggaagaaagggaatgtgggatgagggggctgcttagatgtgctgatcaagggaggaggtctctgagacaacagcatttgtattgtatggttctgaattgcaaaaaagagctgttcaaattgttatcagtggagggtgtccaggttcttggcatcttgaacaaagaattggacaaaatgcacaaacaaaggaaggaaagaatgaagcaacaaaagcagagatttattgaaaatgaaagcacacaccacaaggtgtgccttcacaagcagcaagcagctcaagggactggttacagaattgtctggggtttaaataccctttagagatttcccattggttacttggtgtatgccctatgtaatgaagtagtggctcatgattagtctgattggttgcaggaggggaccaatcagaggctgaagttacaaagctacaccctatgcaaacatctgattgtggaaagcaaccaatcagaggctgcagtgaagttacaaagttatacttctatgcaaatgaagatttggcccaaggccaacctgattggttgtgggaagggagcaatcagacataatttcaatttttcatctgccacacaagaaaagggtgggggatttgcaaagggagtagttctggtccttttgttactttggtgtggaaagttgaggttttccttttgattcagttctaggtagtcagcgtgaattggctttaggttccctgcctctagaccctattctcctgcctcaaaataaagagctatatagctgcactctccagccactggccacaagtagctattaaagtttgcatttacgtgttttttttttttttttttttttttttttttttctgagacagagtgtcactctgtcgcccaggctggagtgcagtgatgcgatctcagttcactgcaacctccgcctcccgggttcaagaaattctcctgtctcagcctcccaagtagctgggaatacagcttcaagccaccacgcccagctaatttttgtatttttagtagagctagggtttcaccttattgatcaggctggtctggaactcctgacctcaggtgatccacctgcgttggcctcccaaagtgctggcatttcaggcatgagccaccgcgccggcctacagtttgcatttaagttaactaaatacaatttaaaaaatcagatcctcagtcacactggccacatttcaagtagtcagtaaccagcctatggctaggagcaccataatgggcagtgcagagcaatagggagaaagggcactggggaggcggatgggagaagcagtaagaaagggaaactagatcacttgttggagagcacatgtatgcatttcaaagaactgcctcctttaatttcacttgttgaaaatggggctgaagccaagactagttatgtctgatagaatgttttaaagtggaattaaaatgatctctagagataatataaagcaggtaaaaaccagccatgaaaagatctttattaaggaatatggcatggctacagcaagtcctgagatggagataagtactagttgattccaggggccagtggatgaggtcacagttaccccttggccttagaaggaggaagccagacatcctaactctgacaccaggagcatactttacctaaaatcttaaagacaggacaatgtttaaaaaaatcccttcttaacacaattcttaacaaaaataggattttgacttttgtgtcttaggaggctagaattgtattctcatgccattaccaggaacggctgtgccttgacttcattttgtatcgtgtttcacaagatgctcatccctttttgcacctgcctctttgctaaacaggttttcttcctctctgtaaaggtgcctttgtttgaaccaatagtgttacttctctttactgtaaacagtgtccagtgactcttccttatcgtggagagccagcagccttttacaggaggagaaaagtcttgaaggtcactttctgatgtttacattataagtcatcatgactttaaaagatgaaaactaaaacaacaacaacaaaaaaccacaactgcctactgcttacccagggcatgttatcctattacatttgaattcaagtaacagctagtatttgtcaaatcataattgatctgataaaatgtaatctgatcattagtagctgtgtaaacgtaaatacactcgactcctgtttcatttgcccttgaaggctgtaacatggttccaaagtgtacctttgaaccggagaagtcgggccggttcacattgcagcctgtgtgcttcctggggcagcgtccaccaggtgtgtgcgggcaggtacaggatgcgagctcagtcctgcttcccctgaaatcctgtgacctggcagagggctgtgttcctgtgtccttacatcggatgtcctactgaagaaagggaaactgggacgaagctgtaggcacagtgggttctgaagatcagatataactgagggaaagttaggtcatgattgccacctggatgctgttctctctcttcacggtaggtctcagttacttttactgtggacttttgcttgctgcagagggaacttacacctttcatgcctcaagctcattaaggcacatttctcttttattcttcagggacattgcatttatgaactcaaggcattgagtcacccagagagaaaaagcatatcccaaacatttcagtttctgggagttctaaaaagctaatgttgtgttcccatggccaacatttctttaagagaggtaaagcagaataactctaggtctataaaaatgctgatctgcttcaagttctaaatttattgtgaattatttatttttccctagtaattactgtaataccttagtaccttcaacttatatagcatttttcaaggaggcaaagcatcagtagaaatgttctctgggatttttttacctgatgttttaatgctgtgatgatttctcagccccttagtaataatgttagatgcactgtggaaaaactaggcacgtagctgttaagctgggaatgtatgaacggtatacatgctatgctttaaaatctagctcaatttttttttttttgcattgaccttgaacatgctgacaacataggtcggcatgggtaaagctaaagaatggccttagggtttgaaaacaactacatgagctctgtttcagacctgctgctagtcgggcacttggcactttgcagggatttggggcaggttttatgtttgtgtgcttctcttagaagtcaaagagttggtgaggtaactgcaatcctgtctatatcagtgtagtgataatgcagtagtgtaatgaagaatggagctgcacgtgtgaggtttttcaagtccacaaagatcaggtattgtctacggtcaataaagatttttttaaaaaaccctcttaactaaagagaggtaacttccttttcaaaactctgaaatttacatgtgctgacttataatgtgtgtgatcctcgttgcttttctgatccttggtggttggggtgtgtgtgtgtgtgtgtgtctgtgtgatgggctttttaatctttgagatttattctttttttttttttttttttttgagacagagtcttgctctgtcgcccaggctggggtgcagtagcacgatctccgctcactgcaatctctacctcccgggttcatgccattctcctgcctcagcctcccgagtagctgggactataggcgcctgcctccacacccggctaattttttgtatttttagtagagatggggtttcaccgtgttagccaggatggtcttgatctcctgacctcatgatctgcccgccttggcctcccaaagtgccgggattacaggtgtgagccaccgcgcccagccaagatttatttattttttacttacacatagtgaaattcattctttttgctgtacatctctatgagtttagataaatgcttacagttgaggaaacatcaccacaatcaagataaagaacagttccatgatcccctaaatatattttgcttcaaatttctattggcatgtttgagtatcaagtttactaccacttctgaagatggagccaagcccttttgtaacaaatagcacagctgtgtctgacacttttcatgtgaaaggttgcctgagatgtcagaagtaagatctggccagttgcagtggctcatacctgtaatctcagcactttgtgaagccgaggcgggaggaccacctgaggtcaggagttcaagatcagcctggccaacatagtgaaactccgtatctactaaaaatacaaaaattagccaggtgtggtggtgcattcctgtagtcccagctacttgggaggctgaggcaggagaattacatgaacccgggaggtggaggctgtagtgagctgagattgtgccaccgcattccagtctgagtgacagagtgagactccgcctcaaaaaaaaagaagtaagatctgattgacttatccttttctcaaagttataaatgggaaaattgtacaatctgaatattgtttccttgtattttaattaatgaatgtagaactgtgtaatgtattatatgcttttttaaacccaaagaaatttgtaataaatactttagttagtaaaaagaatatactgaaagtgaaaaaagtcaattttttgcactttagatttttttttaagtgagcttagttctgtgtggttttaagggcagtgaaatgctgtagaaggactgtaatctgcataactcaaactggcttaataagtggaatttattggctaatatcactgaaaggtaaaggtacagggatagacttgaggcattgtgggatctagaaattcaaacgatgttatccgcctctctttccccactcagctgtgtttccctctgtgttggttctattctctagtagactcttgcttgctgtatcaaggtgactgacagcagcttccggcttttattctactttctcaattccgtacagttccaacaagtctcagaatggggtctcatgggctctgattgcttctcctgctccttatgacccccagggatggggtgggggtgagcggcagtgctctgattggtcagacttaggtcacctgctcactcctagagctgaaggagtgagagctccccctagaccacggtgcagaatgaaggtagagagtggcagaagaggtggttctttaagggaaattgagggacatgtatgtcagatcaagaaaacacatgtcctctgcagggacgttcaggccatgtagccagttgttgtctttgtttttaaataatttttataaacacctaccctaggctaaccttccaaataagcaaaagtttcagaattgatagttgattgattgattgttttatggcttatgagatgacaactgtttactggatgtgagatgtaatattttgggaggaaaatagtggaaattgagtgactgcgggactcggctaagatgggtagatggggcatgaggagaactggtcctgtgtctgtcaagggatcaatgagtaaggaaaaatgggcttcaaggacaaaaagccaggagaaaagaaaaagaagataccagagattggcaattgaccaaaaatttagcaagattaccattgctgaaatagcagaaatattgtcttggatagaaatgctatcagggacatttaatgagaatttatgaagattcaaggctggcatagctactctaatcatgtgaagagtgattgcatctagaataaagcccagattcccaaacctgacatttgtgatctggggcccatctccctctccaggctcatctcccctgctgctgccttgcaccttacaacgagctgtttgtagtctggaaggcatcacactaccctgtttccttcactattcatgctctctcctctgcctggaatccctctcccgttgaccagactcatcttttaagactcagttcagatgacagtttctctgagaagcattctttgattatgcctctctggcttaagaattcctcttctatactctcgtgataccttgtgcgtctttcccagtggtctcaactgagggctgttttgtctccaaggggacatttggcaatgttgggatacatttttgattgtcatgacaggtgagcgctactagttggtggaagccagggatgctgcttaatatccttcatacagcacacaggacagccccaacaaagaggcacctggccccaaatgtcaatagcaccgctgttgagaaccctgcttaccattgcactggcaacattgttggatacatctgtttttagtcttatcttcaccactaggctgaggcccatgtgtgtgatctgcatctttgtatgtctaataccacaatgcaccactgtagggtagttcctcaggagagaatagtttaaagatgattgtatacattttcttaggatagtgaccaatgaacaaggcaactggaggccgtactcgtctttgcgctaggtagccttaaacttgaggctctctgtattagttagttctcacattgctatgaagaaatacctgaaactgggtaatttataaagacaagaggtttaactggctcatgattccacaggctgtataggaggcatggttctggtatccgctcagcttctggggaggtctcaggaaacttacaaacatgatggaaggcaaagggggagtgagcacttcatatagccagggcaggaagaaagggagtggggaggtgctacatacttttaaacaacaagatcttgtgagaactctattatcggaatagcaccacggggcgggggggcgggtaatctgcccccatgatccaatcacttctcaccaggccccacctccaacattggggattacaattcgacatgagatttgggtggagacacagatccaaaccatatcactcctttatcttgccatgcctttgtcttctcactcttctgcaaaaagagctttggggtttactgtagcaaataatggaaaacattaaagaagtattgttagcatagttcttttgctttcaatttttacctaagttattgtccaattttacattctgaatggtgaactgggtggcctggccacactatttggctgcctctggcaaaaacttctgccctcacttctgaccattacattttccccctaccgtatgtgtagtactctggattggtaacgtttgatgggaaagaaaacaaaatcagaaagcaacgattctgagagcaggaataaggaatgttaagtcccctttttgacggctgggctttttttcttatgccaagtttaagtgcaaagcagcagttcccttgtgccctgggacttttgcctaggaacaagggactgccagaaaacctcagaaaatccccatggagatgtctctgaaaaccatgtaaacagggacattgtctaagtgggtcatcctgaatatatgatgcaggatggaaacctatttagttattgaatatttcagattaagaggacaccgcagccttgctttgcacaatcttgctagctttgtgagtttcactggggattggaggggaggcccgccttcaacttgagctgcttgtgttttggttggtggtaatgccttagaaacagaaaggagccagctccccttcagccactcaggcttctgcctgggtttccttttaaccctggaatttcatgtggaccctcagctatgaaaacagatcacatatggcctgctgtcaagcataagaattgcctttttgttcttggggaattgcacaaagcaagtaggagacggggaagaagaccgttctaagcaggaaaatatattgcattaattcttcccttccattgcctcctccccatcttgtgctatattctggtactaggacttttgcttttttctaggctgaatcacatttggccatagcagaggaaaagtgatagctgttaggggtcttggaaggagtattgagttcctagagtgggaccatcttggccaggccgcttcttgtcctcttttggggctgggactggtatgatgttgaagtagcccatctctaagtcttcccctcctccctgccagcttaattgtgcaacattgttcaatcaagtcactgaatcatcagccctgtgatatctacaagcgcatgcatgtgtctgagtgaagtgagctgggcagttccatgatacccttttctatgtatggagggtgaggtgtttctccttggtttaccctgaccaatttattattactgttccaaaaaggaaactgcatgattaatgtcagaatcaggtccaaaggcctctggctctggtgatggctaatgtgatttggatctagattctgtttaataacctgccaaaggcacctagctctttctctttttttgctgttttttgtttgttttgatttttgtctttataagacagggtcttgctctgttgcccaggttggagtacagtagcaggttcatatgtcactgtagcttcaacctcctgggctcaagcgatccttccatctcagcctcccaagtagctgggactacaggaatgcaccattatgcctgaatttatttatttatttatttattaagatgggggtcttcccatgtttcccaggctggtcttaaactcctaggctcaagtgatcttcccacctcagcctcccaaaatgttgggatgacaggcatgagccatcacgcctggccttggctctttcttctgtccccttggtggggacgttggggtgacccatatgtggtacatggcaggtaatgttcttttcatactagccagtcttctgttgtgattccactgtgtgtaagatgtgtccaaaatgaggagatgcatccccgcacctagaggtgtacagtctagtggtctttctgctcttcctgcttttttctgggaaagagactttttgtggggggttgggggggggtgagtccaggacagcaagttcatcataaatgcaaatgggaaggctattgatatttttattcatagcatgaatgatgtaataaatgagtcacgatgtcagcctcttttaacagaatcacagaattttctttttatttatttatttatttatttatttatttattattttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaccagcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacatggcaaccatccgatttctcaatcttttccccacctttcccccctttctattccacaaaactgccattgtcatcatggcccgttctcaatgagctgttgggtacacctcccagacggggtggtggccgggcagagacgctcctcacatcccggacggggcgacagggcagaggcgctccccacatctcaggcgatgggtggccgggcagagacgctcctcacttcctagatgggatggcggccgggaagaggcgctcctcacttcctagatgggatggcggctgggcagagatgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggctgctgggaggtggatgttgtagcgagctgagatcatgccactgcactccagcctgggcaccattgagcactgagtgaaggagactccgtctgcaatcccggcacctcgggaggccaaggctggcggatcactcgtggtaaggagctggagaccagcccggccaacacagcgaaaccccgtctccacccaaaaaatacgaaaaccagtcaggcgtggcggcgcgtgcctgcaatcgcaggcactcggcaggctgaggcaggagaatcaggcagggaggttgcagtgagccgagatggcagcagtacagtccagcttcggctcggcatcagagggagacagtggaaagaggggagaggggagaggggagagggaatcacagaattttcaaactggtttagcatgctggctctgcagccagactgcctgagctcaaatgtcagttgacttttctgtaaaatgggataataatagtaccagtttcatagatttgcaggagatgtgagattacatgaattcacttataaaaagtgcgtgatacttaaagccatgttacctttaaacttccaatccattcattcatttattcaacaaaaactacatactgtgatggttgcacaagcctgtgaaaatactgaaaactaatgtattgtatactttaaaagggtgaattcaatggtatgtaaattaagtatatctcaatgaagctgttttaaaaaaattaattgattacctattatgtgctggacacagctcttttaaactgaggcctagagcaggtgacttgctcaaggtgagtgaatggcagagatagttctagaactcaagtcctctgacacatcagccaagctctttgcaaactgtcagggatccaaatgaagatcgcaatccagattggaaactaaagtcactttctgtcctggtatagaaccaaagtttaacttaagaaagaatcgtgacgtgacctaaggaccttggcattctacttcaccacctctctctgcaggtattctcatttccacgcacctccacattttcgaagacttcagacaaatatatcacaaataacctatataaattcactatatgaaaagcaggccaacatttccaccccatccttcctctttcccccagctctggatataaaacacatatttttcagttagattttttcagttaagtgattactttcaattcccctgtttttggcatttaaaaatgttcacttcttattgcaagacagggacagtctttaaagatttttctgctcaccaccactaccaaaaactaataacaaattttgtcttcatggggaagaaaatcttactcattcttgagatttcacagccatgtctaaagatctaggctatataagaagagaggaatgccttagaaatgtaatgctgtttttcctacggaatcaatttctgtagaaatagaaaccatggtgcatccagagttaccctgcagccttctgctcctggcagcttgctgtgtgttctctgccacatgctttcttctgggatttcttccttctactgacatctggtacttaggataagggaaaaggctttccctgaaccagtgaaattgctatcaggaaaaaatgactcaagtttccaggcagctatgaatgaggtgtttttctgggcggtctgagcaactatcttttggaaggatacataagaaggtacaagctgccagcccatccatttccctaagatgaacttgaagcacgttttctttcagcagcccagacagcacaggcttttcctagcagatgggtggcattacctcactgacatttaatgaataggttgcccccagggggtggaattgtagcaaagtctattatgaaatctcatttgctttgcatgaatcagtttaggagtcccgagaaaacaaaatttgaaaaatgaaaagtggccacatagcttgccctgtaactgcttggacatggcaggtaataatcatagtcagtttgcgcttttatgatggagagggctttcaattgatttgtatttcttgtgagtaggaacaaagccagttgtaagtaccttttagctttgttccctcctttctcattttctaggactgtagcatctggggcatataattgagctctgagagccgagagctggagggggagggggtggtcagaggaaaattattcaattcacacatataacatgcatatatatatgtgtgtgtgtgtcttaaacatatatgcatatgtatgtgtgtctatatatatatatatatatatatatatatagaaacataaatattttatcaagttgagaatgggagaatagatttctttcagcaaacaacctcaagcctattatacatctgatttatgaagggtaagaaattcaaccttaacccaagcaaaggtttaaaaaggcagcatgggtattattgggcttaggaaaaggtgaaggctgccttgctgccgtcctggaagattgagacagtggtaacaacacgtgcagcaaccccctgcacttctagaaggaagctgatatctgtctacatgtttcagcgtttgtctctgaacctagtcttttcttggtcacataggggaagcaacagaggtggcttatcatagcaatgcaaaagcctttaatgaaaaatgggctcaggttttggttcctataagatggtgattcccttcccccacaaaggcctttgtgtacatggggtgaggtaggggtctgagaaaggccactggaaatggaaggcttaacggccagtcctctgctatgtcccagatggaaagctccttgtatctaagaaaggcaggaaaccatgtcacctggcttctgatatgtaacaaccccaaattattctccgaccccttgaaggccagctgggctcttttgcatcagggggattgtgtttagaatttgtgtcaactgtctttgtagagatccttctggataactactacaattcctgggatattcttacagtgggcacatgacaaagacatgtgacattggcccaaacccccctcaacttggaaaaggggtggattcccccagctgacttgaagattctggtctgtggattcagcaagagtctgaggcctctgctgagtgagccaagggtggcttccggggaggtgagtgcctggaggagaatgttcccagagccaagatgggatgcctcctggtatcaaagtgatgttcagattttttctggaaatctagaataggataaatgtgaatagagattagagtgaacatcttctaggatttgaagcccttgagagcttctaggatttgaagctcttggtcttgagaccaagcctctgcaatgcatctggggtccgttgcacaagtgtgtgtctttttaccaggtcttatccccgcttcagccttttctctcctgttagggatcaaaacttgccaaaacagaaattttaaaaagacacgcaggatgtggggctgctcctgggaggtttgctgtgtgtgtttggggtcctgcaccctccactccactcctgagtgtccaagggtggatgtccagaaatttagccacctactcccatcagtgtagccagaacctttgctgggagttaatctctctccctcattactttctgatctgcttgaaagacaaatagaggttagggaaatatattaatatcagtaagtctccatggatggcccaggtcaaggcagacaaaggtagtcacacgctttcaggggctgaaagacaagtagaggttagggaaatgtatcagcgcatctccatggataacccaggccaaggcagacaaagaaagccacgtgctttcaggtgcaaacagcggccgccttttttcactggacatcattgggcagctgttgctgtcatttcccacggcctctctggaggggaaacacagctggcttctgtgggccagcctgaaaccatctgcagctgcttgcatgctttcaaatgtaagtaagggaatttcagctgaggttaatctgggaaatcctctgtatgaaacattttccttttcactgttccctttccttttggatataacatatgacccacttacgaggcagcctgttggatcactggtccccaaggagctgtggatgtcttcccagattactcctgccaccaccaatgcgtctaccaccatgagagctgctgctgatgggcactgcactgtgcatgttgcatatgtgatctcatttagcactgtgacactccaaggaccacactcttgtctcattttcggataaggaagctgaggctccaagaggtccagcagcttgtcttaacagtgaacaggtgcaaaaccaagatttgaaaccagtttttgatcttggtttgatcttgatgccacatcccagcctctttctacctctgtaggacggctttgtgtctcctctgcattttcagcctccattgctaatctgacaccatctaaagcaggaatatccttattaatggaatagtgcttaatgggattaggcttacttctgtattctagacaatatttactgagctgttagatgtaatgtgttcagaaataatacagggatttatgaatatgtattaaatattagagtataaactttatcaagcagagaatatatttgtcctccagtgttgttgaccttgtatgttttttgtttgtgttacctccagagctggattttgaaagattaagccaagaaaaaaagatgagacattcaaaagtaaataaattagtttaggcctggcttttctggggccatggagttgttatcccaaagtccttgcttggacctctcctcctctccactcctcccctcccctcccctccccattgggcactgccagggcccagtacaagtgaaacagatgctcaactcctagacttgtggaggcttaggtagaccagcaagtcactattaggacagaaaaacaagaccacgtcattccccagcccaatcccttatgctttctttcaatgacacttaaaatttaagacccaaacctacatgatctggccccatctgccttttcagactcttcttcctcctcgagccccttaccccatcctagccaccgaagccagtgatgccacatcccagcctctttctgcctctgcaggacagttttgtgtgtgctctgcattttcagcttcaattgctaattgtcctctcttgtcctcacttctttcactcccatctcagggtttctgcatgctggttctcctgcctggaacagccttctacccaccctttgtgacttagttcacttcccagatttcagagggcagctcagctttcccttcctcatggaaacctcccctgacctccctgagtagcccaaactctcctattgtaggcactctcagagcgcttctcatagatgcaattttacgtttgttcgtaattctgttttgttttttcacaacaataaattttgagagggcagctctatgcctagtctccaccctgtgtccccgatgcccagcacagtgcctgaagcacagtaggtattcagttgccttggtgaatgaatgaataaagccaagccaagcacagtactcagatctcaagctcatagtcactgcatagcttgtgctaaccttgcagcaagtgagacactaagcaagtgaacagcttacatttcttagtggtggtgttaaatttacaaggagagcatgtcacctctcacttcaagtttccacacttttaggccattcttagtgttaatagcctgtggaggactctttgaggagagaagaggggaattccaaagattcagcttgataaatccttcatctttgacctcatgtgtattctacttaggaattaaaacgtagagtatggctgctgctacaaatcttctttgcagtttttcctctggctgatttttctactttacctggaatttttatcctgaatttttgtccttttttgaatccatgtggcacacatacattgccctaccaggtttatttgtgtttgagatttgagatgctatctgaggccaagacctccagaattagatgggcctttgttcccagagcctctttgaacagagagaaattctttgctatgttggcaaaagatccttcatatctatctgtctttctttcttgttcagacttctcttttggccacgtgaacgtggatccacctgccccgtcttctggcctatgctgtgatccctggaacatttcaggtttgagtgtcagccacatcttctttaggaccagtcaagggtttgcctccaggaacagtggaatctattgagtgccccccagggagttccccatatgctggtttgtttgtcacttggccacacagttctactttttcctctttgtctgcaactgaacagcctaggaaacttacaagatttctgcttttttttgggggggcgggggggtaaggtatcgtattttgagttcaatctggtcgcaaactggattctgtccagatttttgttgggatttcagatgtttagccccaaacaaattgaaagttaaattgaaactggtccagatgaggtcatgcttaagatttctcccacagcacaaatcgtaccttactggaagctactgtaagggcagttcttgaatctctgcattcccaatacatactcatggtaaaaacagttaacagttaattcgcttgtgttccagtgacttgaaaaataagcattagcaccctggagacctcgtcttatcaagttctgaaggatggtttttatagctagtataaacccttagtttatcagcttcactggcctagaaacccctcagacctgaatatttgggatcagcagaatgggccaagcttaggaattccaagaaggcagactcaagatagagggctgccaaagctcacagatgtggaatgaaaccagtttcaaaacctgattcttcgctcagttggaatgtgttttaaaacctggactcacttgagatgtttgcacctggtaagaatgtttcaaaccttgaattctactttgtgtaattatctgtgaaacgtaatgatgatagctccaagctatctcataaagctgctgaagtcttcaaagcattcattctatcttcctggagttacagaaacacaaaatggtaacaggtgtgtcatatgcatccagagactacctcgaacttttctctctagaactcaagctccagacttgagatattagttaatagattgataaattgactcaggttaagtggtattatttcttagattatatagtgtcatcctacagagtaaccccattttacaggagaaacaaagttggccagaggacgaggctagaacccctttctagactgttaattcaggcagagctctgtatatgttttaatggttagttttctaaagagttttacctagaggccaaataaatcagaagctcaaacgcatatgttctctgtcttctttttagactggcttgcaagaaagcccttgggttactttttgccagaaaagagcatgcagagtgaacttgtgacataatacattccttgaagctcccacgttatagtttcctggtaacatagagttgtttatattattgctacttaaaacttggttgctttgtagatcctacttgggaattgaattaacttcagtgaacttgatagaagctgcatctttctgtaaagttttgggcaggttttgtcactgacattaggtggtgatgattttaaaggactcccattacttatccaacatgtgcacgcatactgtatatatgtcattagaaataattaggagttaattttcaataaggtccatttggtggctacaaattaatccatttaaaacccctgatatttgaccctattaattatatcctgctgttcattggtgcttaacccacagagctaatgagatgcctaagtaccactatttttcattgctctttactgtagggaagtaggtctctctttttctttttaatgtgagtggacataaaatttatcagcaggcatatccacagaaaactgactttattacaagtatccttttagacttgcaagctccctcagctagttaattttgcgtttaagtctatgtgattttcattctaatgtcttttggaattaaatgtaatgttgtaagaaaagaagcgtctgaccaataaagcaaggcagtctaggctgttttatatatatatacgcactttatcctgtctaatgtagtgctcctattttctttttcatattctttctgttagagccaaattcactactctgactttgcataatataaatacagatatccttactcattaagaggctgtgttgttttagaaattagtaagtggctacatctgcataattttgcattggtaagagttggcttctttagcgaacatgattttgtatttttggagaggaaaaccttgggcccatcaggttagccttttctgagatggagactcaagtgggaccacccaggatggtcacagcttcaactcccacacaatgagaacttgtgactatagcctgggagagctgactatgcaggagacaagaaatcagagagttgggtccagaggtagctggcagaaagaagattctattaatattttaacctcagaagagcagcgtctaaatatgtgaaatgagtgctggcctagaggggaagggccatactcttaaccacctcaagctggtcttatcattgttgctgggggggatgtgtaaggctacaaccttcccttttaggtagagggaagagaggactcccttgtgggtgtgcacaaaggagtatgatgagaagagggtggtgatgggtgcttagcttgatgcttacattgtcccagtgcagctccatgattgcaggtaccttgagaggacccatgtgcagtaaggtgggaggttaggaaaagcagagaatgccagccagccatgagtggatttgagaggtctgaaggacaaaggcaatgttgctttgtatgggtgcacaaggggatatgtgcatttaaatccgtcaacagtccagaaattggattgccatttcagttcccaaacaaatggcttgtttattaaactaaaagcccctatctccattaggaaatattcaattccagcaattagccccagggtgaaagaggtctccctctctccagtctgtttttgctctgttcccaaacaatgctttgatgtgcaaggcactcctaatggaagataagtcatcaattagcccgatggaaggttaagctgaaaacagacttttcagggaagggattatcactgagctgttaatcactgattgacattatctattggggatatattcttatgggagacttactctccacccaggcagaaggtaacaaagatgcaaaaatattctagttgtttggtttttttaaaaaatgagttttagtgtcctatagcaccatagaataactgtagttaacaataatatacagtttcaaatagctggaagatgggcactgaatgttccccacacaaagaaatggcaaatgttcaagatgatgaatatgttaattgccctgatctgatcagtatgcattgtatgtacggaaacatcactatgtaccccataaatatgtacaagtaatatataataagtaaattttagaaataagagaaaagaaaaaatgtgagtttagaaataggatcttagatcaattgagtcggggtggagatgataatagttttctttctaaacaagtatcttttactttctttaagaattgttggtcataatatgattacattgctaatttatgaaataaaaagtaaggagaacctctaatttttttttagagtggggagacagtgtctcactctgttgcccaggcaggagtgcagttgtgccatctcagctcactgcaacttcctcctcccgggttcaagcgattctcctgcctcagcctcccgagtagctgggactgcaggtgtctgccaccatgcccagctaatttttgtatttttagtagagacgaggtttcaccatgttagccaggctggtcttgaactcctggcctcaggcaatctgcttgcctcggcctcccaaagtgctaaggattacaagcatgagccaccatgccctaccagaacctctatttttataagagtaagttgatatgaacaatattgtgaatgtaagcacagtgcacatgaggcaaatttgtaattctgtgcttgagttttacaagtgaaataagtttattttttaaactccaagtagtggcagatgagtgttaatttacctacaacttttcaggaaaatatcaattgcatacattaagctattttgctgttattttttttttttgctttgtgccttttgtttttctttttttcttttttttttttttgagatggagttttgctcttgtctcccaggctggagtgcaatggcgcaatcttggctcactgcaacctctgcctcccgggttcaagtgattctgtctcatcctcctgagtagctgggattaaggtgcctgccaccacgcccagctaatttttgtattttttagtagagacaggttttcaccatgttggccaggctggtcctgaactcctgacctcaggtgatccacctgcctcggtctcccaaagtgctgggattacaggcgtgagccaccccgcctggctgccttttgtttttctagtacgctgatgagaccaaaaagaagatataataaaattaattgccaaaaatttagaaaatggaatagggtagttattctactaccctaatataatcaataactattgtactgcctaccactcttttttctcctgtttgctacaggggtgcaatccatttacctagattctgtttcctaattagcctcatagaatgtttcaaaaatcgtgacccatatagcttaatgagtacagagtttctgtctaaggggtgatgaaaaaatcttcaaaatagtggtaatggttacacaacattgtgaatataattaatgccactgcattgtacacttaaaatggttaaaatggcaaaatttaagttatatattgcacgacaataaaagaaagtgtatcaaaattatgcccctgcatttaaaaaaaaatttttttttggtagggggaagtaaaggattgacagatttcagagtctgtggtgctaggagaaaattttagggtggagttattctccatggggctcaaaacccaaaacttttcaatactattgaatattagcaataataagcttgtaattcaaagcagcagggtggtacgttgttaaaacttcagaaaccggtccggcgcggtggctcatgcctgtaatcccagcactttgggaggccgaggcaggtggatcacctgaggtcaggagttcgagaccaaccttaccgacatggagaaaccctgtctctactgaaaatagaaaattagctgggcatggtggcacatacctgtaatcccagctagtcagaaggctgaggcaggagaattgcttgaacccgggaagtggaggttgcggtgagccgagatctcgccattgtactccagcctgggcaacaagagggaatctttgtctccaaaaaaaaaaaaaaaaaaccagaaagaaagaaacatttaaaaaaaaaaaaaagaaaaacttcagaagccttctgaggttcagaggtcatgtttcggaggtcatgtttcagggtgcggtatttggagccctcccggaaacacaaaagcctccctggtgacattcttagcccctaggaagggcagtaatgacagcccacaactgacaagtactgatgaatagttcttgaaggcaaaccctgccctcagggagctctgccatagcttgacatgtcttctagaactacgtgcaaggggtcgcagagcagctaattctgccgcggtatgggcagtcaccaggaaacttcaagggggagcaggtttaacctgaatccttgctgaaaatagatgaatttgcctgggagtgagagaggaaagggcatgcctatgtggaggtaccagcaaggggacagatacaggaaaagggtgccaggccccttaattccaggtttaggagtttcttttaaaaaaaaagttcagtctcaaaaaactaaaaatagaagtaccatatgacctagcaatcccacttctgggtatagatccaaaggaaatgagatcagtatgttggagagagggactggctggaggggagggggattggggagatattggtcaatggatataaaatttcaattatgcagcaggactaaattcaagagctctattgtacaacatggtgactatagttaataatgatgtattatatattgtacttgaaagttgctaagagggtagattttaagtgttctcctcacacatatgtgaggtaacatatagtaattagcttgatttagtcattccacaaagcatatgtatttcaaaatatcaagttgcataccataaatgtatacacttcttttttcttaatcagaataaataaatagtccgagggacatttattgagggcctagttgttgggcagcatcttaggcttcttttggtttctaaatggtgccctagtcagggcttggtgagtttcagatccccagaaaaagtctgttcttagctttgatgggggaaggaagacccagagcaaaccacagtggcactgctgatctagagcaccctttagggtggctgggggtcagattacagactggaccacactcctaactttctttacccctgagacctctggagtcctagatgtggacgtggtgtttatggtgcattcatgtttctgaactcttttttttttttttttttttttttgagatggagtctcactatcatccaacctggagtgcagtggtacgatcttggctcactgcaacctctgcctcccgggttcaagcgattctcctgcctcagcctcctgagtagctgggattacaggcacctgccaccatccctggctaatttttgtatttttagtagagtcagggtttcacaatgttggcaaggctagtctcaaactcccgccctcaaatgatccacctgccccagcctcccaaagtgctgggattacaggcgtgagccaccatgcctggcctatgctcctgaattcttaaatactccaaatgatgcgatccaggcttacaagagaggaaggagagttagatctatgaatctaattaggctaaatgttttaaacagctcttctctcaggatattgtttttgttcatatcccaattctgaaattcattagccttatagaaatttattaagcctgaattacagagtgaaatcaagaagcatttttttttccttttttcttttctttctttcttctttttttttttttttttttttttgagacggagtcttgctctgtcacccaggctggagtacagtggcaagattacggctcactgcagtctcaatggctcaggctccagtgatcctctgacctcagcctcgtgaatagctggggtcacaggcatgcaccaccaaacccgggtatttcttttaattatttgtagagatggggtctcattacgttgcctaggctggtcttgagctcctggcctcaagtaatcctcctgctttggcctcccaaagtgctggaaatataggcataagccactacacctggcctcaagaagtaatttttaaataatatttttcataagaagttgagccatgttactgaaatgatgacatgctgaatggtgcattgcagcattgcatagtgaaattgaggggacttgactaagttgggagctggcaaaccccttgccaccaccacagcctttgcagataaagtctttgccttgctttcccatcccctaacggcaaaatgaattgctaagatgagaaaaaggaattttgcaccatctgcaccaattctgaggttttgcaagtgatcaccaatgtggagagtatggttcagggctacatgtttatttttatttttatttttatttttattttgcatccagcgtgctcagaaaaactaaaggaaaaaaaatggaaggatgaacattttaaaatacaacaaagctgcatcatcctccagtcaacgttttggttccagctgccttctagcattgcacagcttgagatgtttgttgcttgtgttcctgcagcattgaagcccccactcccacacccagcccctgtcatttcctgttttcagatccccaccttctgccctgcatgttggggaggggtccatggccagaacggaatggcagctctctgctattgtaggatccctgctgttgtgctcgaacctgtatataagacaaacagtcattcttgggagtggccagacattatctagagaattccaaccactcagctgaagagaaagtcactcacctggagtatttagagaactccaggcatctttaagcaggtacaggtgggagacacagcccttgaagattaccatccgagatacagctaagagctcaaagtgaattcttagattcagtgagccatgacacatcatgtgttttggaagagcaaaaaggatgtcaagatgtgcttctttatagtgggctttggagagctggacaggccagggcttggctctcaactgtgcccctccttgttttgtgtctttgggcaaattacttaagctctgagcttcaatgtgttcatccacaaaatacggattagccctatttcacagagttgccatgaggatttattgagataatgtatgtaaatgtctacacattgtaggtattcaattaataattgttaccatcatcatccatatcatctatatttcctgtcaaggaaactggcataccagctaagccagcaagcacatgcaaatagttctaggacccatttagagtatatgataaagtagaaaaagaatcttgaagccggtcttccttgttaagtttctagtcgagattgtcccagtttccacctttgtatctacaagaggcaagatagtggttaaaggccctgagacagattttcctccagttcaatcccagctttagcacttatggctggagcccttgggcaagtcacttaaaactctctgaaccttggtttcctgatatgtaaactacagctatcaagagtactgacctcctacgcttgttttgaggaataaatgtaattatgcataaaaatcgcatggtctaatgcccagcatatcataaatgctcaacaaaggttatgagcacctcatcatcaactaaagttgctaatgcctttgaggactctcgggctctttgttccttctccagtttgacagggtacattaccattgccagctctgtgacaggctttgtaacctggcttctgtgtacaacagcatacatgtatgcttctgctccagctgggcagtcgataagcctgcagcctttgctggttgatatgcccttattccacaggtattctttgctgtttctgttttatctacaggtttttatttttgttgttgttgtttgtctttttgtttttgtttttgtttttttcttttttttttttttgagatggaatctcactctgtcaccaggctggagtgcagtggtgcgatctcagctcactgcaacctccacctcccaggttcaagagattctcctgattcagcctcccgggtagctggaactacaggcgtgcaccaccatgcccagctaatttttgtaattttagtagagatggggtttcaccatgttgaccaggatggtctcgatttcttgaccttgtggaccttgtgatctgcccaacttggcctcccaaagtgagccactgcacctggactttttttttttttagacagagttttgctcttgttgcccaggctggagtgtagtggcacaatctcggctcactgcaacttctgcctcccggattcaagcaattctcctgcctcagcctcccaagtagctgggagtatgggattacaggcgcctgccaccacaacaggctaattttttgtatttttagtagagatgggttttcatcatgttggccaggctggtctcgaacttctgacctcaggtgatccacctgcctcggcctcccaaagtgctgggattacagacgtgagccaccatacccggccctgtctacaagttttaaaaagcatgaatatgttggggcaacccacctctgagaaggctcgaaaaatgctataattagcctgtggccagagtagagggcaacagtgaactacctggcattgaagtcctaccatgttcccattgtggggccagctgccttcacattctgtcctcttggaaatcctcataacagcctcagaaggtaggtgtattgatttcctagggcagctataacaaattctcacaaattacgtggttgaaaacaatagcaatttgttctctcacagttcaggagtcctgaagtctgaaattacagatggcagggttggttccttctggaggctttgagggagaatccgttccatgcctttctcctagcttctcgtggttgctagcaatgtgtaacatttcttgacttgtaaatgaatcattccaaattctgcctccagattcacatggagtttcctctgtgtgtatatctgcatgccctctctttcccttataaagacaccagtcactggatttggggcccactctcacccagtatgatctcatcttaacaaattatatccgcaaagatcctatttccaagtgttacattctgaggttccgggtggacatgaattttggggcggggcactatttgactcacttcagtacttattatacccatttaacagatgatgacccagagtctcagggaggagaaaatcccttgcataagcatcacacaatcagtttatgatacccaaggattcacaaaccctgacctgcttttctctagatttgtgtacttcccaccgtatcactttaccacatataaacaaacgtagaacaaagagtctaaaacctatggcagcaaaacggtcaacagcaggcagccctgggatcaaagagggtctctggagggtaaacaggatgaagcagaggctttgcaagcaaatggcgatcccttccttgtttctggttctcagacttcatcctgtttccataatcagtattacttattggctctcaaccatccggctgtgctcctgggattccacagtcgggcagagagattcttcataaatgagagaaggtagtagtcggtttcgtttgcattaagagaaggagcacatttctttgcacaaagtaaaataccctcccacgactccccactgctccccgtatccctgctggcttatgcttatcatgcatcccagtggtgaatggagaaattccatgctttccttctcctgcagaggttccttcctggcattcagagccgtaaaagcagtggacggaaacagctgaccagccctcagctgctcccagagtctggctgcctaaacttttcccagaggatggtccagcagtgctggtccagggtgggcttgggagagcagagctataggcaagagaggtgtgaatccatgtggtccccctggttctgggtaaaggccagggctggggcagaatcacagtcagaaccagggtcaggtcgtcagtgtcaagggcaaatatctttttctttaaaccacaagtgcacctctggtaccatgctcagaatcccttgtagagagtggcatccgtttgctgcatgagatgggagaaaaattagcggccctggctcgagtcttcattgccccttggctgcctgccgtgtcctatttctcatcaggccagtgtccccagtgcctgtcctgatccagaattaccacttaaccctagtggagcaggactctcagactgaccatctggactttcctcgagttctcttttcctgccagagtgtgtcagagtgaattggattagagttctgtttgctgcacagcctggcttcacatgaggctttgtgcttttgaagaaacttgagacaagactattcatgagttcccagagtgggtggcaattcacagtgatgctgatatccacgatcgtgggggtggttctgtgcagggatctctaaaccttttagaaccttccaccagtttccctgcaatcaataggtagctgattccatcagatcaaaccattttcctgttggaaagtggtaggtccttttgttaagtgttcttagaactcaccaatgatttcatcgaaaaagcatctctgatggtttttctttctcctctggcattgtgaacattgtcttggagaagtgaaggtttgccatgtaacacctgcctttgagcagggaagaacatggtgggtaaatctacgagagagacctgttctgttccctggactcagctcccatagagtccaccactgaccttagaccctcaggctccaccggatggataggaattgagtaacagaagggtaggaatcccatacataatcagtatggaatttgggattgcctaagtgcagagttacattctgttccaagccccagcattcactttaaacattaataagagatatggtgctttttgcctatggaagactagattgaacaaacccaaaatattatttttaaaactactcaaaattttaaaatactaaaagaaaaaatgggactcaaatttaatgagcccgtgtgtgcgtgtgtgtgtgcgtgtgtgtgtgtgcgcatgtgtgtgcgtgtgcgtgtgcgcgtgcacgcgcaccttgtaggtaggtgaggagattactagattgactctcctgtacatttaagttaaatggaacaaaaaaaaatgactattgcttagaataatggataagccggcctcctattttttgttctctacttgactgatcagtccttgggaaattcttcaatgggattttcctatgacatattctgtctgtgacatagttcatgaaattctacgacatttgattcccaagggggaatctggttactcacagcgtgtttcacaacttttctgggaacaggcagctcttggaaggaaaatgtctatgtatagcagtgagccaataactcatcttcagtgaaaacggaaggtgatattgtcatacagctgtgtagagtgagagtactcctaaacagataataaattacagccagaaagcaaaacctcctcaagagatggccaagttttggtacacatttgttcactgtggctctatgaaagacctcactttttaatatgtggatggaaaatggagatcagaggtgctgtaaaacctaacaagtagatgagccctggccgtttaaaagtctaaatgtatttaaagcttgaatttgtaactttttaatttatgtatgatactctcaatccttgcttttccaattacaatactaatacatgctcagtcatatgcatctttgtttgtttttgttttgtttttgtttcttgtttgtttgccttttgagacagggtctcattctgttgcccagactggagtgcagtgatgtgatcacagctcactgcagcctcaacctcccaggctcatgtgttcctccggcctcagcctcccaagtagctgggactataggttcatgccaccatgcccggttcattttttaaaattattttttgtagagatggggtcccactatgttgcccaggctggtctcgaactcctgggctcaagttatcttcccacctcagcctccccaagtgctgggattacagacacgagccactgtaccctgccaataatccacatctctatgaaataaaaaccatggactccacttcagcttttcatcacccctttagcactgagtttccccattcctattctccagggttaaccactgtctttgtctaatttctgctgctgaaagagtatacctgagtctgagtaatttataaagaatagagatttggttcttacatttctggaggctgtctcatcccatagaagaaggtcagagggcaaaagagcatacagcctgtgagagacaagagagagccagtcttactttgataatgaatccattcctgggttgaccattcgtgaggtcagagccctcatgaccttatcgcctcttcaaggtcccatctctcaacactgttgtatttgggattaagtttccaacacatgaatttttgggagacacattgaaaccacagcagccacagataagctatatatatatagagagagagagagagagaactatagagagagggcaaactatgtatatagaataaagtgtatatatatagtgtaagatacatatatatatatatgtcgttttgtgtgtgtgtgtgtgtgtgtgtgtgtgtgtgtgtgtatgtagttctacttccaagaatttctactacagccatggaggcacatgtagaaaatgatctatattcaaggatctccaatgccacaatgtttgcaacaataaaagactagaaataacctaaattaatagggaactgatctttttataaaatggaatatatattatatatatatattccatgtatatatacagaaatatacacacacacacacaaattatatccttattttattatttaatttaattttggtttttgagatggagtcttgcctatcacccaggctggagtgcagtagcacaatctcggctcactgcaacctctacctcccaggttcaagtgattctcctgcctctgcctcctaagtagctgggactacaggagcccaccaccacgcccggctaattttttgtatttttagtagagacaggatttcgcaacgttggccaggctggtctcaagctcctgtccttaagtgatctgctcgcctcggcctcccaaagtgctgggattacaggtatcagccactgctcccagccttcttgacttgtagagagtgaatttatctcctccaggtgcctaatcacccatcaggagtgccatatttccttttagtgctttcccacctgtctctctgtattttttaaatgcttacttccttttttcagaagttaatatatgcacatattctaacattggaaaggtgtagaaaagaacacagtgaatagaagcttacctacacctgatgtccagtgactcccttccccattccagagaaaatctctgtgatcggtttcttatgtgtccttccagggatagcttatgaatatgcaaatatagatacacacatacctacatatatacaaataaaaatatgtacatataagattattcatattcatgtttgttaacatcaaaggtaacgtgctctttataaaatgttccatagcatttattagtagattttgaagattgctacatataaattatcatagagctgggagttcttctgttcttttaaagttgtatgatattccatttaatgaaaacatcaggccaggcacagtggttcacgcctgtaatcccagcactttgggaggccgaagtgggcaaatcatgaggtcaagagatcgagaccatcctggccaacatggtaaaaatccgtctctactaaaaatacaaaaattagctgggtgtggtggtgggcgcctgtaggcccagctgctcgggaggctgaagcaggagatttgcttgaacccgggaggcagaggttgcagtgagtcaagatcatgccactgcactccagcctggtgacagagcgagactccatctcaaaaaaaaaaaaaaaaaaagaaaagaaaaagaagataacagttccctattaatttaggttatttctagtcttttattattgcaaagattgcggcattggagatccttgtgtatagatcattttctacgtgtgcttctatggttgtagtataaattcttggaagtataaccactgggtcaaaagcattgtgtattttaaagtggggtccacgttgccaaattgccatccaactttatggagttggatgagggtacctctctcattacatgctgataactaatatataggtggaaaacttgtagtttttgtgtttcttttttataaatgggattgagagtcattctgtatgtctaagaatagtttatatttctttttgtgaaccgtctatccatatcttttgtctagttttatgtttgggttgttgaccttttttatcgattgcaagggtcctttatattttaacaccatcaagccattataataacgtgagttgtgaatattttcctagtttatttctatttgagccaccattggttgaatcattttaccgtatggcaagccctgtggtgagcatgtcatgttttacaactgctccctaagttagcagtggtattatgccattttacagagaagggccccaggtctgtcggatgccaaagttgattcttaacttgaactctacaccccttttgcacatacctatttatatagcatcatttcaggttgtcatgcaattatgataaatatccttttcacaggttgcatagcattctattagttatacaaatcaaaattttcagatgctgatacttagactacacattttcatcacctataggttttcactgttataaataagattgtgatacatttcttctaaaactctgtcctccccaatgcaacaagatggtgccattgctcctgcaggagatgagataccatgcctgaggcagacagcagagtcatcttttgagtctaagatccttgacaagggaactcaacagattcggggtagaaatggggtgcatgtcaggggatggggacattttattggcctgctagacttctcagtgcctttcccttaaatgtcaccagtagcttcacctggttctggaatgaaatacaacacacattagggcttcagaccctcttctctctgaaagcctgccctttgtttttgagacagagtcttgctctgttgcccaggctggagtgcagtggtgcgatctcggctcactgcaacctctgcctcctggattcaagtgattctcctgccctcagcctcccgagtagctgggattacaggcatgtgccactacacccggctaatttttgtatttttgagtagagacaaggtttcaccatgttggccaggctggtcttgaactcctgacctcaggtgatttgcctggcttggcctcccaaagtgccgggattacaggcataagccactgcgcccgggccaaaagcctgctttttgatcagcaatattggagacagttgtaggaaacactgaaagactgcaggatgcagtggggagggcgaaggccgggagttgacaactatttttttttttataaaatagtatttcaaataatatttctaacaggaataaatgagatcatagtgcatgacatagctgaggggtccatatgtttgtatgttcttgtggattcttctcaaccctctgctctgtagctttctatgccctgagcaccagagaagcattaccaggtctgggtgttctttaagcctttctaaagagagttgctgtttctgtttgccttttctcatcattttccccttaataaattaagggctaagtgtgtcttagtttcccacactttactccaatcagggattcctttgggtaaacaaactcctgtcttaaattgtaagtattcccatctgattcacatgtaagggcaaattgttttaaagacctggctccatgctgagatgtagggtcttttggtgacggggcttggaggaggaacctacctgaaaggtaaggagggagaggacaagactgggcatgtgaggaggaagggcggttgtgaggcccaggcttccttctctgtgtgccttgaattgggccttggagcagcttgaaaagctgccccagcttcgctaagcaccaggaagcagggaggggaaccttcctagtgccaccctttcccctgcacctgctactttgcaattccaggcaatgggctggctcttaactgtgtttgaagccagcctctctaccctgaggacctcattccttcctgaccccttcaaacctgtttttggaactttctgtcacactaaggtgactggtgactgtcacaaatgggaaagttacatttagcagaataaaatccttccgttaaagagataaagttctgacaaggggattgtctacaagctgcgcctccttctaggaactcttaaaatccctctcagcaaaagtatcacctggtttccaaggcagctgctgctcctatcctctcacaggctttcttgagactctgcccactcaaaatgagttcacctttgcccaaagttcatgctaaaagcacagaacttacagagattaggagaagtgaattgtgagggtttatgtacctgggatctcattttaccgaccagaaaactaagacctagaagagaaatgaggccttcccaaagctcctagcagctggcctacgctttcaaagtcgtctcttgctgccttacattacagacacttcttaaggttttttcttttttgatcatggctcactgtagccttgacctcccaggctcaagttcctcctgcctcagcctcccaagtagctgtactataggtgcatgccaccgaacctggctacttttcaaattttgtagagacaaggtctcactacgttgcccaggctggtctcaaactcctggacccaagtgatcgattctcccgcttcagcctcccagcactgggattttacaggtgtgagccactggtcctggccttcagatttttttcttttatttgcattagcccaaacgcttcttgggtctgctccttcctgagctgcctggtgcggcttctatgagcactgctgcattttggggattcatggcttctagccagagctctgttcctaaccagcgggatgaccctagggggtaggtggctgccattggctggggtctgcccctctgcagagtgcatgataatccccactttgccattaatgggaggattaaatagaaggtatagaagggtatgtggcacagacaaggcacacagtaggagcaccatagatattggctgcgtgatgatcataatggtatcaattgtctttaaaccccagtggctagactttcataaattgaagtttacttcccagtcaaccaggaccaagtttcaaaatggcttcttttcccccagggcaaggcaccctcagaaactaacgaaatcaggttacggcaaaacagtgcaaatttattttcagaaaacccaccccaagctcagagtctacacttaaagggtgtagaggtgtgagctgcagctagacgttacctgctggattctactctggtcatttctctccagagactccactgtcatcaagtgtgggatggctctgtttatgcttttgcagcctcagcctagcttgctggtttttcatgtctccctctgcctctgagtataatccacttttctggagtacctaactgtgactttgccatagagtatttatctaacctcaaccctatttttgcagcttgggttgaggggagactcaggcaactgtgtgaatgtgtgtgtttttgtgtgcatgcacaaatacaaatgcatgggtgtgtatgtgtgagtatatagattagtttgttagggttgccatgacaaggtatcacacattggtggggggaggcttaaacaacagaaatttatagtcttacagttgggaggctagaagcacaaaatcctcagcagagttggttcctttggagggctgtgagggaaggatctgttccaggcccctctccttggcttataagtagttgtgttccctctatgcacatctctgtgtctacatttcctcttattctaaagaccctagtcatactggattagggcccaccctggtgacctcacttaaatgtgattacctctgtaaagactgatctccaaataaggtcacattctgaggtccttggtgttaggagttcaacataagaacttgtggagatgactcaagtcaacacacaacagtgtgcctgtgtgtgggtggagcatatgtgtgtttgtgtgtgtagtggactctggcgtctctgagacaccaggtcatttgcaaacctactccttggaaaatagtactttaagagcacatacagttgtctcttgtgaatagggcagatttaaaacctttttctaaaacaaatcttcccatgggtgtggaggggcaggtgtggtaatggagtgggtcccgggtgcccctcttgcatcgctggtcgagggcacttcataatggaaagtccttccctggttcttcattctcaagcagagcaatgccattggcatgtgatttctgcctcattttacttcagatgactaagtagcatcttgaagtgcctttggctacacaacagaacattccaattattccacagggcagcataaattcggagttcccttggagctccctggtgacttgataccaccaagtcagtcattgaggaactccccaatatttctaaataaatttggaaaatgtttttagcatatggaaaatgttgtttagatgctgtaaatagttgtaaagtctacttttagcctccttttcaaaagagccttcctgggctccatctactctgattatcccttccttgactcgtgtgcttgggagggtcccaggaggactgctatgctggctggtgtgcagaccacaggtgaaccctgttgcatctttcagctgctcaccaggacaaactgctctaaaactgaccccaaatgagctggccccacagaaccatgtgtagcgtttgtcatctttcccccagtttactgtaaatctcagttctctttgacctctaaaatcttactgaaaaagtgagtacttcatggtactgaactgacctggaattctgactgactttctagttctgcccgtaagttatgccctaaattttccaggtcaatgtagagttccagggaacgaggtggacggaatctggaggcagagttgagccagtgggtgttatcaggcagggggcactgataaacacgccaactccctgttagacttagtgtagtgctgggggccctattctgaggtgacactgatgtctctactcaaggcaaatgcacatctgttttcttgatggcagaggactgttgttagccatgggatggtgcagccacttcctccagatattccttgaaattagagcactcatctcagacttcagatgcatctgtccactttggcatggactataatgtagccacttaaaacatatcttacaagggccattaaataacataaaaagtgcttgtgaaatgatatgagtaaaaaaaaagttggcacagaattgcatttactgtctggtctcaatgatattaaatatgtatttctgagaagatgacaatggaatgaaataaaatattaactttttttctgattggaggggtaatgaatattttttattttctaaatgttctgtggtgagcatttgttatcacacacagacacacgcacacatgcacataccacatgcatgtacacacgcacaagcacacaccacaggctgtcctgaaaagtctgtctaactggagatttctccagggtctttcagattttttgctgcctcaatacccctgggatatcaattccctgcttgtcccagggcccacctctgaattgccgagaagacagtggtagctgattcacatcaatgctaactgattcacctcaacgccgccagctcctgcctccctgctcagccttgagcgtgacaggagcaggccgggcctgctctggctgggaatgccgctgccctccagctccggccagccagggaggggccaggcctctccgaaggaggttaaagtccttctttgtgtgaatggccttttagggagcagagggagggcccacggtgacatcacagtcttccgtcaggaggctcaggaggaatttgtccagcttgagccagggtgcacgcaggaatctgtctggaaaaaggcagttctcactgaggaggtttgaggcgcgcgctctgggcagggtaagccaagtctgctgacttatcttcgtgtccttttctttctaatttgaaaggacaggggtctttttttgaggccagtgtctttatggaggaggttttctgagtgtgtcatgtgctgtggagtcctttcttgctggagagtaggcagccgagctcagactggtgtcttgcttctctctctcttttttttttttttgcaaatcttgtaaaactctcagcttttgtgctaagaggcaaagaggacgctcagtcctgcacatatagtgcaaagctatatgagtcgtctgtggcagatcacgctttgaagatggtgcaagtgtgtctgtgagaatctgtgtgcccttttccagaacaaaaccaagtgactcggtgattctgtcgcctcgtttcttagccatctagcatttgttcaagagactcagtcttgtggtctacagctagccttctgtttccatgctgtggaactcaccacattcacagggtggcctgggggaatatggttttggggggaatgtgtggtgcttgtctcttggaggtcccatgggtatggaaggagaccctcgccagctttgttcataggcacagaatcatctgtagacagagggttaaccacaaatgcatctggcactgttttctcttttcttggggctctgcctcaatatagtggattctgctggtccacagtggtgtttggcttttgatctctgccatgacctgctcaccaggcgtgaacccaagatctggaactatttttaaaccaagagggacacagcaaatttataaagaactgaaaaactaggcttgcttttgtctttagcagaatcggttaccctagaaatctcaccttgcaggagccagagttccctctgtggccttgagcttggtttattctggggtagggactaccttgcaaaataatctccagtgaaaagggcctttggtgagaagagcctccgagggctccttgatagggcgctcagtatccctcattgaggaaaacatgaaactcacatctctccttattcacgggaaacccggaagcctctcagtcactcctgtaagaagtgggtctccaagtaacggaaagaaacaaccctttcatcagctgctgcagaaaaggcaacagcagcttccttcctttcctcccctccccgctgctgacccccaccacacacactgtcttcagtttctttcacagaaagcccaagctgtaaatatattcatcaaataacaccttaacattttccagatgtgattggagccactgacttttcagcagggctaagaggaggattgttcataggctaagctatggtgctgggggagactccgttctatgagaaattgaccagtctccttcactaggaatgtgggtcaagacacagggaagccttgtttccagtgaaggggtggggagttccagaagtattttcatcccgtcttcagacctgtacctgaggcataagacagagagaatagcagaacagtgattactcttttgaccaataccgtagaagctctcagaaaaaaaggctggacctgcaggagcaggaacaggactcctggcctccaaagggttgagttttctttttagaactgccctagtcacattgagctgtaatggcttcatggcaggagatccatggaggcaaaccaagaagtgtttttagtatctgccccttttaaggcccacagcattgacccgagcctgccgggtccaaatttagcctgcgtttgccccaggagtgcttgaggtctggagtctggccggctgtcttccatcagccaggaggggaggctctagcctctttagggagtggcttagttcccagtttcccacaatcaacacgggcccctagttccacaggccggaagaagctctgctcgggggatggaagaggaaagcctgcacaggactggaatgtggcccaggttatcacccggggcctctcctctcctccacttcccgcttataggctcggcttagaggcccaagtctaaccctcgcagcaagcagttcccagactttcctgctgtcagtgccttcaggggagggtggaacggcccactcggagtcccagctccttctccttcctgtcgtcgttagcagggagggccagaggaggtgcagccagcctgcttagaaactttggtgcaccgcgctttcttcaattctttttgcccggcacagtttgcgccgttgaagagggctggaagtttatttccagctattgctgcagcacttccttctcctagtgctgttcgttcttcttatgggaactggtactcactccctccaagtctgtgagcgtcttgctggggatggcggatcaccttggagctctgaggacctcgcacggcccaggctgagagcatatagctctgcagggtcccaggatatgcttatggatccaaggtagtgttgacctgttcaacttctgttcccttccttatgcttcgggttccctcggtttggggagttagcctcccccagacctcctgactgcagctttgcctggtttgtccaaagctgatgaggttcagctgatgtgggcatcttttaggtttctgggcatcatccaccagccaggtgcacttccttccatcccaccctcaccccttctgcatttgccttcatgctggagacatcctgacttagccagaaagttaaaaatttaggaagaacctctctaaagatagccacacatagctcgtggaaccagttcttcatcatgattgtcattgcgtcctgcgcactgaaaacgtgacttacaaaagagaggcaggatgagaagggaaaacggagatactctctgatttcacagctatgaggaagttttgttttatagccatgcctctgttcctaggccaagagtgagtttatatttttggtggaacttataaataactggattaaaggatcgggtcacctattatctggagaaaagcatttctaatttaaatgtcatggctttagtaggaagtaatctgggttattcaaagcagagaaacctggttgtacagcctgatgtttgagtaatttggttcacactgtgcatttaggctaggagcctaggaggtcgagatgggttaggcacactgtcgagctttaacagcctgaggatggtggggcagaggggaggctgtgaacacagtgaacattgtccttgtggtgaaggacacctttctgctctccgcctgggctcaggcagacctgctaaggaaaatgcacttccttaaagttatttctgtccatgacatgcctagctgtaggcctaggtaccctgggcagaaagaacacatgggtgtctatgcccagtggggcagggatcagggccctgctgttgtgttttctgtgcaaatgtaaacaggcttctagaatctcacttgtggtgttggtgaagagttgcagccttttcccacagtgtccatcataatgacatggacatgggatcttaatattttacctctggcaagtggccagaggaaacagaaccccttcagagaccagcccagagggtgaaatccccagaccgtgcaagaagtcacatttctagctgacacgtagagcaacagatacgtctccagagagttaactctccagggagttcatctatttctgaccaagactgaataaagaaggtaaagggatcatcgacttttaaagctaaattgtgagtctcacatcatctgtagagattcaagcaagcaaaagatcaaccaaaaagccaagctaactctgttttgatccatccactcttcttaccatttcccatgtcattttaaaagcctcctaatattgagactccattttgatgtatcaggatagaatgagaagaacccaccttcaaatcctggctagggcacttactaggcaggtgatcttgggaaacgtccctctatttctctatacctcttattctgaagttttaagactgaaataaaattcatgcctttcccacttaacagagggccatttttcaagcatcagctgacatatgtatgtgcatgtactgtgaaatgataagctattagacatgtgtcaaccagaaaatggggatgccacacttacagcatgcccacaggacaggcttgtcagggctgtctcattcacttgtacatttacttggctagttgagttgtggagatggaccaggttctgttttaaccaatgtgtgacccctcctctgcttcccatgtgactggagccccaggtctgggtggttcttgactgctcattctacttactgcatttcaggacttaacttttaaggacattttgtgaaattactccctctgttgcagcacaactgtatcttcctagtcgtgttcagcttcaactaaaattcacatgtaaggatctggggttggggaaagattagggagattagagctgccatagattctgactttgagtctttcccgggccttttttctttcatcttttcttcttgatttcttttcttctaaaaatctcctgctcttttcccaaaagaaaatcagtctgctgccagaaagaatataatacctgtcatttaaacctcagtgtaaaatggcttaataatagtgaacatttgcattaaccgttttacagtttacatagtacttttaagtacattttctaacttaattctcaaaacagatttgggagatattattagtcctgcttatgaaggagttctgttctcagcagaattccataattacaaaaagtctggtaggacttttataggtagagccaagaaatgaccccagactctggtctttggacgctaaactctgaattaccacatttcctgcattctttaggtggagacataggcacctgtgttgtaaattaagccacgctaatttgctttgcaaaactattaaacactttttggtaaataaaggcgactttagttgcagcctggctaccaggttatgttaaacacaggtctctgggaccaaattctggcactcatacagacttgagttgaataaacatttataaaaaatgctatgaggaaatctcagctccctaaatttctagatgctccaaccccaccttgcctgaagacagatgtggcaactttatgaagacaggattctgttaccattttagtgggtggtaagcaaccgaagtcccctgagccaaaggctagaaacaagatcgtttagttttcaaacctcaaacaccatccctaagggtgtataaaccaaagggttcgctctattggcatatcccctttatgaaagggtgaggaagatctctaatccacaaatttgaacaccaccaatttcacggatttctaacattcattatgctaattgacaggccactaatttcactaatgaaaacctatttctcaccttaattatgccaattagcaaagcttcaggggttcttgggagttaaagggagctaagtactggaggaagccacctgtggggcgtgggatctctcattggatcctagatgaccatcccttgagtttatattcccatttaggatggttgtcagaccctggaatgtaatttaaactaattccagaagcacacagctgtattaaattgccccgatcaagtatgtgaaagtaaatggtaggcatcctaaccagctgttaactattctagaatttagtgggaagggcaggtttctgtgtcgtggtattagggctctacctggagggtgaactgggccgatctaaaaagctcccacagcccctttgcaccttagtttttctctgaccttagaaaacccagtttgatgattctttcatatcctcctgtttttgcattggggcatagttcatttcaaaaaggactttcctggtgattgaatgaatgtgcatcttatctgaatctggaatcacgttcgcctaatttgaagcatggagaaaattctggaccttcttatcttcaaagagagcaataagcatttgttggtttaaacaagacatcatctgatgataccaagcccagattcctgcctaatccggataggttagatttccagcccatttccatttacctggtgtagttgccagtggctttgattctatcaggccatcatgcatgaaggcaaattcttactgctgacagtggaactcaggaattcgctcttttgttatcattgttgtctaactttacaaaacctcaggacctctggtgcatgattgtgaatcagtaattcagagttgtttatctctttaaatacttccatgccaattagaggttaaacctgctgcttcctgagtagatggaattgagtgtcatgaagaattttctgaatttatggggaaagggggactggatgccatatagctcacaagaaggagggcctctttcctgtttacaccctccagtgtctagaggtttaaaaaaatgtatcggaaaggaatcatcccaaattacactggaacccccaaactttgacttttaacaagtaactagcgtgtgtgtgtgtgtgtgtgtgtgtgtgtgtgtgtgtgtgatggagtttcactcttattgaccaggctggagtgccgtggcatgatctcggctcactgcaacttcctcctcccaggttcaagcaattctcctgcctcggcctctcaagcagctgggattacagaggcacctgccaccacgcctggctaattttttgtattttcagtagagatggggtttcaccatgttggccaggctggtgtcgaactcctgacctcacctcaggtgatctgcctgccttagcctcccaaagtgctgggattacaggggtgagccaccgtgcgggcttcttttttttttttctttttgataccaagcctcacttcctcacccaggctggaatgctccaacttctgctctccgggttcaagagattctcttgccaaatagctaggattacaggtgtacaccaccatgcctggccaacttttgtatttttagtggagacagggtttcaccatgttggtcaggctggtctcaaactcctgacctcaagtgatccacccacattggcctcccaaaatgttgggattacaggcgtgagccaccacacccagccttttttgagacagtctcacttcctcacccagactggaatgcagtggcactatcttggctcacagcaacctccgctctccaggttgaagcgattctcatgccaagtagctgggattacaggtgtacaccaaccaccatgcctggctaacttttgtatgtttagtggagaggaggtttcaccatgttgatcaggctgttctcaaactcctgacctcaagtgatccacccaccttggcctctcaaagtgctgggattacaggcatgagctattattgcaccctgccaactaactagcatattttaaaatctcagtttgaccgatcacagaagacataactacttgtaaaataatttctgattcaaagataatggcagttttgtattttttttcaaacaattgcaaaagtatattgtcaaattgttgtcttagattttaaatatttggtaccaaaacaactatttctagttcaaaaagggtgccttggaaagagctgatacaatttttgaatcctaaaaagaaaacgtggaaagtcatctgctcattcatcatcgagcacttgaagtgtgaaacattcaacagaaagggataatgctgatgtgaggagcggaaaagtgttcttgggaaatggctttggagataagccccatcactccttcctctgtgattagcaacaagagacaaagagaagcaatttcttcacttgcctgattcagactaagaaaactctaatatagacttagggctttcttggaagtacagagaactcattttttttttaaagggtgttgtcttctggagcttattgttgctgctaatttcattatgaccctgcagaataacctcccctcatgtttaatgaacggattaattaattaaactatagaactaattatttgccttttagtttcctttactattacgttgcccttcttcctctcctcaggtattctaaagcatcttgtgtttcaggagagcagtgttttctaaccatatttcagtcctaccagcttcctactgatttcccactaccctccgcccaccccggcccccaagccaaaaaggatagaaggagagctctgttgttcccatgcagaatattagcagtgagtcattggccaaaagaagccaggggtgagggtgccataggtaatctgactcatcttagcagtaccgtgaatctctctttgtttgtcttcttatttcaataataattttccatggagtgggctaattttggcctaggtttacttgaaattgaatggcagccagtaagtttcagcattcaaattttgtgtaatgcttaatgatatatgagtagaagttactgacaatgtctcatccaacaaaaagtttagttaatagttttaaaagggctggccatgcagggtggctcatgcctgtaatcccagcactctgggaggccaaggctggactgcttgagtccaggagtttgagaccagcctgggcaacatagcgagactctatctctacaaaaaattttaaaaattagccaggcatggtaatgcccacctgtagtcctaagggagactgaggcaggaggatcccatgagctcaggagttcaaggttgcagtgagctatgatcacatcactgtgctccagcctgggcaacagagcaagagcctgtctcttaaaaaaaaaaaggaaggtggtggcaaaaactactatttaatgatggtcaaaaataaaaaataaagatattagcaattataaatattaattgtgttaagtatcactccttaacaaagaccagacctagactggaagaaaatcagagaatggaagatgttgacaaaagaggaacactcattatttgtgcctgttaatggagaagacatatacattacttgaataatttaagtctgaaaggaaatgtggaaagtgaagagtgaaggaaaccccccagttcatggataactcagagagtttttcaacattctgacagcagtgtagagcacttacgatgaactccagtgttttcttaggtctcaagaacaaatccataattatccacttttttgggaaggattttgaaattaatttcctgagaatcgtcctaaggtggtgttttaatattctaagcatttaaaattgttgaaaccttagataaatgaaaattacactctcttgcaattttgcattgtcctatgtcaataataccaggcacattataaacttgagacagggaaacaaagccaacctaggtgttgtaaggtccttgatggtaactcaaattaagtttatactttactggaattctttgagataagccagagtcctttgatatgaaaaagaaaatcatcttataatttgaaaattaatgtttctaatgccaaataacaaaattacataggctagataactggtagaaaaataagatggatgggttgggtgtggtggctcatgtctgtaatcccagcacttcgggaggctgaggcgggcagattacttgagtacaggagttcaagaccagcctgggagacatggaggaactctgtctctacaaaaaaaaaaaaatatataaatatatatatatatataaatcagccaggggtgatggcacacaccggtagtcccaggaggtagaggttgcaatgagccgagatggcacactgcactccagcctgggccacagagcaaaatcccatctcaaaaaaaaaaaaaaaaaaaaaaaaagccctcaagacaaaaaacctccttccttaaaaaaaaaaaaaaaagaaaaatatgatgggttttaaaacattaagaagatagggttttcttattgaatcacaaactgaagatatcacatataaagcagttaaaaaactggaggagaggtaccattggccattagtttttcaaagcagtgctgacttcttaactaaagagtattattttgatgcaatcccagaaaacagagctgtgcagtcagtggctttggtgatggtgttcataaggcacatggtcaattacagccatggcagtgaggcactgtagcctgtgtgctgccattaaagggatctactgttttccagtattttattctgcaaagattttccaaaaagtttcttgtctccagaataactgcattacatctggcagagagtcatatgttttaaagatctgttcatacaaaaggaccttctttttgcaatcctattaatagtcgtattgcacagcctgcaatcatttgccgcaaaatacttgggaagactctggtacaataatgatgtaatctcttccaccttagtagataaaatttaaaaatggcactagcatgtaaacaaaatggaatccataaattagagaggattgggcacctgttactacaagaaaatgaacatttaagggattattagaaaatatctattcaaaagaatttgtcactgtggtttccattttccttcctcttaattatgagtcagtttgtcagcattcacatccataagagatgcagtatttaaccctgacttttgtttactctttattccagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccaggtaagtgaggtgcctcacatgagagacagatgccacagcagtctgttgttgttgattccagctcatgggtttctatgtggagcctcctctgtgtgtgtctggaataagtgttggggggacactggcatgagaattccagcatacagggacatgcaacaaaagtgtcaagagtgtcctctagaagaaccctgagcttgcatggagtttgccactttccagaggatgcaatagctccttctttgttgttctgctttggccttggtttattataaagaattgttctcttttacttgaaagcctgcctcttgtctgaaggagaggctgtttgtggcatagaaccagagtggacccatgtgtggactatgttggaatcagtagcttgaccctcagtatctagttaaacccatctgatttgggagttgtcctctactaactaaccccttctgaatgctggtttccttcccagcaatgatagtcatggcatggcattgcagactggtccatgcaaaatgcttttgttcatcttccgtgtaactgggtttttcttcttaagtcaccacaaagcaactactttggaatcaggagtggacgcatctgttcttgtcatgtgacccatttggaaaagttgaattactcttcacaaaggcaggtctttaatcccttcatattgcctgggtggtcccttttttgaatactttgtatagatggttgatgttaattagagtgctaattattattgctaccatatggataacagtgtgaccagttgtttttattttccatgtgaatgtgatagcaatcagggatccacagatcttcagctatggaaaacgctgctcaaagcgtggtccaagctagtccaggaatcatttgctactggttcattctaagttcagacatcgagagtaagcatttgaaaactcctattgcaatgtgatattgtcctgaaatccaagcgtgggatttttgtattttacaaaactattgcttcataatggactggtggggaaaaactgatgcttcaccagagaaaatttaagaatcgttaccctaaaggataattgttgacacttatcttggtccatccatatcttaatcttatcttgacacttggcttccatcaaacctacaatgactcaaggtcactcttctcattaactttttaaaattggaaagaatctccaacctaaagaaaagttcccaagtacagtacaaatgtctttctgttttgaatcatttgagagtaaattgccaacatgatgccccatcacccccaattttgtagactgctccctaatgtgggtctctgatgttttcatatgatgattttcaggttgtgcatctttggtaggaataccaccaaattgatgctgtgttctcactgtatccaaacaggtagcacgtggtattagtttgtcccattatggtgacaggtgtcaactctgatcacttaatattgattatgatcactccattgagggagtgtctgccagccttctgcacagtagttacttttttcttttgtaattaatatacattttgtagggcaatactgtggtattctgcaattttcaccccatttcttatcaaacttcatttatttatgtcggtatgatctcatggattcctgtgatattcaatggattcctgtgatattcaatggattataatccatttcttttattatttttatccgcaacttgttcagttacagctcacgggagccctttctggctaacttgtatgtcctttggagatgtccccgttttcctttgaatgcttcctcaatttctggcatcgcaagatattccagtttcatcttatactttcccaaccctgaaatcggtcgtctctctgaagagcactagtttctgatgatggagaatggtatttagaaacaaagatctgagtgctagctgtgctcattgttattgcattgtcactagccccaggcactctcagtggacagaattagaaattacacacatctctcttgaaaaccatgagtttgccctgatgctttttaattcttatttaataaaaagttcattcatactttctccctttccatatttgtgaccaccttcttgacaaaagatacttagtttttattatctgtaatatgtttattatttaactagccctccttcccccacactccagtataaccagtctcctgttttcctcaccaaacttgggctccgacatcattttccaggtggccactgccacgacccttcaccaacaccctccttaccctccctgggctccaacactacagcaggtaccatcttattcagcctggcctagtgacttttggactgagttgtttgggaaggaaaggaaagggaggaagaagaggaagagtgcagtgactttcttaatatatgccatcaaattggtgataaagtttcaacaaatgaataatgggggggcgggcacaaacattcagaccgtagcatgagtattttcaggcttctctgtctctatctcttaatcgaacccctcaccatattacctccaactttatttctagcacataaacaactgtctaatataaagacatttcaatgctttctcctgattcccccaccggctgttgtccatcaggcttccccaccaggaccgaggttgccttaaacaagtcagcatcctaaggcttgccactggcatcccagcaacccagtatcaatctccccagtacttccctctatgctaatgctgatctcttctcccatatcccacccccataggattgatttctggtccctacaaggggatggtaattcatccgtgcaagtctgttccaatcttgatgtcgtattgagtacaatcatgataatgatatgcatacatgtcattccttcatgtttatctctagaacatttaaagcaggcacccgggcttcccagaattacaacatgagttgaaagaaacggaatgtaaaatacaattttcttcctgttcatgcctggaaatctttggagtattgcttggctggccaacctccaagttcatgatcggggagaaggctgacacgtgactctgagcagccaaactagacaattcatggctagggtcagaactcctggcttcagtggttttgtgaatggaggtgttaccaagttcctgcggcacatttcatatttcatgccagaagaagtgactccactagtttgttgtgtgactcagattgatgattggatactaggtgatgaaaaatataatttttaacttctctggtagaaatcatgctggtggcatgctggaatcctaaaaccttaaagcaaataaaatccactgagagccaagatgtggtaaggaaggagaaatcttctaattctttccatacaaaagttatctagacagaaaccccatccccctggtgtggaaatgctatttgtttttgcttttagtgcttttgcttttaaaagatggacaatgaatgatagaagttctgttttgaaaaggatatagtcattgttaatgaccgggtatctagaaattatcttgttggttcttattttactttttttttttttttttttttgaggcagagtcttgctctgtctcccaggctggagtgcaatggggcaaactcggctcactgcaacctccacctcccaggttcaagtgattctcctgcctcagcctcctgaatagctgggattacaggtgtccatcaccatgcccagctaaattttttgtttgtttgttttttgtatttttagtagagacagagtttcatcatgttggccaggctggtctccaactcctgatccgcctcaggtgatccgcccgccttggcctcccaaagtgctaggattacaggcatgagccactgcacctggcccttatttgacttttaaaggaagaagctccacttaaatagaatttgagtgacatttgtttatacagaggtgaataaaaatgtatagtccctgctctcagggaacttaatggttcagtaagagaaacaacattaaacaaatgaggcaattttatgacagagaagcacagagacctgtaggagcacaaacaaggaagaccatatcatttggaggataaagaaagtcttccttccttaggaaattactgtctaagctgagaactgaaggggtaaagttgggctcagggtgtaggggagaaggaagggcacctaagagaggctcaaaaggaatagagaacttggcacatttgagatatttaagagtaagttaatggaagagatttaaaacaaaacagaaatagatttggagccagacaaccaagagctctatcaatcatgttaagggttgtagactttagagtttaccctatggtcagtgagaagccagtgagagtttttaaaggagtaattatctgaacacaaccccaagctgtcctgccttcactgtgagttgatggactaaatgtcttcctattgtaatgcatccatttcataggcttggattgagctcttcctgcttatgagcacttccgaaggcaggcgccatcttggtgaacaccctgtatgttatgtgaggggccatgctcccaatagtgtgtgcatgtgtgccctctgctgatggcacttagaattagagactaaaaggaagaaggccaggggtggtggtgcatgcctgtaatcccagcacttttggaggtggaggcaagaggattgcttaagtttgagacaagcctgggcaacatagcaagtccccatctcttaaaaaaaaaaaaaaaaagaaaaattacctgagtgtggtgacacatgcctgttgtcccagctacttgggaagctgaggcaagaagtttgcttgagcccaggtgttcaaggctgcagtgagctgtgatcgaaccattgtactccaggctgggcagcaaagtgccaaaaaaaaaaaaaaaaaaaaaggagagagagagaataaaggaagcacctttgcaggtacatgagcctgatttgaaggggtaactcacacagtgctgtaaaacacccttgaggaaagaattagggggtgggatatccaaacattgtattgaagttgcagttcaagaccttttcaaatgtcttttcatattggggttgccaacagttctcactttagtatctgtgtctattattagatatcctggtttcacttccaagttctaagtatgccagagaaacccagttaggtgatgatttgtttggttttttgagagtttctgttttcatgccagatgttgaatttatttaccaagtcagatcattcaccccgtgagacctacattatggagagtggcaaaagagaaggtgtagtttgctattaagttccataacttggggtatctgttcatgtcttctaatttgtggaaagatgtgatagttataaatgttacttttgtaagctgtacaggaagtgttgacttctgctgctgtctgtttagataagattagacatgaggtgatcattacattattataaagattcttaactgggtctctgttctttccccttcattatctgcaaatatcacaaaggaaagtcttaggaaaaatatgtttgcgactgtccacacattcttcatgaagcagagcttggtggagtgtgccatgctaaattagagccacatgaggcacagtttcatttgaggtgccctcattgctccatgggggaagtccctgtgtcagcatctgacagaaggattgatgatgagagagctctccatcagtagtacacagtgcctctctttcctgcaaggcaggcaccaactgtgcagcttgtaggagcccttctggctgtgtgaagctagctaaagcttattgtggagtgtccacagatggttattgtccaccaccatatttctagaacattctctggttacaaaagtctaatcatggtagttacaatttatcaaggccttaaagctgcatataatactagttatttcacacttgtcatttcttattttctcactgaatcctcccaacagccctctaagatacaaattacctcaactcttgaggccggatatatttctagattcagactttttctgattttagagaatttataaagtatatactattatttagaaaagtaatacaatgaacatactattatttaacacaactggcaggttctgggtcaacaccctgtgatcaaattaaatttctactctaaaacttgagaagaagaattagttacattaagtgggtaaagactaggagaccttcatgtcagctcatgtcaggttttgctgccaaataagttatgaaaaatctttcttttcagagttttttggatttgggaattatatatgaagagttgtggacctgtaataatattctttttcaaagaattactactagagcccagagagattaagttgcccaaggtcactcagcttgaaaatgggagagcctggtttcaaactcaggctctcatttgtctccaaaatccatcttctttcccctaccttctccttcccatttgttgagcctgctctatgaggtatacagtaatagcttctctctccaacctgtagctcaggttccctctaccctttcccaatcttatgcccaacccctgcattttcctgggtccttcttgatcctccttttaggagccactgtggctctgcaatccttcttttgcggtggcctgggtgtataaatttgactctcaggggccatgaaacagtgcttccctagtgacccaggatgattcctttctgctttcagaactcaattccaatgccccaaattacagtaggcaaaagcactcgggctgtccaaagatctgagcggatagccaagggactaacttagtccacatcagccatctagcctagctgctcttgtgagttctttttgaaagttatttcccaggaagaagctctgccatttactccagaaacaggttcattccttgaaaacttcgaaagaactgggtactcaagcaaggaagaaatttttaaatttgaggatgagcagggataagtgttcattattctgttaactaaacatgaacatttttggtgtactagggtcaaagtcaactaagttagttgactggtgatcattgagcaccatgactacgtactgttctccttgccttttaaaaattgatctttctgccttggcccagacttccctgtgttctctttatctaaatccagcaagtatgttttcttgaaaaatgcatgccatttggaaaggaattggtaagaaaagactatgttgaagctatgtttggcaaggggtgaaggtgtgcaatgaaatcaggacttttcaaagtatagaattccacattctctttagatattacccttaaaggcttggaaaagacaactgccatggttaaacctgcctgtcagcctcactcttctttttttttttttttttttttttttgagatggagtctcgttctgtcgcccagtctggagtgcagtggcgctatctcggctcactgcaagctctgcctcccaggttcacgccattctcctgcctcagcctcccgagtagctgggactacaggtgcccaccaccgcgtccagctaattttttgtatttttagtagagatggggtttcaccgtgttagccaggatggtctcaatctcctgaccttgttatccacctgcctcggcctcccaaagtgctgggatttgggattacaggcgtgagccaccgcgtgcagcccagcctcactcttgagatcctatgggcccagaagtctttattctgtgacaagcctgcagttacagcttctgggcagcagaactttggaaaaagcagaacgttccccaccagctgaattccctggtacaagcaggttctgctgttcctgctgattgtgctgggtcttcagatagatccgtgtgtctgggttggctcctgctggtgctgggccaccatgtgatgtcctcattgcctacttctgcatggcctctccatgctgcaagttagttaggggagcatcttatgaggaatcagactcagccatgcacaaaaacagatgcatagttttcaggtgacagagaggaggtgaatcaaagaacctaattcttgcaagttccttggtaagaaataggaactaatcaaaaccaggcttgggagcaggatgtcctctgtgactgctggggttcagggcagaatatgactgtgtcttttaccagccatagttacttgctgtgtacttccctaaggagactggcatttcagatctatttgatctttgtgtgctacatacttatggggtggaaggctaggaggtgaggtggggcagggagagagtgtatggggcagacaattagagcaccaaagaatatatgtgtagttcttgtaacgagattttctttctcatggccttgaaggtaaacttaaaagggttcccaaaatgtgtgtgtatctaactcacaagtattaccagtctctcttttatttcccattactcaagtataaatctatgtgcgaggtggctcatgcctgtaatcccagcactttgggaggctgaggtcagcagatcacttgaggtcaggagttcgagaccagcctggtcaacacagtgaaaccccatgtctaccaaaaatataaaaatgagccaggcgtggtgtcacatgcctgtaatcccagctactcgggaggctgaggcaggagaatcgcctgaacctgggaggcggaggttgtagtgagctacaatccctactgcactccaacctgggcaacaaagcaagactctgtctcaaaaaaaaaaaaaaaaaaattatgtgtgatggtcagggagaatatatgctaaaatatgacagtcacttctctggattcatatctcaagcttcattcctgactaccacttgctagctttgtgaccaacttacttcacctctgtaaacctcagtaaaataggaataaagttataccaacctcataaaaatgttgagacagggcctggtacataaaaagctcccagtaagagttattattgttgttgtcattacaacattacaacattacagttgctcttttgttttaagaaaaagcttagaggctgatcgcttgagaccagaagttcaagaccaacctgggcaatatagtgagaccctgtttctacggggggaaaaaatagctgaatttagtggtgtgtacctttagtcctagctactcaggaggcgaggtgggaggattgcttgagcttgagttcaacgctgctgtgagctatggtcatgccgctgaactccagtctgagtgacaaagcaagaccctgtctctaaaaagaaagaaaaggccagaaagccttagtagaattatttgtgagttgctcttttgcagcagttgtgagcctgaaataaataaccgaacacacatgataaaattgctttctattcctagctgggatttttttcagttacttccttagaattaacatttctcttagaaacttgaggtcaggaataatgagttttcagtagtccactatgattcgaaaaactaaagagtaaaaagtccatcattaaatgtactgagtgaataaaattacatgtattaccataaaaatgttttccttctggggggaggtaatcttcacacagccaagcccaccatgctagtagaaatgtatttgaagagaggatcttggtggagaattactattcaccataattttcattcttactgttttaattaacttttttcctttttggccttaaactctgcttgccctgtaagagcagagttctttctttccttctagagttttcatcatcttccagttgtgttcataggtataaacccaatatcagcaactcatccaacaacttgacttacctttaagcaataatatttgacagtttctcagacttgtttgccaagcagtggtatttctcatttctgagctaagtttataatctgaagattcatatcatcacattctcccacccctggggccttcaaaggaggagatgaaagaagaagggaccagctcttggtgtgcgggtcacagctggaaccgcacaagtccgtgcactctggggctgacaagcaggatgttcccttgtactgagaggaaacgaaattgaaaatgcaagtctgagctcatttctttctggtgacttgtgggtcgcttcagatgtttgcaaccttatcccaatgctgtgtgaagaaaggaggtcattgaaggaggccctggcttaggcatgtcctctggtgagtgattttgttcggttcagtttggtttttaaatacgagtgggtgaaggctttttcttttattttgagaaatgtggaaacaaaggctctttgatttaagacctcagacttcatgcatagagagagtaataatcacccaaatcataatatctgaccaaaattttcaggacttttggaatccccattcctggctttttaaaagttagacctgaaatccagaaggaagatttggacagtcagggatgacaatagctgtattctgagtgcatgcagccttttctcgggttctttgggtgggaggaattgcagattcttttctctgcctcctgtcagcacggctcgccacagatgcccaagggaaatccatccggcctggaaaatccagaagcacagccaaggcatggcttgctttctctggaccacagagtggtataactatttatgataaataaacaggaaacaccaatttatgctttcccactcatgatgggactaaactagctagtttggagtgaaactctttgggcttccttgctgcttagtctaccttgcaatgctacagtcttgtgagcaccaccattgcagagatgaacagtttttttccttctgagctcctctgggtatgcaccgcctgggatgatggaagggcttgtggatctgcctagtccataaaagttaaagcaagcaggtttacctgcttttctcagcgtgggctaataatatttacaagaaaacttttctggtttgttttatattttaaaattaatttgtgctgattgtagaaaaaaatgtaaaaagaatcaaaagtgattcataatcctactcccccaggaataaccacctttctagattttctccatgcccataggttcatggaagccaatattgggttgatacttgcattcgtttctattgctgctatgacaaattaccacaaatatagtagcttaaaaaatatgcatttagccaggcacagtggctcatgcctgtaatgccagcactttgggaagctgaggctagagaatctcttgagcccaggagttcaagccctgggcaacatagtgagaccttgtctctaataataataatttttaaaaatacacatgcattatcttacagctttagaaggcagaagtctgaaattcatctgctatggatgactatctgaccaaaataattttcagaacttttggaatccccattcttggctttttaaaagttagacctgaaatccaaaaggaggattgagaccagcctggtctcaattgagacccctgtcccgcaaattcgtatactgaagtcttaaccctcagtgtggtggtgtttggaggtgggccctttgggatataattaggtttacatgaagtcacagagtggagccctcatgacaggatcaatgcccttgtaagaagagatatcagacagcttctctccccaccatgtgtggacacagcaagagggcagctgtctgcaatccagggagagagccttcagcagaaaccgaccattctggcacctcgatcttggacttccagactctaaagttgtgagaaaataagtgcgtgttgttcaaaccatccagtctatggtattttatggcagctcaaacaaacctaagactgggctaaaatcaaggtgtcagtgggtagtgttccttctagtggctctggggaagagttcactttcttccctctttcgttctgtatgctgcctacattccttggctcatggccccttcctccatcttcaaggccagcagtgcagcatcttcagatctctctctctctctcgctgaccctcctagttccctcctacaattacatcagacccaactggatatttcaggatagctttcccatctcaagtacctaaacttaatcacaactgcaaagttctttttacctctaaagcaacgtattacaggttttggggattaggacttggacattgttggtgaggccattgttctgcccaccacaggaggcaacatatagtgttcatcttatgctgattgagtgtctgccatgtgctatgcacttttgctttctttcacacagttaagaagtggtgaactaggatttgaacccaggcagtctggctctcccgcctgcactcttgaactcctgcaatatatctacttctgcagtctgctttttctcttaatatagtttgaatattttctcatgaccttaaccattcctctaagtttgagagtctaaaacatcatttataatggctaactaatacttcattgcctaaatgagccatagctaacttaaccattcttcaataggaagatatcttggtgtagttaaaaaaaacacagtgctgaacgttcttgtacatgagctgtgtgcccatacttacttattaaatgaacttgggccagaaaagttccctggaagctggttaactactgtacattagacaacagtatttcctaaactgtttttcttcttttttccccttctgtattcatttacttactttaaaatttttttccccttctgtattcatttacttacttttaaaatgaggtctcactatgttaaccaggctggtctcaaactcctgagctcaagtgatcctctgacctcagcctcctgaagtgctgggattacaggcatgagcctctgcacctggctttttttcttgaggcacttaatagattctatgaagtgaggttttctggttaactaaacttaagaaatgctgcactcccattcctgaattagagcttcacaatcatattagcactaaaaccagaagtcctctggtaaacaaatccctctctccctccttgttttctttaacccagagtttcccaagcttaatttgaccaaagatttttttctttgaggcatcaagtaactatcctacaaagctaaggtcacaggacacaatgttagaaacacatctttggagtcaaccaagtgaagccacttaccctcaaactccttcaaaggcttaagtctaaaattactccagatggaatagtttgaatatgatcacgtttatgaaataaacttaaacgtttcctatcctccactcggaatttcagtctaacattgttgtagtggttccttacgttccttatagaggtcacattatacctgttccctgctctgtaaatgtcagggctggccatcagccaagaccaatacggacctgccctgaggtctacatggcactgtgtgttcatgttgttgtttaaggatagtgaccgatgtccttcaagagagccgttctggccgggcacagtggctcatgcctgtaatcccagcactttgggtggctgagacagactgatcacttgaggtcaggagttcgagaccagcctggccaacatggtaaaaccctgtctctagtaaaaatacaaaaattagccaggcatagtggtgggtgcctgtaatcccagctactcaggaggctgaggcaggagaatcgcttgaacctgggaggcagaggttgcaatgaacccagatcactgcactccagcctgggcaacagagcaagactccatttcaaaaaaatgaaagaaaaaaaagtgttctatagagtgttcagtgcaggtgaggaactggatggcaggatgttctcattgaaaatggggcagatttcaggcatcacaagctattgaatcattacaggtgaataaaccaatagcagagcaaagtttgagggagtaagcaaagctggacctggggttactggggaagttctgggtgagatgcacactggatcagtgaaaaagaagcaccaaagataaccatcatggtttggggagtctaatggggcatgtcctcttggccaagggacttcaaggggccttatggggtcatgaaaaagaatgtgattgagctcccaggcctgtggcacagactatttgcatcacattcatttaatgatcttcaagacccaaacagtggtgctgtctgcagtgtccactattgggggaagagcatccggagtgctgtcaccgtcctaatggagaggacctctggctgcaaactctggacctctgaggaagttgtcaggtgtggaacaggtttctctccagccttttggcagcctgtgtgattcctaagatggcacccagaattctggtgcctggtttgaaccatacttggggaggatcatcagagatcacagggcccagcagaggagcctggctgagctagcttcccttgatactgaccagaatgatggccggaagtctggggatgaggcatagtgtcttctctctctggggacctgtgatagcctctcctaagggggtagatagaaccagaacatgggctcagttatccaaagcgaccattctcagcccccttgttcctggaagcccctgctccagaactgctaagccagcctttctttcctgctacttctctgacctctagtggctagaactggaaaaacttgctcaagggatgaaatcatcaataagcaggaaatgtctttgatgttaaatggctgtccacttctctatagtaatccttcaccctctttacaacattctttctgcatacatcccatcatttaattcagccatcatcaacactgggtttgggctccagactgtgactgtcactgtcttatgtaacttgggctggagttggcatctgagcctctgtggtcatgacatccaggtgtcacgacatccaccctaactacattccagggttgttgcaaggctcaaatgacatgaagcctacaaaagaagtggtatataaatccgcttgttactccaaagccattgagtctgtgattctgtaagcctaaaatgttttaattcatatattttggtgaaggcatttaagccctttcctctgattctctatgggagattctgtcccaatccataagcatttacttgtggttgttatatatatttcataatggacttactgattactcaacaaacatgaattgcctacctcgtgccatgtaccacagctactgctgggatctggcaatgatcagacaggcaaggctctaccctaatggagtttgcattcaaatgaattaaggggattcatagacaggtgaaacatacccccctgtcctcaggatgacattatagcttaattgagaagacaaaagcttcaatagccagataagatttaagtcagtatgtgaaaatggccttcacagaaatataaacaggagttccactgtgctgtgtgtgaaagggagaagctagaagcaatgaatataggctgtgctttctaggtgtttaactctggaagagtggctggtgggaagtgatctggacacttgagaggtcaactggaaaatgatgaaaattaacctggtaattggtgtctatttctggtcccagaagagatgcaaaaattttatgcagaatatgcatgaaattgttcatctcaccctatagtcacattattctttgagattccaattaagtggtagctagaatcattagatgctttctgttctgaatattaaccttataaatattaactttgtcctcataataactatctgagggtaggtacccttatcatcatacccattttactgatgaggaaactaagatatcaaaagagtaagtaacttgcccaaagtgatttggctgccaagtcatggattcaagcccaaaccggctggctccagagcttacacgctcaccactgtgctatattgtttcttaagccttcaattaaaaagtcaatcggaattttcagagatacatactaagtgtgcaggagtgaggtgacctgaggtctgggattggtttaaaataattcagcaagtctaaggaaggaaggaagagccaattatgctaaaatcttgataaatgtttactctgggtgatgtttataatgtttataggggtcattatagcattccctaatttccgtaataaaaaataggaactgtttctagtgaacttggagattttgaaatacttattattgtactgttaatatcaaaagacttttcagttatctgggtaatttagatcaaagcaacaaatttcactgttattaatgtaatgtggccatgaaatgcagtgcccttttctgtatattaaaacctattttccacctaatccccaagtgtaacagctaaataccttaaaaaaaatcaagaagggtgtatcctgccaaacatatttgatagaatagcaaaacgtttgagttagaagagaccacaaagataacttcttccaaaattcccatttaaccgctatggcagttaaagctaggagaatttaagtgatcagcccacgattgaaatgggaatatgaaacgatgatctatagtcagtcacgtagccaagtactggaagagcaggagttaaaaacctgggtttcctggactccaggcctttgtatctctcatcagaaggaggttgtgccagtaaagggctaagcagcccatatggaaatgtggacaccaggcttcacttgtgattcctgctacatcaggcagttgccaagttagaagcctgggatgtaagatgaagaaaggtgagtccccttcggcttggaactggaagaggtcaaatggccctttcccctcccaaacggagccatgcaagccccatttatcttgtgtgttttatccacattccttgttcacaggttttagccgcatcaaccacaaagggcataattggaaaaatcataattgttatacttgaagatacttctcagaagtgcatttggggctctgtgtcaataaacccaccccatgaagggccagaagccagggccaggcatttcttgggagggagggatggaaatggtcttggtgagggtgcgtagagtcaccacaccactgttgaattaatcactgacctcatctctccatcctgaggattcttggaggacattgcgagagctaaaatctcctcattcccaaggctggtgtgcaccttttccattgcctttgttggtgtacacttcttaaggtctgggaggcctcaaaccccaatgtttcaggaccccagcaggtgaggtaaatgaataaagctggccagtgtaagaccggggcaaactgagaagaacaaacttcatccttattcaaaggttttataacactgggctgtctgcacaaaaagcctgggcaggtcagcagacaattgacttcctctgctatagaggatagaccctggtgaggaaagcaggaggcctgggtaccatcactggctccctatgacttgagtacagccttcccttggcagagcctcaagcgctttcatctgttaagaagtgggtctgtgagtctccaaggtgccaccacctctgacagtctaattctgtgatctgtgatagaatacatatctcaaaacaactggagccactgtcggtctgtccaacatatatttgcaaaatgcgtgctgtgcctgtttgatctaactgactttttggaacttggtgtccttgagatctttggatgggtttgtgcattaaccttaagtgctttgatccctgtaatataataaaatggcctacacttaaccatcattctggtaccactctctgtgtcagaggttgttgctcttttatttgccagttttctttctaaaagcagtcatgagcagacaagcttagaaagggtattttcttcgtgttgtttcagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtaagtttttcctcctttcctctttcacttctctgagcgcggccatcggtgtggcgtgtggcattccagttcaggcacaaatgtgtatgtcgttgtctggtcagcattagggttccagtatcagttttcatatatgtggtttcacatgcctggaactgggtttgggtttttgcctgtttcaaaaaaaaattgttgatcttgcagggagctggtcctttgctgccaagtatagctggagtcgaccagcaaggctagtgtgtaagatgtttggtgcatagaaagacagcatgcaagggccacgcagggagaaggttgcaagtgccctgaaatcatccctatgcacctgggagctgatttctaccattgcccagtagagattttatttctctagaaaaggatgaagatgctgttccttcaaagccgacactctaggcaatccctaacaatgttacagtgcttaaaagactgagtgtgtttggggctgttaacaagcccatgtgcatagcttgaaagcaaagagccagtgaaaatgacagttgaaaaccacatggctactctgctacacccaagccctcggaactttgcacataacgttcaaattaactgtgaaggaagtcacatgctctgtggtttctttctccggttagagacataggaactgttgctctacacagtcccaggagcctggagatcagcctcagggttcatgccaacctcctgtgggtcttctggcaccagtctcttagcacatattgaagtcatcacctcctcccctgactgcacttaagtcacagatagcttgggttggttgaggatcctactgagtttacctgagacagtcctggcttatgcctgttgtggtgttgtggttattaatatccccttcaactcttttgttgttgttgttgttgttgttgttgagacagggtctgtctctgtcacccaggctggaatgcattgatgtaatcatggctcattgcagcctcgacctcctgggttcaggcaatcctcccgcctcagcctcctgaatagctgggaccacacgcgtatgccaccatacctggcttattttttaacttttttgtagaaaggaggtctcattatgttgctcagactgttcttcaactcctgagctcaagggatactcccaccccagcctcctaaagtgctgggattacagacatgagccactgcacccagcctgcctttcactcttgaaagtgtcccagtttgggtgataaaccatctggtcaccttaaacttgaatgctatgaagttcacagtaagaattccctgctgttttattgccttttatatcctagctggctaagttaaaggatttctggagttgaagcccagatgctgaaagttgctttcaaaatatatggcggtaaagaaaggaagaaagcaaatggatatctggcagcctggcttctcacttggcatctcccaggctttcccttttgtttacacctgaactgcgtggagcactggctcagctgctgtattaggctgcagctattctactgggctcttcactgtattagacagtgggatgatgcccggccctgggtagctgctgcagacatttccactgctgaacctcactgtaggggagccagcagctcctttcgtgagcctgcaggatttttccctggctactcagtcactttcaccagcccttctttgaagccccacttcaaaggataaagtttgccttaagaattttctgaaagttaaatcattttgaaacttggtgctctaggtgtctggtttcttttctcccagtgactctgctctatacatcagcagttttggtagaatttagccaagtgggtgccccacactctgatgtggatggggaagaacaagtagaaccacttagcatgtgacccacgcgagtgtttgctgaacacactctacttgtcacttgtgtatgtcttttgtgttggagtgcagatgatagggaaaaatactccatacagaagggtagaggcagttctcactcatttcgtaaaggcagagggctggaagctcttttgtgcacacgctgacactctggcagccacctaacaaatgccaaccaggttgagtttttcctctgcatgaatgaagctgcttggaatcagcgttttaatatgctgattgcccttcacttacaaatcaaagaggcagcctcctgtctctatattttccagtaaataaacattttgaaaaagaaagagacctaactaattaagctgttaatatccctggatcttggattcaaagccaaatgttttgcactgttattgctattacaacagaaccaagtttgctgttgttgaaaattcttaggatcaggacaaaatctaccaatccactatatgctcatttaagagacccaaatctaaaacaacaaattcagattgcttctaaagcaaagatatgatcatcagtcaggcttcaaatgagagccttctcctagcccttccaatttaggggaccttttctcctgtatctgtgtcaatcactggtgaatgtgttgaagtttacctgtagggatgaacaaacattcatttttttcctaaccaatctgtggccccttttccattttttctttttctttaataccagaaggatagtaatagagagcagatggattgctggggggatgagttgtgtaactggcttacctatccgtagaagcataaagttaattctcttaaaggtaaagtaattctggtctctagcctccatttacatacactattctcacagagaaacatggcttcttagactctccaccctctaagcacctcagtggctcacacctacacacccagcatctccccatgttatgcagcatcacccctggcacctccatttgccaatattttttccagtaagccacttggcagcattttggcatgccgttttggagatgataaaccacacctgagaatcaatgcctgtcgcgtgattagaacacaaccatgtgtttgcccatcgaaagtaacagttatttgtgaattgagcaaaaataattcttattttttattctttttaaggagaaggcagagttaaaaacaagacaggcgctgatcattggaatgtgtataaagtgtgatatgttagacacaatggtatcgaggagagtgaaagacagaaggagaaagatagaatgtagctacggctgaagttttgctgagtgagaaaaactgatctttgccatcaaaacaagttcagtgtcccccgagcccccatcaggggtgtggtggcctctggggtcctgtccacagggactcagctcagggccctgctctctccagttttccactttataaaaagtcatatgcagagaggcccctggcttatgggagtcagggagtggtgttatccaaaggttgtccccaaccagccatatttgttactagctcagaacttgagcaaagtactccctttagttgccacagtcttcacccacctgggctgatttctttgtcctgtatattggagtcaccaatgagtatctccagcctcacttattaatggacctcttggctaattctgagggcaggaggattaccatccccacccctacccacttacccaaggctgtttaccaacctatgcaaggcctttgtgtgaattaggaaaaaaaaccacccttgttcctctatgaagatatgaagatgcagccctgcaccagccacacatttggggggtagagtaggggactgggctttagtaccattcatccctttagtctgatgcttttgtgcagtgcacacaacacacacccagatgcagcaatcctattcatattgtgggtttctcttatctggaaatgttctcttatgtggaaatgtccacttatctgggtctcataccatttctgctcagtcatgcaattcataatggactagtgaatcctagtttcctaaagggcttcttgatgccttgcaaagcgactgcctccaaggtggggttgcccactcatggacctggaagacatttggatcagtgggcacaaatgatgggctatttggatgtttttccttcaggcatgaagaacccctctaggaaactctgattcattagtccatcctgagtgacatgactgtatttaggcaaacagtatttttccagccaattgtttccctaacctgacctgagcctcagaaagtgaagatgatgggtcattgagtcaatgatgctcatgaacatctcgagggtttgctttgcctttctcagttgaagggatgctgaccagagtccaaatcacagcctcctggatgttcagccccatctttacttttagcgcaggatctgccctcagtggggttttccagtgtgctctctctctctttctcatcccatgacttcattactgagaggtcatccaaccactctgtctcatcttagaacaagagaagacctcgtcggttttcctgggctacgtcaaagctgagagttcctggcacacattacccttccagaccaggacatgcattgagagttgtggccatactctcgctcagtgtgtgaaggaagcctatctgcctcctgtttccccagacgctacaggaagctcagtgatgccttgtgcttccctaactctctcttacgttctcactcgtaccctagtgaagatgcaaaggagagagaagagctcctgacttgtcagctcccagccattagcccaatcatgacagaactataattcctaagtgctacatataagaagcagtcagcaatcacagatgtgtgatcccacctaactagtctatggctatcaatgccccaaaccaataaatgctttaaatgccccaagcagtgtaaatgtacgctcattaccataattctggagagggatgtcccaaattggtcctgccatctcattttccatagtcaggccatttttttctgtactttgagtaagacttttagtcccctataggaactaaaggatcatttcagttcctaagtgctcatactaataatcctatataatcaccagaaattgctatcaaaggatgatcccactctcaggaacttacccaggcccccagggttctgacgagggaggctgtgtggtctccctaggcaagactacccttaggccggtttcagagaatctgcctccacaaaccaactgctgtgattaggatcttcttttaatggaacaacaggttacaagacggctttggggttcagagaagcctacgggaagagaaaaggctatttggctacagactctagcaaatccaaaatggcccccaacgaccttgctggtgggcagctgattgtgtacagaggggaaggaatcttgttaattcaaagtacagaaactgaaagcaacgttttgaattaacaaagtacggcttatctgatatttttattagtgaacaatagggtatctagttgctgcaaagaatagacttataaataaactaatatcagatggagaaagttttggcatgggtgtagaatggcctcctggtattacttcccctcccatcctcttctggtgtggtgcctgttcccggctagggggtgttctgtaagtgtgtcactgccatgtactaaccctggtcttttccctctctgccagtacacttctaagttactgtcttgcaaggtgacttccgaggtacttttcaatttgtttgtcttggtcttactgaatgcatgatccaggtgcatgctgttgtggtttgccatttcctgatgagttaaacgaaaatggcaagaaaaatgacttgtctccatatgtatttttttgtgcctgttctgaaatatgggactgcctcgaaatgttggagtccatgcaacagtgatatacaatggtgtggtttgctgtgctgtgctgtgggggcgagtgggagggtactggggaagaccttgcctgctcacgaatcttgaagacgtttggaccagaggacacaagtgatgggctattttggtttttaaagtttctttaggcattaatagcaagtatacttggcctggttggaaaacagtgcagctcatgcagattgagctatggattttcacccattctttgtttaccttaacataaagctagaaagctccattctatagatttaagatgaaccatcctaatctacagatttatcaaatgtaaaccatcctagacctccctccctccaatctttaaacgtgtatttttattttagaaactctaagccttgatttctccaaaagcctccttgtttaagagacaaggtcttactctgttgcccagggtggagtacagtggtgcaatcatagctcactgtagccttaacctcctgggctcaagcgatcctcctatctcagcctcccaaagagctggaactactggtgtgtgccactatgcccagctaatttatttttttatattttttttgtagggacgggggtctcgctatgttgcccaggctggtctcaaactcctggcctcaagtgatcctcctgcctcagcctcccaaagcattgaggttacaggtgtgagccactgttctcggtccccaaaagtcttctttccttttacacagatttcacaaatatatgtgctataaatatgtgtgctatgagaaggcataatatttttctcttttaatttttttctattttgtccattttttctttttgctgagaaagcacaatatttttcatatttttatttctgtattttattttgattttaaaagaattatttcaaatatacagaattctagagagaatcattcgttcattcatttaacaattttcaaggctctactatgtgtcaggcattgttctaggttccaagaatacagcagtcaacaaaacaagttcctgatatcatggaactggcattcagaataatataagataataaaataataaaacccacctacccagctttgtccattcttatcatttcatgatatttaatatttttaaaagaaattagtattgcaaatacaatttaagccctctcgtacttctcccagttccctcctcccttacaatctcgcagaggtaactatttttgagcttgttgttcatcatttccatgcatggttttatacttatactacaaatgtgtatatacataaacaacaccttatttttgcatgtttgaagacattctataagcggtaaatcatgttgcagtatcttctgctcctgactttgttctgtctgcattgttttgagatgtgtccttgttgatcactgtggctctggttcattctttataactgctgtatggtattccattgaatgaatatatcactatttattcaatcttctgttatggaaatgtagactatttccagtttttcttaccgttagaaataatgcttttatgaatgttattatacatgtctctttatgtacctatggaagaacctgtctctatatttaggagtagaagcactggctagtagcctgatacatcctaacatttactagatattgtaaattatttttcaagttggttgcattaacctgtagcataataagttttttggtctctctatttagccaaagaattatatttaaatatagagctgacctgctgattatcagtaattttctttcataagatatcaaatgaatactgagaatatcattctgtaccttctttaacgtctaattgtggttctcatctggaggatggcagtttgagaattaggactaagcccgtctcccctttgagtccatttaaaacaatgaaaatctggtcaaatatatccaaggaagatagagttgggcccactctgtcttcaatttaaaagcaggttggaagatgaaatataaatattaatatgaatagggtgatattatttaacatatctgtcttttgtttcatatgtccaaattaaaattttctatattgattgctttcaaagttaagcaattcacttgaattccctaagcattagagagaaaaattaatattaaagggttgttgagagataattgttttttattccctaccagacctgaatgtgaatttgtgaaaacaataaaactttgtttatttatttagtttacttttttttttttttttttttgagacaccgtctcactctgtcacccaggctgaagtacagtggtgcgatctcagctcactgcagcctctgcctcccatgctcaggcgagtctcatgcctcaacctcctaagtagctgggactacaggtggcagccaccatgcccagctaatttttgtatttttagtagagacaggttttcactatgttggccaggctggtctcgaacacctagtctcaagcaatctgcctgccttggcctcccaaactgctgggattacaggcttgagccactgcacccagccacaataaaactttaaatcagatcgttttttgttttcccttttccatttccatggggagtgttgattgctcttctctggtgtgtctccttctggactccttacagccattgggcagccagatagtctggtggcctcaagcatcaactctgcacccagagtgcagagttcaaatcttggttttgccttctgctaactgggtaattctgggcaagttacttaacctccctgtgcttcaggttcttcatataaaaaatgggagtaataacagcataaatgtcatagactagtagtgaggattcaaacagtaacatcgtacttaggacatgagtatgacattattagagccccagagacatatgcctttttgcccagaaaataaaggaatgaactttagaaagtgaagttaatatgcagtaataaacaagtaataaaagctctaaatttgctagagattcacacacacacacacacacacacacacacacacacacacacacacgtctgaattaattacagaacagatactcattcaaataccttgatttttgaatcttctgaagaccagttgtggtgcagctttactcccagacacccctgggtcataagccttatgaacccaaagacagctttatatcaagattgccaggtatttcagtaaggatgtttattttcttgtctgtgccattactagaggctttagatttcactagaaatttattgtatggccatggtaagtgattgtatgaccatggtaaatgggcatacatactaggggaatgaattaagaaaagagagctcattgttggtataagtgaattactggggctcttgacaagtagatgtccaaacccaagctatactaaacgtttccataattatgagtattatttttctgcccattatacttttcgtcactaaactccatgagggaagggactattctatcctcaacacgaagcactgtgccttatacttggtaggaaactaataaatatgtgtaaattggattgatagatggcttgtaacaagagttcctaaagagcagagcaaactcaatttgctcaagttgtttgagaattaaaatagggtttaaataacaagacaaagaacattccaagaggatggggaccatagtttttagaactttagatttatttttagctttgatgtaaacctttctgtttgtatctgcaatctgaaaggcaaagagatgatccttttatacaatgtagagttctttataaaacgccctatttgtatgccacttcataatttatatatccctttcacatgatgatagaaataattattccatcatagtttgagagcttactatgtgctgggaactatactttacatacattgcctcattgatttatccgtccaactttatgctgtagtttttatgatccccattttacatggggatactgaagcacaggggtaagtgacttttccaaggtcatgaggatttgaagtagacctgcctggacttctgagtccacagtgccttctgagaaagcctgtgaagtggggtagctgtgttctccatgttatagataagaaatgtgagataaaagatgaacaacaaaggacaaaactggaaatagagcccaagacttccacgtgcagtccagtgctgtttttcagttccatgctaccacacattagactattagaaaatttctctatttaactatacagatttggaagcatgctttcctcctactaatttgttattcgtagatatctgtggatattgagtgagtgaccgtgatatgcttacatacaaaacacattatgcaaaacacacatggcttgtgtgcttaacaatgcatcattcattcagcaaacgtgactgaggaggaaaaggggaggcttcacagaggaagatatgttgaagctctgggtggtccattcctttgacaaaggtgcagagaagcaggttgagatggacccccgatctcccatctacccacaatctgcttatgtctgggctcccacctctgcctgtaactgcatctccttgcttctctggagttgccaactgtattagtccattttcatactgctatgaagaaataaccaagactgggtaatttataaagaaaaagaggtttaatggactcacagttccacatggctggggaggcctcacaatcatggcagaaggtgaaggaagatcaaaggcacgtcttacatggcagcaggcaagacagtgtgtgcaggggaactgccctttataaaaccatcaggtctggtgagacttattcactatcacgagaacagcatgggaaaactcgctcccacattgaattacctcctatgagtccctcctgctacacaaggggattatgggagctacaattcaagatgagatttgggtggagacacagccaatccatatcaccaacatcactgtcccttgcctaactgattatatttagaatgagcagtgccttcattgcagtttgcataatcaaccaatgttggctctactggacttttcttcaaaatcagaaactgtacatcctaagcaaatgccagaacaattggcaagaatgcctggacttgttttctgcatggtcatgaaatagaaccatttttcatatgttggcaacctaaatgccattaatctggaatctcttcttgatcaaactgaaactggaccagataggctgaagtctcctctcgggattccacagactgccctagtgaatgggaggaagggaggctctccctcagtggtggtgagcctacttgtccttagtgttgtcacctttcatttcattgattagcatgtggggtctgaagttgcatcagaatgctgagattgcttctattgatccaagaacttttttttttcatgtaatggcttttttagtttaattttgccaaagtaggtttttatactataaatatcatcatggcttatataggtttgcaaagcttgatggactgaatccacactggtcccattgtttggaattattttctggtttgcttgtttatgaagagactaagaccatctatagtgtgctgtctaatatggtaatcactagtcacatggagctattcaaattaaaattaattaaaatgaaataaaattaaatatttagcttctcagccacactagccctatttcaagtgctcaatagccacgtatggctagtggctaccatactggatagcagagatacgttttcatcattgcataaagttcaattggacagcactgatctgctgcgtgtagggatctgctttatctgaaaacttgatgcagaatcacggctagttcaaagaaacttgcagaacatttcatgaaaattaaatttctctatggtgaaaactaggggtcaagtagcagatgaatactggctgtgagatgaatgcataaccagaacctcccattcccctttttccagcgtctctcctatctcccagcagtgctttatcactttctcctctcaagttgataaagagaaaggaagaaagaaacagagaagtcggtttatgttcataattaacatccatgaactctgcataattttttcccctctctttacaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggagagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataa

SEQ ID NO: 1215 - DNA, 392215 bp, Homo sapiens; identical to SEQ ID NO: 1214

SEQ ID NO: 1216 - DNA, 13354 bp, Homo sapiens
atccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccaatcccgaggttcaccggactgggacccccacaccggtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcaagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaagagtataccagacctctctctgaaatgaggcttgggttgtcctctttctgataaattcccagatttaacagaaaggctgccttctgccatgaggatacattgatataagagtttgagaggtactggtgcacttcttcacactaacagacgtgtgaggatgtatgactctaaaccacatggcatacagttcctgccaacttaatgtttacttttctagctctgcctctggttttggtccctggcagctgatgattcttggtaataccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggcgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgcttgacctcatcgggcctctcttttcacatctgtataatagaggtggtattgtttcacttccatttgtgaagtttaaatgagatctgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtctgtaaaagtcagtcaactgaagaacaccatcaaatctttggtaagagtccactggggtcccctgattccacgctgccaatcctgggctctagtttctccttggggccctgaagaaaggggacaggggcccctggtgccaagggcgaatagggagctggggcacccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccctgtatttctgccatgactcagtccctaatttgctctttgattctggacaagccacctctcctttttgggctcgtgtttccagaggaagtagtgagtatcataggtctctgttagctctgagagtctgagatttaaaggcctcctagaatggaaacctcagggccaaaggctcctgtctgtccttttccgccctaaatctgctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctaaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctgggactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagaacacaggacgtagagcttggaggccaagtgcctgccatgcctttacctggctgtggtcttggccaagtcctaagtggggtattggctacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtttgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcctgggactgggctttgtggaggtgggggcagagagggagatggtagcatgtccagcctccagcccctctctccagggccctttccccctgtgctttgggcaggtttgctcgttgaagaaggagaagaagcatgataaatatcgggtagagacgctggagaggagcttgtccaaactcaaacaccagatgggtaagatggggctggcgtgacctgacagcaggactggcatcagagggctgtgagggtggcttggagtgccccagcgaggtgggtggatgggaagggctttgaggcagagggaaagaggtctgttccaggagacggcaagtcttgtcatctcaatgagcctcagtgtccccatcagcaaagagggcccgttgtcagccacccgcagtgctctttctctgaaagtggtttggaagactggctaccatctgggtgcgaggaatcattagcagtgaggccaagtttgaggagcctgagaggagctgtgcgccaagaggagggtttttcttttccgagaatccagaggcccttattatctgcttcctttctcagctgaacccttgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttcaaggagctggtgcgttgccccagctggggagcctgccctcctccctagccctccaggcctttgtttccccacctataaaatgtggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccgggggcaggtgaccccagcaccctccagggcagtcctgtggctgtttcttgcttcctgccctctgattttagaggtgggtagccctgggctcctcccaggtctggacatcatcattccagctagagacatggagcaccgccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaaggaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcacatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagggaggcagtcacttaggcctggagtaaggggccaggggcctgggcaggcgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcggtggccgagatggcctgccaaaagttgcaggaggcccaggggagggagctgccgaggatggggccgtgagggggacgacctgacaaactctgtgccttctcactctttcctggccccttaggagcgcctggaagctgccagccagcagaaacagcagctaacggcccagctgagcctcatggctctccctggggaaggtacgggagaccgcttagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccacaccgaccagtagtgggaatgtgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaagacccctctggccacccccaacaggacacggaggagaacatctggacagtgagggggaggaggcacctcggcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctgtgagtggggagacccaccgggccctgcaggaagtcatggagaagctggcccatgccggaactcacctccgccttctccatgacttgaaaatgccacctgagggcaggtcgctgccgagatgtgaccccattattttggctccagagcggctttatggaccacctggaggagaaggcagacctgagtgagctggtggagaaagaagaacttggattcttccagtactacagagagagatgccatcagtgagtgggaggccagggcgtggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatgaccatcgtcaaagacctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcatgcatattgagtttgcccttacgtggtgggagttcaaacacacaaagacccactatttgcacaaaactattcttgctggtttggaataggctgccatgtgtttttaatgttattgaagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcatatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaagtg

SEQ ID NO: 1217 - DNA, 7502 bp, Homo sapiens
agtcacacagctgcctggaaggtgactggaggccttgatcggttctcattgcgattttgctgctgtggccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactgttccccccaaccccggtgccttgggctacccccatcaaagttttgtcagtcagccccaccccttcagaaagcagcccagtccttgccctcgccaatcaccccagggtgactttgggtgggtgactcctgggacttcccgctccgttactgggccctcatctcctgccgccccaagcttgatctccctgggctctttgggctctcatctccaaggagccaggccccaccctcgccaatcatccctgggtgactttgggctggtgactcctgggactccctgctgcagactctgccctcccctcctgctgcctcaaggtcgacctccctgggttctttgtgctggcgtctccaaggagctgggtcccaaccctgtgcttccctcccccatcgtggagcggcgacttagacatggtgctgacacggtccctccccctgaccaggaggattggaatgttgtgatgtcacagcccacctagtaactgccgttactgcaagactggcctttgatcttatgacccagtcccctaagcgttctcaccccgtttctggttcctctggtcacaggacaaatttccagctggaaggggaatggagactatgggacctaggagcaagaggttccaggctgcctcactcccttacagatgttgacggtgggaaaagcctacacttcccccatgaactcaaaacattgacagtatctctgggtggcaatgagagaatgggtttggtttggttttctcccaggcttctactttccagagagattttaacattttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatgtgggacatctttctgaagcatcagtttcccttgattctcttgagatcaagagaaaaaacatgaatatacttagggatgacagtcacataggtttctaagagtataccagccctctctctgaaatgaggcttgggttgtcctctttctgatgaattctgatttaagagaaaggctgccttctgccgtgaggacacattgatataaaagtttgagaggtactggtgcacttcttcacactaacagacgtgtgaggatgtatgactctaaaccacatggcatacagttcctgcctacttaatgtttacttttctacctctgcctctggttttggtccctggcagctgctgattcttggcaaaacctcagagcttggagtcagaagactgagtttcaaagtgccagtattgcctttttctttttttttttctagccatgatatcaatccttctcagtcactaaatgagtgtgacaacaccttgtacagttgttggtgtcattaaatcagatagtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctcagacagccacttctggtggttgccagccacctggggatgtgagtcttggctgaccaggcttctggggacagggggcccaaggggcaatagagggtaattgttaagattgtggatggactgctgggtacgggttaagaattctggctttagccgggtgtggtggcccacgcctgtaatcctagcactttgggaggccaaggcaggcggatcatgacgtcaggagatcgagaccatcctggttaacacggtgaaaccctgtctctactaaaaatacaaaaacattagccaagcgtggtggcgtgtgcctgtagtcccagctactcagaaggctgaggcaagagaatggtgtgaacctgggaggtggagcttgcagtagccaagattatgccaccgcactccagcctggtgacagagcaagactctgtctcaaagaaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaaattttcatgagatttgttattgttgtttttatgttaatccctagtacatggcctgctgtaaacactcaggacacccaggatatggtctttgctgtttgattttcctcatccccagtctcaaggggaagccaggacaatgagaacagccacttgccatcaggagtcactgaaagggccccaggatgggatggtggggagataagaaccatgagagaagttggcacaaaggagttatgggacaaagggtccaagataggcagaaaagaaaatgttgccagttgatggggaagaaaggaagtcagagggctcagacactgtgggggacagaacatctccatgtgcactctcatctcttgtagtcagcaacaggttttcacagggaaggccctacatcatctgctaccctgaaagatctggaggtaagaggctctgggcagaggtgcagtgacccttcgggtcagccctccaacctcctcctccaggagggactgggtgcccctctgccagctgagacagcccacacaccccagccctaatgattgttctctctacctctcccccgactcctgctccacctcctcctctctgcatgaacctcagagcccgtgccaagaacgagcagtagtcctggattcaaggtccgtagaaatcagtcaactgaagaacaccatcaaatctttggtaagagtccggtggggtcccctgattccacgctgccaatcctgggctccagtttccccttggggccctgaagaaaggggctgggggtccctggtgcccgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggcccccgagaatggaaacctcagggctaagggctcctgtctgtccttttctatcctatatctgctgtgaagaaccgtacctggcccatacgtgctcagtaggtgtttattgaatgaacccacttttctaaatcacaagctgccagaaggaggggcctttctgaaactccatctctagaggtttatgttgctgtcctctcaagagattccagattcagactttgagttctgtggctgtgggcaaaagcccacaaagacccaaatcctctgtccttgggagcttgaggagagtttaccagttcgtgttcccattatgtctgagaactttgcctttaaaatccattcctggcccctgcctaccgcttcctggtctggggaatagagttgagggggccaccctccatcaccttatttgactctccccacagaaacaacagaagaaacaagtggaacatcagctggaagaagtaacgtgatttcgtttccttgcaacatgactgctggaagaaggctcacccttcagattccaccccatcccctcagggccccgataacctggtcccatgggtgggcctgtcctggggcattggtggcattctgggggcatgtctcttgctgtgccatctctgcctccccctggtaagagctctgtcttcctcttcctacaggaaaagaaagcaaacatcaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctgatgtcatggccacacagaagaagaaggcaaaccaggtgagtccaaccacctgccccatcccctgggagtctgcctttgcagatggaggagtgagcctaaaggtcccttctgcaggatggcgtgtcctgcccagaaggcagcatggccatttcttgctacttttttgtatggtttttagtggcagcctggggctgagtcagctgctgtgggtgagttgggggtcactgtgtggagtgagcactggacgcagagcttggaggccaagtgcctgccccgcccttacctggctgtggtcttgggcaagtcctaggtggggtattgggtacttgtactgtgaaggtacagaagagtacctttagtatgttaccatttctgtagaaagaggaaacgtgtgcatgtgtgtgtgtgtgtgtgtgtgtgtgtgtacatactatgataatatacataaaacatgtctgcaagggttcataaaaaattcaggagagagcaacaagatggccgggagatacttcccttctgtaccttctgagttttggactatgcaaatgtatcatcctttcaaaaagtgaacaaaagattaattttccccttcctatctgtggttgtgaggattaaatgggattgctagcatggtatctggtgaagcactccataaaagttcaaacagtggtaataataacggtaataacaatagcaatattatctgatctctctgggcctctgttagccagctataaattcaatctcattccctgtccgttccaactttactgtgttcttttaaaaaccagaccatgggcttggaaatgccatgatctttactgaccgagttgtatattgggcctagccctagccctgttaaggggcactgtgtggaaatgcccaggctctccagattgaaacttctcactctttgccatccagttgtccagccccagtaaagcaggtacggagtggaagttagagcagtccatgcgggaggaggcactactgaaagtgcagctgacacaggtgaggttttctgagggagttatgtggaaggaagatgaccccaggtggccaggagcaggtgaggaccagtgacagcccttcctaacttctgtgcccattcttgcagttgaaggagtcatttcaacaactccaattagaaagacatgaatatgctgaacatctaaaaggagagagggcccggtggcagcagaggatgagaaaaatgtcgcaggaggtgagatctgacccttcagcccccccacattagataggtcactggatctttctggtcatctgtaaaatgggaatagtacagccagaggtggtcatgggtctgggctttgtggaggtgggggcagagagggagagggcagcctgtccagcctccagcccctctctccagggccctttccccttgtgctttgggcagatttgcacattaaagaaagagaagcagcaagatatgcgtcgggtagagaagctggagaggagcttgtccaaactcaaaaaccagatgggtaagatggggctggcatgacctgggagcaggactggcatcagagggctgtgagggtggcttagagtgccccagggaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctctggaagactggctaccatctgggtgtgaggaatcattagcagtgaggccaagtttgaggagcctgagaggagctgtggaccaagaggaggttttttcttttccgagaatccagaggcccttattatctgcttcctttctcagctgaacccttgcccccggagcccccagcagtgccctctgaggtggagctgcagcacctgaggaaggaactagagagagtggcaggagcgctccaggcccaggtcaaaaacaatcagcgcataagtctcctgaaccggggacaagaagagaggattcgggagcaggaagagaggcttcggaagcaggaagagaggattcaggagcagcacaagagccttcagcagctggccaagccacagagcgtcttcgaggagccagtgcgttgccccagctggggagcctgccctcctccctagccctccgggcctttgtttccccacctctaaaatggggcagtgtagccctcacatgaaatgttacttctaaaggcacctgtgagccaggtggctgtgggagagagggggtgatttttctaacctgtctccagccttcccagtgccatgggaggcagacaccaagttctggggtctccagctgcagtgggtggctgctgattgcttctctctgtccagaacaatgagaacaagagcgcactgcagttggagcagcaagtaaaggagctacaggagaagcttggtgaggtgaaggagtcggaaacctccaccccatccaagaagggctgggaggcgggcagcagcctctggggaggggaggtaccaggccagaggcagcttccagcctgggggctggtgaccacagcaccccccagggcagtcctgtttcttgcttcctgcctctgacttttaaaggtgggtagccctgggctcctctcaggtctggacatcatcatcctagctagaggcatggagcccccaatcacaggggaagagacagtggtataacaggctccttatgccaggtgcagtggctcatgcctataatcccagcactttgggaggctgaggcaggagaatcacttgaggtcgggagtttgagatcagcctggccaatgtggtaaaacctcatctctactaaaattac

SEQ ID NO: 1218 - DNA, 95995 bp, Homo sapiens
aatgggtgtaattattgaaaattggagataaaatttttattacttgtaaacaaaattctgtcaaaaacctgacaaattaaacaatacaattaatatgtttaatagaactaattacatatgagaggcatccaaaatccattttttctatacaaacatggtttgatatacagtcattttatctgtgtattaattggtttatgaaataacaaatagaaaaatcaagtatgcattatcaagttaaagaagcaggagagatggagctataaaaacaaagagagaagaatgttgtaaggagggcttaacaaccaggataaatgttgtagaaagatcaattaaagtgatggcctagagatcacgggcttcctttggcagagccatgttggtgaagtgaaggaagtggaagccagaccacaatggttgaagaatgaatgtaatgtaagagccaagacatttatttgagtctgatagtaatgaaaaaggacaagaattttcttcttgctgttgtttttgtcatttcatgttcaaaaccctttatctcccatgtggtactgaaaactccaagatgggatctctgtttctgtgaggcctgtagtgcttagtacatccttgaatgtgtgaggctctcattggtataagtttaattcctgactgtggatgaaagctttaaaactttgcgggcaaaatacagaatgaatttcagtgagttcccatgtattaaacaaggtggcgctggctggagacatgctgtccctgtgcccacaggagtagcagtgctgtgctcatcttcctgacccgctcttcacagtcttcaccgcctttcttcaggagtctcccctttggcttttccacagctatgaaacccacgtagtcggacaccctaatgcttctcctgtagggtgtgtgatgaggaggtgagcttggctttggagtgctgggaacctgaggaattgccaaggacccagagcccagccctgaccacccagagagcccaaaacacaatgaacaaattgaatttccacaacaacagagtcatgcaagaccgccgcagcgtgtgccttttccttcccaatgagaatctctgaacatcatcataaatgtgagtagatctcaatataattctgatagctggaggatagtgtattttcaggtttgctggagggaaaaaactggactttaaataattaagacaaaatgattgtattaattgacttctattcttaatcactaatttcattttttatatttcccttgacttttgggggagaaatagtctttgtctcaaaagtgggcttcagtgacctatgggtttgataaagcaaccagagataatgagacaagaatatttaatggcaacatgccagcaattattattagttaattgaaagcgtttatgattttggcctggggccaatgctttccccctctgctggactaacatgtgggtaaaggagaggaaaagctttgtttcactttttaaataaaagtattacgtaactttgaaatttgtataaaattaaaagatagtaaaaacaactattctaacagaattcaaaacctgttatgcttcagtggagagattattcaagataagtccgtgggaaattgggagtacatttctactggcaaagttagtgataactatgcacttctgacaaaatgtgaaatggggggtatgggcgtgtcatatcatcatggtgcagatacgtggatgtgtgcttccaaacaatggcaacctaactgactgctggaaccatacaaaatacctgaaactactcagaaagaaggtgaaaattgcatgcaaaaattatttgaaaaatattgagctaacacaacatgaatttggaattataagtgaggtattgtaactcacctacagatgtgttttttgtaatcaatattcatggactcagactacacagtaaaagcttacatagaaatcattctatctaaactttctggatacgaaagtaacctagtatgcgttttgctactatatctttatatgaatttaaatcacatttccaagtggcttacagtaatcaaggttgtcacaaggaagatgcaaattaaaaccacattgcaatatcactgcacacccactagtacggtttaaaagaaaaaaaaaacagaaaatatcaagtattggtgacaatgtggagcaaacagaactctttttcaataatggcaggtatgtaaagtggcacaaacactttggaaacctgtttggcattatactgtactaaacctgaacacacgcattgtttatgacccaggaatgcccctcctgggaaccaacaacaacgcatatatgtgttgcatatgttcaccaaaagacatttacaagaatgttcatagcagcactatttgaaatcacccccaagtagaaaatgcacaaatatttaacagtagttggataaagtgtggtacgtttatgcaatataataccatatagaaatgagagtgagggatctgcaaactaatatgcaactgtacaaatgaatcccacaaatataatgttgggtggcagaagccagatgcaaatgaatacatgctgtagatttcattcttttacattaaaaaagctagtcacacaaagttatgctgttagaagagagtgatttggtcgggcgcaggggtagttacaggaagggagtacacggagatttctggttgttagttatgttcagtgtcaatctatgtgctaaacaggtacaataaagattttagaattcatcaatttgcacacttatgatagatgcactttcctgtatgtatatttcaataaaatcttttaaaaagtaaaatgacaaaaagacactattaacaaaaatgacatattatattaactgttatactaaggaaaatataaaaatgagttctataacaggggctctgcaggtcatgtggtcatgccaaggaccatatgtgctcaagattctcatgacattttggaaggaggttgggctttctttatctttcctttcttctctcccttcccttcccttcccttcccttccctatttttaaacctaggtttggtattttcctggggtgatggtgactttggaaaattgggccggggcggaagtgaaggctgcaacattccccagaacattgagagactaaatggacagggggtgtgccagattgagtgtggagctcagttcctactggcgctcaccaagtctggagtggtgtggacatggtacgtaaacgtcctccccgtcacagtgtgcgtgcttgtgccgacgcgtgcagggaacttgggcctcgccccaggaccaccccggcgtgattgtgacctgtcatatttttacttatgcatgcatctttgtcctttaaaggatattgagtcgggattagtgacaatagtacaagaagaaatttcctattgtaactgggtcattttgaaaatactagaaaaattttaggccacttacctttcctgtttgggcgagatttataggaagtgtttcttctgctgaagcctaaggataaaatgagagcaaaatagccttctgaatcctttgatcctgagaaagttaacatgtatttcttgtaaaagcttattatattaatgtgcaaatgagcaggtgcccagactggccttggatgctgtgtcaggccttgctgcctctggtcataacattggcactatttatttatttatttatttatttatttgagatggagtctcgctctgtcgcccaggctggaatgcagtggcacaatctcagctcactgcaagctccgtctcccgggttcacgccattctcctgcctcagcctcccgagtagctgggactacaggcgtctgccaccatgcccggctaatttttttgtgtttttagtagagatagggtttcaccatgttagccaggatggtctcgatctcctgaccttgtgatccacccgcctcggcctcccaaagtgctgggattacaggcgtgaaccactgctactggccgacattggcactctgagaaagatgtataccagataggactttggataggtgtttgcagtaatgtgtcttattttcagtctatatgaaaacctacaacagtaacttaaatattgtagaacatgtattaaggtattaaggtttttcccagctgacttaataagttaatttgaattaatggtgtatgattttgaatacaagttcgaagaccttgggtgctgtgtgtgatgtcattgagctggctgtgaaagatgtgagacaatgagtgtcttcttgtatagcattgtcagaccacaactatattgtaacactccaccacgggcctccttctcaggggaaagggggattacttcaggttgcgccagggctctgacgtgcacgtgtggaaactgtaggtggtggaagggctgagagggaagaagatcgtgcatgtggctgtcggggccctgcactgcctggcggtcacggactcggggcaggtaaggctgcaggtggcctgggggtggcgtgccatcctgacttgggggacgtgggggtcacgacatggccctcgtcctgttgaaatcacagctgttgatgaactcagccgagtcttactgcttgaagaaccatgaggccgggacccatccgttttgcccgctggtgtatctgcctactcagcagcaggggttgggggcggggtcctcagaaaagaggcgttcccactctgaagtccacgtgaaaagtgtgtggaaagattgttatcctttttttttttttttttttttgagacagagtctcgctctgtcgcccaggctggagtgcagtggcgcgatctcggctcactgcaagttctgcctcctgggttcatgccattctcctgcctcagcctcccgagtagctgggactacaggcgcccgccaccacgcccagctaattttttgtatttttagtagagacggggtttcaccgtggtctcgatctcctgacctcgtgatccacctgcctcggcctcccaaagtgctgggattacaggcgtgagccaccgcacccggccaaaagattgttattcttgaagatgctcctactgcaaggtattaacaagactttgctttaggaaattgctaactggtgaggaggcacccatgcctcattttagagacagagctagtgcctgacaagtgttacactctcttctgcttggagaagcatatgctatgaccggcttgtagatattcaatttaaaattttatttatgaaaacaaaattaccattactgttttttagtcaaaatgaattatactttataattctataaggccaaggagctacttacttgaaaaatgagcatattgtttttggtcatttttctttgcaaagtaaaagggaaaaaattattgcacttagttgaagagaggaccttctgtgtgacttgcaacaaagcagaattaatttgattaatattaagaaaatactccttttatggttattggcattttcatggttagattttcttcagaattatagtacaccgatgccattttgtaagattgtgaaatggtttgcttttacttttaagaactcaattctttcaaataccatggcatacacgttaagcattttgaagtaaaaattacattaaagaaaatgtcctgaaatgttgaaaaattataagcttttttctcctcgtaaacaggtgtatgcttggggtgacaacgaccacggccagcagggcaatggcacgaccacggttaacaggaagcccacactcgtgcaaggcttagaaggccagaagatcatgtgtgtggcttgcgggtcatcccacagtgtggcgtggacaactgtggatgtggccatgccctctgtccacgagcccgtcctcttccagactgcaagagaccctttaggtgcttcctatttaggtaacacagatttgtatcctgagatttttctgtaggttacagcaactttacatttatttaattgtgccaacacattagaggttgtagtgctgcgttaactacattatgaatctaaagacacagaagaattatggtgtgcgctcatgtgatttatacatgctggaatgaaagttttagaagaaagtatgttgctgattcttgtgtttatgatcaggtaaattcacagcgctgtacttgtgtgtaaacaggactcctaataactgcctgagagatacaggcactgtactgggctcttttgtattttttaacagctttattcagttataattgacatataataaactgcacctatttaaagtatgcattttgatcgactttggaatatgtatgatccatgaaagcatcagcacaatcaaagataatgaactcatacactaccccagcgtttctctctggccctctgtacccctcccttttgcttttaactccctccttcctgccgtatgcaccaatttaatttctgtcactagagatcagtttgcatgtctgctttttgttgttgttgttttgtgggtgttttatttgtttgttttcttttttttgtagacagggtctcactctgttgcccaggctggagtgcagtggcacgatcttggctcactgcagcttccacctcctgggctcaagtgatcctcccacctcagcctcccaaagtgctgggattatgggcaggagccactgtggcaggccagtttgcatgttttacagcttactataagtagaatcatacagcatatactctttttaaaaatcttactttttccactcagcataataattttgagattcacttacgttgcatgtatcaatagtttattcttttaaattgttgaatagtatcttaagataaacaaatgcaatttgttcatccatttttctgttgatgaatgtttgggctgtttccagtttttgactatgcaagtgaaattgctaatggacatttccatacaagtttgtgtatggacatccacttgaaattctcttgggtaaacttctaagagaggagtggttggatcatatggtacgtgtatgtctagcttcttaagatcgctacatactgttttgcaaagtggatgttccagaggtccacatcctccacatttttgtcaacccttgatacattcagtctttaattttagttatactgacagatgtatagtggtatctcgttgtggttttaatctgcatttccctaataactaatgatctcaagcatcttgcttatttacaaatcacataccttttttggtgaatgtctgttcaagtcttttcccatatttaaataggttgttttcttactggtttgagagttccttatatattctgagttacaagtcctttgcctaatatagaatttgctagtattttctgtcagtgtggcttgtcattttattctcttcacaggtgaatcttaaagattagaagtttttaattttgatgaagcctagtttattcattttattcttttgtagagtgtacttttgatgttgtgactacaaaacctttgcctcaagattatgaagtttgtctttctatgttctgttatagaagttttatagttttagacaggtatatctatgaccagttgattaaattttatatatagtgggaggttcagattgaaaggcttttttgggcatgattgtccagttgtttcagttgtatttgttgaaaaactacgcttttcctactgaattgccttttgcctttgtcagaaatcagttgtctatggatgtatggatctatttctggactcccagtactgtttcattgatttatttgtgtattttggtggcaatgccacattgtcttgattactacagctttataaaaggcctgaactcaggttgcaacagttttttagctttgttctttttcaaatatattttggctgttgcaggccctttacatttccatatgacttaaaatgagcttgtcagtttttataaaaccgcttgcttgggattttgatgtggattgcattaattctgtaagtcaatgtgcaaggatggattcacagtattcagtcttctaacccatgaacatagtgtttctctttatttgttaggtgtccagtacataatgacacatgaagaggcaaaaaaagcgactaaaaatgaccagaaatgataggagagaaacagacccacaagggctccatatattggagttagaagacacagactttagtataataaatatgcttactgtgttcaaaaagataatatttcagcagagaaccaaaaactactgaaaataaaatagaaagactagaactgataaatccaatatttaaaattaagaacttaatgagtaagtttagaacacactgaactcagctgaagagaaagtaaaaatatctggaatgaagaactgaggagcaaaagtttagaaaacataacaagaaggtaaaagatctgcaggacagaggttaggcctaacacaagtgaaagaagagtccccccaaaaagatagaaaagagaatagagcagaggcaaaatgtgaagaaatactgaaagacagaattttccaaaacagacaacagatatcatgccccagaagccctaccaaccccaagaaagataaacatctccatgcacatgtaaaacctgtgccagatgaaaacaaaaagactctctgaaaagcagacgaaggaaaaataaaatgaaccacaattagacttccatccaacttcaggagaaataatataaaccaaattgcaatggaatactatttttaaagtgctgaaagaaaacacctagcaaaaagacttttcaaaaataaaggagaaataaagacattttcagacatacaaaaatagataatttgtaaccaacaaagacacatttttaaaaatattaaggggattttcaggcaggagaaaaacagtatagatggaaaattaaagaagaagaaaaaagtggagagaaattacaaagtatgcagaaaaatctaaatcaatattgactacataaaatcgtcatatgccctgcatgtattgtttgatcctttgacttgtttttttgctttttttgttttttgagacgtagtcttgttctgtcgcccaggctggagtgcagtggcacgatctcggctcactgcaagctccgcctcctgggttcacgccattctcccgcctcagcctcccaagtagttgggactacaggtgcccgccaacacaccggctaattttttgtacttttagtagagacagggtttcaccgcgttagccaggatggtctcgatctcctgaactcctgattcacccgcctcggcctcccaaagtgctgggattacaggcatggatcatgaggtcaggagatcgagaccatcttggctaacacggtgaagccccatctctattaaaaatacgaaaaattagcttggcatggtggcatgcgtctgtagtcccagctactcgggaggctgaggcgggaggaatggcgagaacccaggaggcggagcttgcagtgagctgagatcacgcgccactgcactccagcctgggtgacagagcgagactctgtctcaaaaaacaaaaacaaaaacaaaaacaaaaacaggcatgagtcactgcgcctggctgatcctttgactttttttgaaattttgtttgagcatatgacccacttagcatatgactggattttatgaacattttctatgtgcataaaagaatgtcttcgatagttctgttagatatatatttgtataaaatgtataaaattttggctggacgtggtggctcatgcacataaccccagcactttgggagactgaggtgggtggatcgcctgaggtcaggagttcaagagcagcctggccagcatggtgaaatctcacctccactaaaaatacaaaaattagccaggcgtggtggcaggagcctataatcccagctactcaggaggctgatgcaggagaatcgcttgagcccgggaggtgtcagttgcagtgagccaggatcgcgccactgcactccagccagggcgacagagtgagactccgtctcaaaaaaaaaaaaaattaaaaattaaaatatgttaagaacatataaatcagaatgaagataaatgatgttaaagagaactaaggtctttgcattgtttaggaggagactttactaaataataatagatttaaatcagtcaaaaatagatgttataattaatatcttcagtaactactaaaactaaaaatgtatataacacatacactccttatagacagagtgagactctgtctcaaaaaaataataattaaaaaaaaaaagtagaaaagttagctgagcatggtggcaccggcctgtaatcccagctgctcagcaggctgagacaggagaactgcttgaacccaggaggtggaggttgcagtgagccaagattgtgccactgcactccagcctgggcaacagagtgagactctatctcacaaagaagaaaagtgatatatgcatacagtggaatattattcagccattaaaaaggatgacgttctgacacatgctacaatacggatgaagcttgaagacattatgctaaacacaaaaggataaatcttacatggttccatctagatgagatgtctggagtggtcatattcgtagagaccaaagttagattcaaggttaccagggttggggtaaggggaagtagggcagttaaattgcttaatgggtacagagtttctgatcggagtggtgaaaagttttggtaagagaaagttgtgatggttgtgcaacactgtacttaaggtacttaataccctgaattataaacttagaaaatgactaagtggctaattttaagttaaatatattttgccacaatgaaaaatataataaaaggtatacaaattaaaacactcactctccatctaaccaattccacatgccacgcaactaaacacttactagtttcttgagattcttttaatgtttctttatggaaaaacaagcaaacaagcctagttattctaattcttccccgataccccatcctgatttttttaaaaagccagccagtcatcagcgggtaggaccgtcacttccgtctcactgtactcactctacagaattaccatatgcaaaggaaccttaaaataacaaattccagtacactgtggtccacaataagtatttcattaatatttggtggaagagagaatataaacattctgccatacctggttcatttattctgccaaatgtatgcctggtattgtgttttttggtcttgaaacacgtttcacaaaaatcaaagtcatcacagtttctgcatttgaatctggatccattgataggaaacatctgacatccatcacacctatttgtaaaatagcaactgagttaagaaaggtcatttattaaacttaattcaacagaaaaccattcgtcccaaagcaaatctagcaatcataaaaataactcacgtaaccccaggatgaatactgggcaccaactccatttctgatagcaacccagtccagtgagactgctggggaaagtcaacaatgatatcttttccattggcactgaaagccaggacacaacagaaatcacctgatccatcttcctcttcaccaataaaaacctgaacttaaaactgcacctagccatgtcatactacattgtagttatttgttttttacaaagagtctatcttttagagataggtactaaaatgcttatggatgaactaatatatgatgtcagcgcctggtttcaaaataatcacaagaagggagcatgaataattttggccatgaggcgacaatcgttaaagccaggtaatgagcacatggaggttcattgtaaactacattccttacttttgcattaggtttaaaataggacattttggtttctaattacaccaagtcaacaattccatacaatacctttggtatctcagggaataaaaaccacattaataacatgaagacttctttcatcctttgataagagcaacgtgtcactcaaaacaaagaaaccaaattcttatttttaaaatttgtcttgttttgatttgcaaatattttaacaatctcttaagcaaagaaaaatgtttaaagtaaaatattaaataatccacttgttcttatgtaacatgagaagctctaggaacctctcaccactggggaaccaccaactgtggccattttctaagcgatctgatgaaaagagaggcttccacaaggttcaaacgaacaaacaaataatctctttatgcatcaagagtttataaaactatacacatacttatttctcatgcaactgttaaaacggacatagtgtgcctttcaaagtgtgccacggatttgatttggaatctcaacagtatcatattaaatataatctgagaattgtttccagttcctaatttccatcattagcacatttccatttcttaaattcagtcctaaatttttatacagcatgaaaaagagccaggcatggtggctcatgcctgtaatcccaacactttgggaggccgaggtgggcggatcaataggtaaggagttcgagaccagcctggccaacatggggaaacgccatctctatgaaaaatacaaaaattagccaggcacggtggtgggcacctgtaatcccagctactctggaggctgagactggagaactgcttaaacccgggggcggaggttgcagtgagccaagatggcgccactgcactccagcctggtcaggggaggagaaagaaaaagcagtcctgacagtcaggagctggcctgttaatgtcaatgttaggccatttcacagaacaaatgacaggacaagtttacagaacacgaacatcagataaggccactctgtgactgatgaatcaaggcacaaccaaaacccctccttaaccatgtgtgattaaagttgagtctaatccaaaccacaaacaaccacacagtcccctatcctggtgatatgaatgactgcttccttaccaatcatgacgttagcatggctccattctttctgcctgctaggtaaatttattaagacatcctgttttaggattacccctgctttctcgacccctcccccaaatacccaacataaacttcattagtcctcgctcactccctctgatggagacacccattccccaaggtgtgtgttctcctgtaccgcaatgagttaatattaataaatctgattgtttcactgtaggtgagttcctttgtggcctttggcagaaggcactgacaagcaaaggaacactctatctctttcttcacacttgttttctgttttgtgtgcttgaacaaaaagaaatactaagtacatatgcattaatgaaaagttaacatcaggaatttaattacccagatgatattacctttcacaacccccacactctgatgagtcacagatccccatttgtattttggtgtggtgacagaggctttgacccgcactttatcaccaatcttgatgtgagaagaacttcttggtggaggatagcctacagatttcaataacaaatcattataatcagtattcatttatgggaattctgtctctaagaaaaagtaaaagcactaaacaaagaatgtgctcacctataagttccacatgaatgtacctaaaccagtagatgccccctttctgctgccagtcacactgcacattgagatcatgcaatccatctctgtccagcttgatgactttgccaacatcacatcaccttcgcacacttcttcgtatgttcggcagcatctaaccatcattcccacctagaattaaaatgaaattggagatccagtccatcatgtacacaggtgaaatgagccatgataagtagtattactctactcttaataaagaatttcaactgggcacggtggctcacatctgtaatcctagcactttgggaggctgaggtgggaggatcacttgagctcaggtgtttgagacaaacctgggcaacatggcgaaacccacctctaccaaaaatacaaaaattagccagatgtgatggcacatgcctgtggtcccagctacttgggagacttgagttgagaggattgcttgagcctggaaggtggaggttacaatgagccaagatcatactactgcactccagcctgagtgacaaagtgagaccctatctcaaaaaaaaaaaaaaaaaaaaaagaatttcatctagcacccagagtgcattctaagtattatttaatgataaagggaagagaaactctttagaacactgtctggctttgtgtctcaggcaggaaatatacaggaagaggctggatcaacttgtatcataaaggaagggagttttcaaagattactcaaaaggattccctgatcatcaaaaatataacagtggagacatcacaccctaaaagccaatggattggtcatcatgacaataaggaaaacgaagcttcctggtcatctttatacatatcagaacaccaatgcatcattgtgaaaactgatgaagtctccctgtattatcaagagcaaccaagattaataacaaagctttttttcacagaagagaattccagctaatgaactcagagaagatgaagttagaaaatcactatggtgcagcccctaatgataggtctaggtgatgacactaatgcctgctggagctatgagatggacaattaatacagaatgtcatcaaggaaggagcaggctgacaagacctaacccacccaaacctgcttgcctgttgagatggggccggagggagtacatgcctatgaagcttcctgcctgagattcagcctggtccaatcaccctccaaccctaactcctactgcattggagaaacagggagagaggaagatgttagccacaaggaagccacctccaaatgcagactgtaagacatttggaggacatggtttcagccacaaataaatagcatgaaaggagaggaagggagaaggagggttactatgaaatgaatgtttgtatcccccccgcaaaattcatgaagtcccgactcctaatgtggcagtattaggagatggggcctctaaggaagtcattaaggtaaaatcaggtcataagagtggggctctgacacaacaggattagggtctttataagaagagactccaggatgggcatggtggctcacgcctataatcccagcactttgggaggccaaggcaggtggatcacctgaggtcaagagttcgagaccagcctgaccaacatgaataaaccctgtctctactaaaaatataaaattaaccaggcatgtggtgcatgtctgtaatcccagatacttgggaggctgagacaggagaatcgcttgaacccgggaggcagaggttgtggtgagccaagatcgtgccactgcgttccagcctaggcaacaagagtgaaacaccgtctcaaaaaaaaaaaaaaaaaaaaaaagacaccagtgctcccctgctagctccagctccccccatccccagccccacgtccacaggaggacacagcaagaaggcagccacctggccgggcacggtggctcatgcctataattccaacactttgggaggccaaggcgggtagatcacgaggttaggagatcgagaccatcctggctaacatggtgaaaccccgtctctactaaaaatacaaaaaaattagctgagcatggtggcgggcacctgtagtcccagctactcaggaggctgaggcaggagaatggcaggaacccgggaggcggagcttgtagtgagctgagatcacgccactgcactccagcctgggtgacagagcgagactctgtttcaaaaaaaaaaaaaaaaaaaaaaaaggtagccacctacaagccaggaagagggccatcaccagaatccagccaagctggtaccttgatcttggatttccagcctccagaaccatgagaaataaatgtctgttgttgaagctgccagtctatggtactgtgttatagccaactgagctaagacaagggggaaccactctagcttggaatagacttcaaagatccatcaaccaaatgcagataaggcatacaatcttggtttatccaagttcaaaaactaaccattaaagccatttctgagaaaactggaaaactacaagcaagcgttagatatgagatgatattaaggaattattatttattttgttaggtaatgctggtaaacagaaatgtcattatgttaagattctttattagtgatactcactgacatatatacaggtgaaatgagatgatttgggggattttctctaaaatatactaaaacaagagaattaggacaagaaatgatttaaagtagataaaggactatataaaacataattagatttttaaagtttgatggcaatgagaattacataagaaaaacaaggaaaggtatgtaggaagtgtcacaagtggggctagtagaaaacagccatccctgcgccatgtccaccgtggacaggccacttgtgctctccggctgcccctgagcccatctgcccctctgtcctctggctacaccggggcagccacagcagcctctgtctgggtgcccatcctgctcagccacccttcacaccctgtaggctttgcacccatctcaccttctcattgcagatcccgatccctggactgtgccctcactcccacccctttactgtagtctgctctctctcattccagggtacacagcaccttctagcgtaccatgagctcactggtcaggtatgtcttccagcaccagaaggcaggctccctgagggcaggggcctctgtccactgatgtttggcatataggacatacccaaatatttgctgagtgaaaaacggatcgaggctccagcttaagacaattactcacctgaatattctctctcacatatacagcataatcatcattacccaagaaaccagctcggtttttgtacgtctggctctccgtcacaacagcaccagtagactacaagaaataaatacattcaaagaaaaaaaaaaaggagaactcaataaatctactcaaaaagaaatgtctgtgaaatctataatattaaaaagtaaaggatgaaatcctttattttctctataaaaatcttcatttaaaaaagactaatagcagtagcatagtaggcagaaatgaatctcaaaagctacaagtatacaaaatttccaaggcacttccaaattaatcctatgaacaatttactcaggtcagaaactgatgtgtcaaaacatggtattttaataaaatatcctctaatggctaccgaagatcatgagatgtttgaacaagggtctgttctgaagctaaaagtaattatgatatagaaacccaatcatcccttcagtagtgaaacacagctttgttctgtgcccggcaacaccataggttggttttatgaaacagtccacagtagatatagttaattctttcaagggacagagaaagccaaggtgtaagactgttagagcgctagacggacagcggcccaggtgcgggcggtcacatgggaggcactgaccatggagtaggcggcatcatccatgtcctccaccacctcctcgtcagaatactcgtcggacaccgtgtctgcatctgagagctccgtgacctgtatgtcggagtggtccagcagccacccgaccaaggcttccacacctaagagaggcacacacagcacaccagccactgtgagtcaacagccctgaagcgggaacccacacacgtacaagcagaggccaggaaaacgaagtaccaggcaagccggacgcattcccggaagcaccagtgagagacttcagggcaaactcgatgttccttctgggaaatcccatctccatgagctgcaccacgatcggcagagcgggaacgggtgactgcttgcgcctcttcactctggcagggcggatgtgctgcacgttgacaggcgtggtggcctcactggagctgcagtcttcaaatcctgggctcgaagggtgagtggactccacaacggccagtgcagcagtctgggcagacaagagggtcctgggaggtttgggaagtgccctcggctagcttacacagtctaggaacatggggcatcatgcaagtctagaaagcccacattcacatgtgcgtttttcaatgagttcctaaaacatgttagaaaatgacaaagccaagtttcgcagtttaatgcagagaaaatacttggtggtaaaataacttgcctgtttcagcagacagagagcctactaaattagccaagtatcaatgtccattaaggaaaacttcattacagccctaagcgagcagtcacaggggcttgagggagcagggagaaaggcatttcccctgccttaaccaggcactgtggtggcggccacaggcacctgtgttttagacaggccagaaatgacacaggactctcatgtaccattaaaacaaccctcaactattcaagggttaaataaccacagtgaggttaaacaaggtattaaaaagtaagagaaataaaagagtattagttgggaaacacactgcaatgaatcagtgaacatctaaactgccagtctctacagctgggaactccccacctacagcacaaatagcacttccctgatctgtctgcaactccctggtcctcctccccagctgctctcatagcactgacttgctattttgttaaacggagcatgtgaggaaggaatcaggaagaaaccgaggacactgtggagccccccggtgctcaggaagtatcaaagcctagggttttgcagcgaagtctgggtaacttggaagtgacaggtttcatcctaaaagtttaaaattcagagccagattgagccaagagttctggttctgataatggggagttagggtgcattggactaacccttggctgataataatcatgaactctggataaaatattttttaaaactgcttgagggcactggagaacagctgacgcaatcagcaataaaacaagcacaacccctgaccccgagaagcctgcaggtaagacgcgcatttaaccacagacggcgcaccttcctgcactgcaggggctggggtcccggcctgccagagcaaccagaatgtgagggaaagcccgcctgagaaagaaaccacagagggaaaaccacgaaatatgcggacggactacccgcaaatctacagctgaatctaaactgaagcaccactgaagagcctgcgctcggcacaaagggaccgctggaaggctgcaggggctccccagctgcccagggccaggacagcatctgaggctcaagctcaaccaactagaggtggggaggagaatgtcaaggcttccagtgacgcccagaagagattctaaatccttgagaattaaggatccacaaccagggctaagggcaaataaaaaatcattagaaagcctggcaccaagccacctcaggatcaaggaggactgccaggtactgaactgcctgtgagaagaaaactccccattctccagaggaggcagaacccagagccaatacaatgtaacgtccaaagaatccagaatgaaataaaaattctcatatgtgaaggacaacaaccaataactgactataatcaagggaaaaaaactgcaaagagcagcagaccaacaggtgggcagatgttagaattagcaaacaagaaattcaacataactatcagaaatatgttttaaaatgtacagcaaaagatagatttggccaggcacggtggctcacacctgtaatcccagcactttgggaggctgaggcgggcagatcatgaggtcaggagttcgagaccagcctggccaacatggtaaaaccccatctctactaaatatacaaaaattagccaggcatggtggcaggcacctgtagtcctagctactcgggaggctgaggcaggagaatcacctgaacccaggagtcagaggttgcagtgagctgagatcacgccactgcactccagcctggtgacagagcaagactccatcaaaaaaaaaaaaaaaaaaaaaaaagatagacttaaaggatgaagaaaggaactgtcagaagagatataaaactattaaatgagagccaaatggaaataagagatgtgagaaatataaaataaagtatgtcttggatggatataacaacagattaggcccaacaaagcaaagcatcttgacctttcaaacagatcaagacaaactaaccaagctactaacaaggagaagaaagactttctattaaagtcataaaaggaaactcactaaccgtgtaacagatgtataatagtatttccagaaaagaacaaaaagagcaagacggggaaaaaaacagcagtcaaaagtttccaaatttggtaggggaacaaaaatcaagccaaagatgcaagcagcttaaataaatttcaaggaggatggtggggtgggcggggtgggccaccattgcatacatgagcccagcttagggaaactgcagaaaaccaaagataacacaaaatacgaaaagcaaccagagaaaacagacatttcatacaaaagaagagatgagaacaacgactctccatcggaatccatggagacaaaacagcggaaggtctttttttgtacaacagtccttctcagttcctgaagaacaactctacacggccttctaggtgttcacactcggcatctcccagcatgactgcagggagcacgtgcaccgccccacgtgctctcaagttgctcagcgtcttttgatctctgccagggagactggaaacacaaccaggccctttaaaatgaaccttcaccttggaggttcccagacctgagaagaagctggagttcagaagagctcatggccaacctcctcccttcctgcccacacccgtttcttgctttctccctttgcacccccaccatctttccagctcgttctaggattgggggaggcctcccacctgtccaaggcagtggctgcctcatctggacccttgctcccagaagggccctgctatctgagggtttctgttagggtaatttctgattgccaaactgagtactgatagttttatttttgtctctgatattttgtccagatttttaatgtattacacagcaagaaagattttggaatgaacatctctaatcctctatgttgccagccatgaaagctcccatccctcttacactcaatcacgtcgcctcctctatgcgaacgtcccgtagccctgaccctgtgcctcgctgctgccctcacctgctccacagcatggagagagcggagaggctggcggcaccagagcacccccaagaggctcctgagtgaatgaaacaaacggctgccagagtcctgacgagcctctttgaataattctacttcctggaaaaagatcccttcatgaagatgtgagcgtttaacccatgctgcatctagttaatattttttcacaatttacacaaacccaaaataaggttaaacttcaaccctctcagtctttagtattataatgttctgcagactatgcacaaacatggttaaaccccaatgaatcattagaattatttgcgtactatcatttaacattcagaatagatccttaagaaaatatacacctagaaaaaaagtgttcacaatttagtgctgtggattaaaaactgtcaaggctgcatggctgtacctcaagttcctgtttatcaaatatggccttcacaggagacggctgggtggccgaggccagcagctgctgcaagaggatcatggggggctgcggcccttcaggagacatgtccccaaggtcaggtgataccactgctccatcatctgaatttaaaaacaaaatatgtgtaagattctattttcaactgcgaacaccactttactattaaagaaaatgcattaagcatgttaaatcaggtatgacttctgcctcattatgtgatagaaaaccaaaatcttcaaggttcagacatcgaacaaaaactagactctaggttgggtgcggtggctcacgcgtgtaatccctgcactttgggaggccaaggcgggtggatcacgaggtcaggagatcgagaccatcctggctaacacagtgaaacctcatctttattaaaaacacaaaaaaattagccgggcatggtggtgggcacctgtagtcccagctacttgggaggctgacacagaagaatggcatgaacctgggaggcgtagcttgcagtgagccgagatcacgccactgcactccagcctgggcgacagaccaagattcggtctcaaaaaaaaaaaaaaaaaaaaaaattagctgggcatggtggtgcgtgcctgtaatcccagctactcgcaaggctaaggcaggagaattgcttgaaccagggagttggaggttgcagtgagccaagatcacgccactgcactccagcctggcaacagagcgagactccatctcaaaaaaaaaaaaaaaaaaaggaactagactctaaaccactttcactgcctgcttttggtctctgtccttcattagtgcatctgtctcttagagccagcaaatgctccttcccagatttctgcacttggtctgattctttctctttttcttgagatggagtctcactctgttgcccaggctggagtgcagtggcacaatcttggcaaactgcaacctctgcctcctggctcaagtgattctcctgcatcagccttccctgtagctgggactacaggcacatgctaccacgcctagctaatttttgtatttttagtatagatggggccaggctgttgattagatttcaccatgttggccaggctggtctccaactcctgatccacccgcctcggcatcccaaagtgttgggattacaggcgtaagccaccatgcctgacctacacactctctttcatgttcactcacggcttcagtaacccctgacacagacacatcccacgtgcatatttctagctgtagcttttccagctaagccttgttgagatcattaagtgaccccaagtccaaatgtgacatgtgctcagggtgatggctttttgtctgttatgagtagctttaggtgcagcctttaggactctgtttgacacagccccagggagatccactgcgctcaagcccacttcacacatctaggtactcatccaggtactcacagcatttgcatgtgctggttttcttcagtgacaatttcaactaactagaccaggagctggaaatctttctcttaaagggccagagagtaaatagtttaggctgatgggctgtacagtctctgtcccaactactcagctctgccattgcagagcaaaagcatccagagacgatgtgtaaacaagtggtgtgcctgtgttcccataaaaatttacaaaaacaggtgcatggcagttttgtcaatctagctctgttcggagtccctgctcggcccaaagcacagacttgatcatcctgattcaggtctgctgtaattgctcatcgggctgagtgcagaacagaacagccaatccaattcccaggctccaatctcccaatctctacaactgggaaatcttcatgttccctacgacctctactattaattgattctatactttcaattgatttctttcatcctcagcaggtttaaaattaatttcatagcatcctctcctcttaagaagcaaacgcacacactccacattctactggacttgcttatttgtttcaaacacactactcaatattcctccctcaactcaagcttgaaacagcagtcaccttccactttttgctggttccccataaagttatcatctacaagactacaccatcacagtggatggcaccttccttccaccagaaccttctttcccttttcatgccttccccctcatcacctgacgcaggagcaattctccatctctgtcatctcctgtttcagatactcctataccttcctagcaggtgtatcacccgaaggtcaatgcttaccatgtggcccctaccacagctttccaagtgggcctcaagtttcaccctggtctcccaggtactctgtaacaggatgtcagctgcccatctagcttcagccccaccactcatcgaaaaaccctgagctccaagaagaggagagctgctcaacgtgcttccaaagactcaccacgttcactcctctcctcctgcctccaccaccagcagagtgcttgtctgctggcatctgtctgccacagccttcaaaggctgcccgtccagtgctcagctgccactggctccagacgcctgtggaaccactcacatgcctcaccgccccctggccccagagaacaaagagagccatctgcattcacttcctctcctcatccaaaccctagagagcaatgatcatagaaaaggacttctccgcaaaagacttagcataatgtctttcaatagttggagatcaaaaaatgtttttttctattaaaagtaacacaagctcattctagaaaactaaatatagagaaatataaagaaaataaagacagccaaaattccaccaaagattactgggtcactgttttgctaaacagataactatggcatatctataaacggatatacatagcagtgtgcttttctgttcacttactgttttcatgtttccacagcaataaacatatacagctagccctccgtatccatgggttctgcatccaaagattcaacaaaccacacatcaaaaatattcagaataaaacaattttttaaaatataattttaaaaagaatagcaataacaactatttacatatcatttattttattttatttttatttatttatttatttttttgagacagagtctcgctctgtcacccaggctggagtgcagtggcacgatctcggctcactgcaagctccgcctcctgggttcatgccattctcctgcctcagcctcccaagtagctgggactactggcacccgtcaccacgcccagctaattttttgtatttttagtagagatggagtttcaccgtgttagccaggatggtctcaatctcctgacctcgtgatctgcccacctcagcctcccaaagtgctgggattacaggcgtgagccaccgcacccagcctatatatcatttatatttttaaagtatttcggaggatgtgcataggttatatgcaaatactacaccattttatagaagggccttaagcattagtgaattctggtataactgggggtcttggaactcatccccatggatattgagggaagactatacatgtaccatcattttgaatggcaccatgatatcacactgtacggatacacaacataagaatgggtattttggtgtctacagtttttcaatacaaaaacaataccaaaaaggaggccataacgacactgttgaatacattatttttatttattattttttttgagacgaagtctcactctgtcacccaggctggagtgcagtggcacaatctgcaccctgcaatccgcacacacggcaacctccgcaccccccggttcaagtgattctcctgcctcagcctcccaagtagctggcattacatgcagccaccactatgccccgccaattttttttttttttttttgagacagagtcttgctctgttgcccaggctggagtgcagtggcgccatctcagctcactgcaagctccgcctcacagattcatgccattctcctgcctcaccctcccgagtagctagaactgcaggcgtctgccaccttgcccagctaatgttttgtatttttagcagagatggggtttcaccgtgttagccaggatggtctctatctcctgacctcgtgatccgcccgcctcggcctcccaaagtgctgggattacaggcatgagccactgtgcccaggtggtgaatacattatctttacatgccttttcgtgtgataaagtcccacagaatgacttgctgggccaaagtatataaatacatacatacatctatgcatttcaaagtccaactcatttcctcagacgcccattagatggctacaccaactgaaattcccagcagcagcctgttcatggagtgcggctttacgcgcatttgaagaaccagcttaggttcatcttgttacaatacaggctctatttctttggtctggggtgcagcctgggagtctgcatttctaacacatacctgcgtgccaccaatcttgctgacccatgcagcacactttaaatgggaaggcatgaaaatacctttttccctccccacccaccagatgccctcagtcttgtcttataagatgacgatgacaattttattcacagttggtggttgctgggcaggccacgtgtctgttttgtacatttataagccacctatgtccatttttatgaactgattattcacttcctttgtctactttctactgcccttcttataaagatttaagaactttttaaaaagacacctgtgtgaacagttccagtctcctgaacagctggctgagacaggatctgccgcagtttatcctggtgggagaacagcgcccgacctgctttcaggatgtatagcttcaactgctggcgccgcagcaggtccaggtccacttgtcctgcggaaggaaagactcagtgagaagggcgtgccctgctcagactccctcctcgccagcagcaagcctccgccacatggcgacgagtaacgctctgcccttcaggaatctgccgaccgcacacactgtccgtgacgaagggcttgcctttcccagagttacactcggtgcttctgggtaagcatcttctgcctcctgggtcttccttccctgctctccaggcacctaacttgataggacgcaggattcaatgggtttaacacggttagaaccatgttagctactattaatatgatcaaatgttccccaagttgctgaagtttcagccgcttccactcttcttctaagactcctctgagagaatctgtcagccccactagctctttaactgatgaagatcgcagcaatgcccaaggcttatctgatagcagaggccgcagaagcagcacagagagcatggggtgggaaggaaggagggccgcaggtgccgctcggacactggctcaactaactggcagacagttttattcaccacgatgggaaacggcagctactagagaatgccagccagctgaatttcggacatgtggtgatttgcatgcactgcacctccaaccagagatgtgaatgggagatccagagttgaaagtgcttacatcataaatgctgaagcagcaatcgtaggtctgtgggagcaagaggggagaaaactcaagaagactgggcagaatacgccatagttatgggtgaagccacacagacttccaggacataaagaatgagcagagagaagagctccctagaaacatggaaacaaactcaggagaaccgccttctagacccgaaggaaggcaaagccaagccaggctacagtcacagtcttagccatcctgaatgtcacaggcaagccaggcgcttccgggacagaggcccctggatccggcagagaacaggctgtgagccatggtccaacagggtgacggggccacagggccctgggatggaggggaggagggaagaggtgaacagacttctcttccgggataaagggtgacacggagaagagggtgtgagccatggggttcttcaagtgtggctccgaacatggcgacaaaggctgactcgaaaatactcattaccacgaacacagggttacattcccaaccgcaactcaacaaatggtgagcccacgtgaaccccaggactttagtacgtccgtgaattcactcataaaagaacactgtacaaaccacacgagtttaagacggcagctatttcatcaagaagcgccatgtactgacctgcaaaggcctgtttagtcgatttctttattttgtgcttttctaacttgcttccagcgaggttcaccaactgagcccagacagacagcatgggctctgtgaagggcaggttgttcacattaaaggccacggcagggagctggagaggacacagaagctgtcagagtgtggccaatatgactaacaaatgaaacgttctgaaagtcatcaaaaccatgggcttaatcctgaaatgccacacatacccgtaagcctttttatagctgagaataatcattttttaaaatgacattaaaggcaggatagagatttacacatataataagtataatctatattaatttttctttacaaacctgtcaacaataattacatcagtgtggtggttactatcttctcagatattttctatatacttcaagttttctacaacatgtatatattcctataataataaaaaagagtactttatagaaaatatagtcaggccgggcacggtggctcacgcctgtaatcccagcactttgggaggccgaggcgggcggatcacctgaggtcaggagtttgagaccagcccggccaacatagtgaaaccccatctctactaaaaatacaaaattagccaggcgtggtggcacacaccgtaatcccagacactcaggaggctgaggcaggagaatcgcttgaacccgggaggcaaaggttgcagagggccgacaacattgtgccattgcactccagcctgggtgacaagagcaagactccatctcaaaataaaaaagaaaaagaatatatagtaagattgcacttgggctacatcaaaataatgtaaatggctccttctccctgtgcatccttgattcacagattaagatgacagtagctgctacattaagtcacgtcactcaaaactactaagcattttctacatgaagaaaggctgtttttttaaaggtgtttaaacatgtttgtttttttaaaacttgagttgttgaataaaaagtaaacttcataaattcacattttaaaataattagaactacctcatagatgcacggtaccttctaggttgctaaagccctcttcgtgtctctgaggctgaaatacacacgaaccactgctttaagtgccctgtgagacaggccctgcttaccacagaagcacaagctcgcacagcttcctggaaggcaaacttcaagtaccagaatcaagttctttcaagtgctgatgttggtgctcggttctagtgtaaagtcaatttcccttatcatgcagtaactaagcacaagttcacctactggtttcagctgattcaatgggcaaacgcgacacgtccgcatgtcagagaactgcacggtgattttgcccttcagggtgatgcgagtcatggtgacttctccaaagtcatcgtgcacaacttggccgcccaggcacaggcgaccatcgatgcctccaaccacagccaggaccgccatgaggccccccacttcagggttctcggaatcagggaagtagtcatctaactgggcctagtgcagaccaaacagcgagctcgaccggggacactcacggagctgcccaatccctacaggtttactgttcaactaaattaattctgagaacacaaacccacccctttggaaggccttcccgcaaagctgtgggtgatggagcggagctgggagttgatgtacttgttgatgagcccattccaccgagtcagggagtgcagcgtgtgcagcagtgccaccacctcctccgccagtgtgctgctgtgggtggcagtcagcgaggcctgcgggcacaccctgcgccgcctcagcgtggactctgaggaggaaaccaggggagaagctgctgcaccactcttcaccagggcacagggaagggagacggccactcacctctgagtgacggcactacacggctcttcaccaggacacagggaagggagacggccacccacctctgagtgacggcactgcaccgctcttcaccagggtacagggaagggagacggccacccacctctgagtgacggcactgcaccgctcttcaccaggacacagggaagggagacggccacccacctctgagtgacggcactgcaccgctcttcaccagggtacagggaagggagacggccacccacctctgagtaacggcacgtcagaggagcacatagtgagcaagctccccaagaagtcaaacagcttctccatgaggcatttcatgtccctcaccctttcggtcttgtcccatgacggaaggactgcttgcaacaaatgcacagctaagatctgataaaagaaaatttaaaatgacaagcattaaaaaaaatctgatgaggaaactacagattgttattttctttttttttttttttttgagacagagtctcgcactgtcgcccaggctggagtgcagtggcacggtcttggctcactacaaccaccacctcccaggttcaagcgattctccttgcttcagcttcctgagtagctgggattataggcactcaccaccaagcccggctcattttttttggattttcagtagagacaggatttcactatgttggccaggctggtctcaaactcctgacctcatgatacacctgcctctgcctcccaaagtgctgggattacaggcatgagccactgcgcccagcctctctttattttctgttctcataatgcaagtaatcatgtgaaaattttgagattcattattttacagccaggtaattacactcaagttgattagtgattaggattgtcagggactttagaaaaaagcaacattacagatgcatgtgtttaattaaaaaagaattatttttagtttaattcttaagacaattacactacaaattctgtgaagcagatgagtaagtagttgcaggatttaccacttaagagaaaagcaggtaaactgaaggttagcaacttaccaattatcaaggacctctgccccttgcctccagaaaatctaccctgtcacttctagaccctttctgcactcgttacggaataaaggcccctgactctgagggcagggaacttcagtacatggaggcctctctcagggaactggttttgcctggcagcacattacctgcctctgcagcgaggtggcagtgaagggtgcgtgcccttccacaaccttcatgagcagcgtgatccactgcggggagctgagggcgccgcacacctgcagcgtgagagcgatgctctgcacaaaccccagcgtgcaccagctccggtgttgctccctgtacaccagcctgtttggagaagctgcgggagggaaaatagacatgcttggtaacaagtccctaaagacaaatccctaaagatatatatatccttatttttttatcaacttattttctacaataagctcctttaaaatatattgcagtttgtaaattaattcaaactaattcaaagtgagaagtggaaggcggcttttaagttagttcaagaaacatttccgaagttttcttttttttttgttttttttagagaagggccctcactgtgttgcccaggctggtctaaaactcctgggctcaagtgattctcctgccttgccctgccgaatagctgggactacaggcatttttaaaaccttctaagtatgtgtcgtaaaagtagttagggaattttagctatgcattgtttctaggcaataggaaaatgatctataattcaaatagtaatttgcaacagtgcatctattatatttttaatttcgtgttttaaatatctccacaatcttggttatatttaatctgcaccacttaaatactctttttgtaattttagtagagacagtttccaatccaagtttaatgcatctgcattaacaaaatgagtttttcactaggtttacaccactggattctggcaccagtgggcccacctctgctccgcctggctccaggactccactactccctcaatggaagctgaggcttggaggctgggccccctgagggaccccgcccacagccccacaggacctgctctccctcccacctcccccaccctgccctcagctatccaagcttatgaggacacctgccttccttcagcacactcacatgcgctcacacacacacacacactcactctcacaccctcatatgcatcctcacactcacactgatactaagttattcagacacactcatgggcactcatacacccaccctcacactttcaggtgcactcacaccactgtcgcaatcactaacacacacacaatcccagtcacacgtatgcacaaacagatgcaagctgacacacactcccatgcactctcacatacacttacccctcccaatgcatacaaaaactcacatatgcactcacactcctcaacactagtaatgaccgattactcacccactcacacctttacccacacactttctcactttacactcacacctatactgttataacctcccattcactgacacaagcaaaatgctcacattcactcacacgcattcacaataacatcactcgtgctcacactgacacaaggcactcatacacatttacacaaatgctcacactcaatcgcacacttacacttgtgcctgccacccactcatacttcctcacactcaccaaccctcactgacttacacttacactgggtgtctcattcgcacacccagtaatcccctcacactcacactcatgcctccctcgtgctcaccctcacacacacacattggctcaatgcaccgacgctttcactcccacttcacctgaatgtagtcacctgcccactcacatgctctcatggacatacacacacccacacaaccacatgctacaaacacaccatcacacttgcaacacaaacgctcagccacttgcccatcgaccgctaacacactcactctcatcaatatgtgcggacgctccagcacaccactaatacacgcatgctctcacacacactggaggacgcccacatacccacccacactcacacgtgctcactctcagtcacatgcacactcaccccactccctcagctcacatttctcatacttactctccacacacacaaacactttatggattaaactgtgcctgtcctccaacttcacatacattcggaacctcagaatatgatcttatttaatgaggtctctgtagacgtcattaaggtaagaatttaggtgacatcatgttggattagagtcaaagaaactcaatgaaagagtcctttcagagacagaaaaggacatgcagaacacaggggcaggggccatgtgaagacgcaggcagagactggcacaatgcgtcccaacaccaaggaagcctggagctcccagaagctggacaaagtaaggaaggaccttcccctagagcctgtggaagaagcatggccctgcccgcacctggatttgggacttctggtctccagaactctgagagaacaaatttgttgtttgaagccagtgttacgggttgaattcagaattgcaaaattcgtatgttgaagccctaacccctaccgtacctcggcaggtgaccttgtttggaaatagggtcgctgcggatgtaatcagtttgatgaggttgaatgatgtcctcatgaaaaggggagatttggaggcgactcacacacagggagaatgccatgtgaagatgacggcagagataggggtgacacctctacaagccgaggaacgctaaagagaccagtaaactccagaagctggggcagagccctgaagcagcttctccctcacagccccagaaggaactacccttgatctcagccttccagccaccagaaccgtgagaatttctactgtgtaagtccccaagtttgtatactttgttacagcagccacaggaaaggaatccacacacatccacacccacccacatgcacacccagacacgacaagcgtgcggcccccagcgctgactccctgggccctcgatctctcattccatacatgtcttgtccgtcgttccgctttccactaacattcgcagcagtccgcataaagtcttggtggcttcactctgcatgatctcagcatgaactccagcagacagacaaagagtctgcagtaagttaatagtgctggtaaacatcattgcagtggggtgaatgttcctttcagtttgttcggcttctaaaaaaaataatcaaaattacaaattatattggcagccccagcctcttggatggtcttaccaagcccaaccatgtgaagcttcacgtgttttaggaacagctaagaaatgtcacgaaacctcctcccacaacctggatctccacagataggatctagctttcttggtccacccctaaattctcacctctgcttccctagaagcgataaagtgctgactaactccacattacatgaagagttcagagtcagggaccacagaggaaaggtaaaggcaggtggcaggtggggtgtgcttgggcaggggctctcactggaggaggacgcgatggaccgagaccgcagggcaattccaccaggcctcggctcactcgctcagatgcaggctcagcaccaaccacatgagactcactggtgatgcagctgcccccacctggccaccacattctcaaagaggggcgggtgcacacatgagaggaaaatgcagaaagtcagttccagccagatcgccggatcccacagtcactccacacacctgcatcggaggtgcctgggagcttatttaaattacaggttccgaggacagagcgccagctgcaggtgtgtcctgacatcccattctaaggcccagatggcagtggcagcacccagcaactggacagtttgtaggctgccttggactaaacaccttcctgagtcacccaccagagtcgtcctctgtgtccgaatcctctgctgagggctgtgcaggggctggcagctctgccagcttgaggtcgtattttccttctttccccatcctgtaggagttggtgctgcctgtgtcccactggactcttatccacccgtcctctcccagctcaccaatcactcggcctaggcctggaggaggcccatcctgagaaagccaaagtagagatcagttaggagggtgcgtaacctgccctggtccttccatggctcccagcagacctcagttaggagggtgtgtgccctgccctggtccttccatggctcccagcagacctcagttaggagggtgcatgccctgccctggtccttccatggctcccagcagacctcagttaggagggtgcgtgccctgccctggtccttccatagctcccaccagacctcagttaggagggtgcgtgccctgccctggtccttccatggctcccagcagacctcagttaggagggtgcctgccctgccctggtccttccatggctcccaccagacctcagttaggagggtgcgtgccctgccctggtccttccatggctcccaccagacctcagttaggagggtgcgtgccctgccctggtccttccatggctcccaccagacctgccacacagatgtcgccatatgccaccctgtctgtcaggggctgtccccagacacagatttcacctctcctacaaaatgtgtgcttgcatcattttaaattaaatggcataaaataacgtgctcatgctgctttaccaaggaagtcggggaaatctcatctcaatgaggatcctctgagtcaatgcagagacagggctttgcagcaagtcctgtccccacaatccctcacgggccttgcaagagcggaaacctgaaacaagcaccagcacctccacattccctttgcttcagtttcccctgggccccagggggaagctctgtctctcacttctgcaggagaaagctgtttctaggatggatgctgtctccagacactgctatttctaagatgactgtgacaaagccagggcttaccagcgtggctgagaaaagccagacagaccatgggaaggtgaacactgccctaacttagctagggctgtggtaagtgacttccacctgggggcacctggcagagatttagaagagacctgcgatgagggaagatggaaacgtggccacaggcccatgaagtagatccctaactactggcttcagggcacttcgcagcacatggccatcagcccacaggggcagcatctgggcttcctgcctcagagccttcactacaccaactttcagaatgagatttactctcttgctcactctcacactcttgttccagtgacccatcaaactgagcctcatgccagtgagtttcctgaaaagagctgcctctctttccagacttgattctgctcagatgccctacttatgattccctgtttgtgttcactcccttcagctgctcgggaaccaacacctgtgtcatcgatcaactgacacatcctggattattccaatttccacccaccaatatcgtacagaactatgcagaagataactaatgtgtggctaatgtgttcacatcaaatctctgagtacctgatcgccccatttccagtccacacctctcatgacccttgttccaatcttcatcatggcagccagttctggccctgaaacagggagctgcacaggagccgtttccttccttgtttcttccaaaactgtggcagaagcaccttgggcagaagcattcatatcttcctcaacgctgtcacaactggggcctgacggagcgtcaaaaacaatagctgagccaacaagtagctacagtgtccccttaatacacacaaaacattcacaaagtactaatgaagatcgtaattttgaacaatccatactatatgttttatcaatataatattatgaatattttactgatataggataaaaagaagataaacggaaggatgaaatacataaatatcctaggaagatataaaagatattaaaatgctcagtaaagctactttctctacttctaggaattactcccctgaaaaaagcaaaataactgagttagaaagatcctcatcacattttttattaatagaaaaacaaagataactacctaaatatctaacagtgggaaactaacaaactttaatcatggttctgtgcagaagacagctaacagctggcccgagatacaacctcagacagggttgctgcaggctggccctcagctggagtctggatctcaggagggctcccccattccctaggtggtaggtgtggttccctgtgcctgaactgtctgtacaaacaatgtggtctgtgctgaaacctgctttccttagtctggaacttggtacacgccaggcagggggtgcccgtgtgatcagtcctgatggaaaccgtgggcctggagtctctacccagcttcccggcagacagcacttgacacggctcggtgccagggcagttaagctcgtcctgtgtggatcctgtggaagcttgtacctgctttcctctggactttacccatgtcctttttcatgattttgctctgtgtcccttcactgtaataaactatagccctgagtacaactacatgctgagtcttgtgagtcctcctggccaaccatcaaacctgggggtggtcttggagacccctgacaattggtgccctgggtggctacagagtcatccgtagcacaaaacagaagccgagctgctgtcacctgagagaagtaaaacttcccaatggatctgaaaataggagcgctaaccctaggagagtaggctagatttttaaccccccttttcccacttgctaaactgagagggggtaggagtgtggttctggtaactcccttgattttagttttctcctccaggtgggagggaaaaagatccaaacagtcccaaaggtgggctggggtggaccaaaaaatgtaaaaagtttgtgtttctctctcttccaagagaacaaaaaaggatattcaattcccagggctggagcaaaactttagataaactagcaggagaaacagcctttcctttagcctagccgctactttagggcccccaggaaggggccccaaggaagggacaggagttgcattccaggtggatctcccaggagcccctgggcagctatactgttaactctgtaaagactgaatgtattgctaagggcttgaataaatttgcaaccaaaaccggggggaatttttttattttacatagctttatgttttgtggctgttacatgtggatgtatacattaagctggtataaaatattatatgtttataatttcttaaatgataagaaggataccctgatcagggcaggctgcaaatatagacggatattcatgagacacaacttccttgctttttgcagccagtgggccagatgaaatttaaacacatgaatattatcaacagaacaagtccccatacttaatgatttgtgctgtgatttttacttattggaacctctgggggaaaagtagacaacataaaaaggccatttctcgatggagatatgcttttgtaatttttaaatgcaacttttggttgctaatgaggcctcaggaaatcagatataacccttactagatgattcttttcagctgtaatatacatattaaaatatatatttaacataatacaacatataaacataatatataaattaaaaaataattatatatatatatatagagagagagagagagacagacagacagacagatagaaagattccacccacccccaagacaggatttcactctgtcacccaggctggagcccaggctggagtgcagtggcttgatctccgctcactgcaacctctgcatccctggctcaagcaatcctcccacctcagcctcccaggtagctgggaccacaggcacacaccactatgcccagctaattttcgtattttttgtagagagagggtttcgctatgttgcccaagttggtctcaaactcctgagctcaagcaatccacccgcctgagcctcccaaagtgctacgattacagcctggcctgatacatatttttgaatggattaatgtgaactctaaaactgatgtgattataagagcttgggaaaaccttgctttttcactgtgactttgacaactggccctgcagcatctcagttttagccaaagaacaccaccataaaccaatcagatctaatagacatatacagaacatttcaccaaaaagagcagaatacacgttcttctcaagtataccacaggacactctcttagactgaccagaccatatgttaggccacaaagtctcaaatttaaacagacgaaaatcatacaagttaccttctccaaccaaaaggaaatgatgagaaattaataacaaaaggaaaagtggaaaattcacaagtatatgaaaattaaacaacacatggtaaacaatcagtgggtcaaagaagaaatcacaagggaaattagaaaatactatgagatgaatgaaaacacaacacaccaaaacttctgtgctgggccaaaagcagggctaaaaggggcaattatactataaaagtctgcatttacaaaagatgatctcaaatcaataactctacatctggaagaactaaaaaaataagaacacaataaaaaccaaagttaggccaggtgtcgtgcctcacacctgtaatcccagcactttgggaggctgaggcaggtagataacttgagcccaggaggttgaggctgcagtgagccatgagtgcgccactgtacttgggcctgagggacaaagtaagaccctgtctcaaaacaaagacaaaaacaaaaacaaaaaaatacaaagcagaaagaaggaaacgatagagattagagcagccataaattaaatagagaatagaaaaataatctacaaaaccaaaagttcggtttctggcaagaacaaaaaatctgacaaacttttggtaaattaagaaaaaaagaggccagtcaaggtggctcacgcctctaatcccagcactttgggaagctgaggtgggcggatcacaaggtcaagagatttaggtcatcctggtcaacatggtgaaaccccatctccactaaaaatacaaaaaaaattagccaggcctggcggcaggcgcctgtagtcccagcttacttgggaggctgaggcaggagaatcacttgaatccaggaggcggaggttgcagtgagccaagactgtgtcactgcactctggcctggcaacagagtgagactccatctcaaaaaaaaaaaaaaaaaaaaagaaaaaaaaagagaaaagatgcaaataactaacatcagaaatgtaagtggagacagtactaccaacataaaaataaaaaagattataaaagaacactgtgaacaactgtatgccaacaaataaaatagcctagataaaatggacacattcctagaaacataaattacccaaactgactcaagaagaaatagaaaatctgaatagagccataacaagtaaagagattgaatcggtaattaaaaatctttcaggccaggcgccgtggctcacgcctgtaatcccagcactttgggaggccgaggcgggtggatcacgaggtcaggaaatcgagagcatcctggctaacacagtgaaaccccgtctctactaaaaatacaaaaaattagccgggcgtggtggctggcgactataatcccagctactcaggaggctaaggaaggagaatggcgtgaacccgggaggcggagcttgcagtgggccgagatcatgccactgcagtccagcccgggcaacagtgtgagactccgtctcaaagaaaaaaaaaaaaaaatctttcaacaaagaaaagcttaggtggtcaactctaccaaacatttaaagctgaactgacaccaatcctcaaactcttctaaaaacagaatatatgggaacactacctagttcattctatgaggccattattaccctgataactgtaaaacaataaaatattgctgaaagaaattaaagaggacagaaataaatggaaagacattccacattcagagaatggatgttaacattgttaaaatggcactatttcccaaaacaatctacagattcaatccctagcaaaaatcccaatggtctttttttgcagatatggaaaagccagccttgaagttcatgtgaaaatgcaagggacccaaagtagccaaaatcatcttgagaaagaaaacacacttctcaattttaaaacagtacaaaactacaatgttcaaaacagggcggtacctgcacaattatcaacatatagaatgtgataatgtaattgagagtccagaaataaacctaaatatccacagccaactgatttttgccaagggtacccagaacttcagggaaagaacagtcctcaacaagtggtattgaaacaatcagatcaacaaaagaaaaaggctggactcttacctcacactgtgtaaaagaaattacctaaaaatggaccaaagatctaaatataagagctgaaactataaaacttacagaagaaaacatgaggataatcttcatcaaccttgtgtttggaaatggctttttggatatgatatcaaaagcatagacgacaaaagagaaacagataaattgaacttcatcaaaataaaaaacttctctatctaagggaatacaatccagagaacaggagaaaataccctcaaatgatatacctgataaaggtctacagatctgtgaaggtctagtatacacgaactttttaaagagtctgaggactggtgttaattcttctttaaaggtttgatacacttatatagtgcatttattggtacaacaagatgacgacaaataaccctatttaaaaaggagaaaggggctgggcgcagtggctcacgcctgttatcccagcactctgggaggccagggcaggcagatcacctgaggtcaggagttccagaccagcctggccaacatggcgaaatcccatctctactaaaaatacaaaagttagccaggtgtggtggtgtgtgactgtaatcccagctacttgggaggctgaggcacaagaagtgcttgaacccgggaggcggaggttgcagtgagccgagatcgtgccactgcgctccagcttgggcgacagagtgagactccgtctcaaaaaaataaaataaaaaataaagagaaagggacttgaatagacacttctccaaagaagatatacaaatggccaacaagcacaaacatgtaaagaagctcaatgtcattcatcattagtgaaatgcaaaccaaaatcacaatgagataccacttcacacccgctaggatggccttaatccaaaaaaaaaaagaaaaccacaaaaaatagtgttggcagggaagcagagaaactggaaccctggaatcctgcccactggtgatgggaatgtaaaaatgatatggcactgtggaaaactttggtagtttctcagtaagttacacatagttgtaccatatgaccctgtaattccagtcctaggtgtataatcaaaagaactagaaacaagtgttcaaacaagtacttgtatataaatgttcctagcagcactattcacaaaagtcaaaaggcaaaaccaacccaaatgtccatcaacagataaatgagtaaacaaaatgttatatattcatacaatgaaatctttttcagccataaaaataaagtactgatatataccaaatgaaataacccagacacaaaggccacaaatggtatgattccatttatatgaaatatccgggatatgcaaatccatagacagagaaagcagatttgtgactaccaggggctggagagcaggggagtcaggactgatggctaaatggggtgcatttatagtgatgaaaaagttctacaactagacagtggtgatgactctagaaaattgtgaatgtatttaataccgctgaattgcgacgttaaaatgctacactttctgctatttgtgtcttaccataatttacaaaaagctttttttaaaaaaaagaaagaaaataaatcaaagcaaaatcttgacgttttcccaaaggctctcaagccagtgcagacctaccaatcaggcgcagtgccgtctgagcgagggccagcgtgccggaattgagcaggaggtcaaggttgtttgcgctgtgctgcagggtgagcatgctgagcatcaccaggaggaagtgggcttgcgggatggtccccaggctcggtcccgatgggttctcattggtgatggtttgcaggggaaccggctggatacctaatgagcattggcacccactgacatttcttgtaatggatacaagaataaatgtaatgcagaaagcacgggcaattactctaaacatctgactaataagcactgacacccactgacatttcttgtgcgtggatacaagaataaacgtaacgcagaaagcatgggcaattactctaatcatctgactattttgacacccactgacatttctctcgcatggatacaagcataaacgtaatgcagaaggcacgggcgattactctaaacatctgactatttttcagtggtttccacagagtgggcagctctgtcatgctgcacgatgggcctaccccctgcattctatgcacaggtcgttccatctgtctacaggacttagtatgctgctctctgaatacaccggtgccctattccattccttccatttcaaatataaaagttatgtctcacttttcctccacaaaaccaatccaatcaactctctgtagatgctcaaactatccaggaaataaatatcaatataggacacagacactttaggatatgtggtgatacacataaaaatgtcaaaatgtaaaaatgttatactagagtacttcaacattgtgtctcctgctaaattttaaagttttgtttaaaatctgagaaagctgacagcagcatagattatacaagtacaaagtacaaacttattaaagtcttctcaaaagcaaaaattggcatttgcaagtttccacaacatataattaaaggcaaactataaaataacattgatacaattattgactcaccaagctctttaaatttggcactggcatccaccaaaacatttcgaatgttctgaacagcccaagcgtacagcttgccaaaggtgacttccagcagcatccgattaaaaggcgggatcaaatcaacatcctttaaacaatcagtaagaggttccctttcaaataaagataaagaatttgactcgggacactgccagacttctaactgttacagaaaaacattctgttgccacagcttccttaattaagaaaaaaatatgctaacgttttaccctatatcgattccctcaggaataagtctttgccatccacaaaacatcgcatacggcacagatggaagtaagaaattcttgctcaccagatacaattttaaaattgtatctatcccttccaggcgaacctctgctctctccaactgcaaaatatcaatgcatacagttaagtgttatgtatattacccaatgcagagaagcatttctcatcaaatgttacctgttttagtaggcactttctcttttccacatccactggctcttctttaagggcaaattcagcaattgtactgaggagtggagactgcggataaagaccctgcacattctgcttcaaccacttgtatttgtgaacatctgtaacagtactcaacagcggctgccatttgtcctaacaaaggaaaacaattttcatcattagtctaccctatttaataataaactgtgctctaaaagttattcaagtaaaatataaataatgcttatgggtttaaattggttaaaatacgttaaatttagtaatacatgtttttaaaactatgctataaatataagtgaatttataatctctatactatatgttggaacaggctagcttggcatactaagttaagttatggttcatattaacagccacagggcccagcactgtttctggaacaaagaatatatttaaggaatgaatggtgaataattaatgatacaatctaataccaaaaataaaaggaaacccttctccagctacagctctgaccaggacatcataagtcaagttcatgaagcatcactggggccgtatttctaacaaccgcccgtccctccctccagatgctcaggtacagaggtacaagactgtggattcctgtgctacatgctacgattctattcagccaacctcagaatcacagaaaataccgcaccttgggtgatttaattgcaatgggtctcttgtccacatttattggactatgaggcaaaatgcaagcttcttctaaatcactctcttcgtttccaattttttcttcatcatccgtagattctggcttcttaggaactgtgttttaaaacatcattcactataaaaatcatacacttaaatattaattttaaattaagacatatttagatttacatgaaggacaaatatttcattcaaataaacatctgaacaacattataaattgcaatgctcaacaacaagagtgaaatgatcaccctggcagaacaaaaagacaaagtgagagtgcgacgaggggagaagccccgaagcaggggaagcccggcagccagcaagctcttcctcaagtgccagagagtgaacatttgagtctttcaggccatgctgtctgtcgcaaatactcaactctgctgctgtagcacaaaaagtaaccacagataaagcaacaggtgtggctgtgctcctgtaaaactttatttatggtgctacaattttagcttcatgtaattttcatgtgccaaaataatatacttcttttaatttttaaataacaatttcaaactggaaaaaaaaaaaaaggtcttagtccatgggcaacccaaagccagcaagaggtagaatttggcccatagttcctggcttgtccaccctggtccagttcagtggttctgttactgtgtaactgaatcaactgaattcactgtgatatgtggaatttcctccctatactttatctcttttaaaatttttggtctaaatctcctcagcatataatataaaaaataagcaacatgataatacatctgggcagtaaagagctaacatagcaggccggggttgctcaaaccctgcaaattcccaaggaaggtctgtcccttcaggattggtccttcttctaggagctgagctctgagcccttggaacatcctgcctgagaagttttttggtatacctgacacccaggaccttgtggcagtggtctggccaggtagtttatgctaatgatgggacttgcgagggaccacttgtttttgcactggggcactggagcctgagtgaggtcagtcacaggggcactgcctgcgtatgtgactggcccccaacaaaatctctagactcgaggctcaggtgcgctggcctggttaacaattcttcacacatgatgtgacactgttgctgggagagctaagcacatccacgtgacgccactggggagagacaccaaagcgtgtgcctagtttcctctggacttccctccatgcacccttccctctgctaattttaatctgtatcctttttgcagtaaaaacacagctgtgactataacagctcttctgagtccttttagtgaatcaagcctgagagaaggctcggggatccctgacacagcaacaggaatattaatcacttaatcttttcaagttacttactttccaaaaaaaaaagaaaaccagcttgaaacaccacacgataaatctataaacccacaagaaactctaaaagtgacagtgtgggctcagaacccacggatatgagatggcaaatgtggagtctctctccctcattccgaggcagcctgtctcctgggcccaggctgagttcctgcatgcctgggttaaaggaatcgcagcagtgtgactgctgtgacttcctgatccagagcacccctcgcattcagacaggctgttatggtgtagggtttgttcaggaacaatcaaattaggatggcttctaacacactttagtctttcataagcttattgttcaaaatgcccatcagaaagtcagtaatcaatactgttcaataagcaggtttgtgagtaaatcagtataagtcataatatgatcagaggccaggcgcggtggctcacgcccgtaatcccagcactttgggaggccgaggcaggcagatcacgaggtcaggagatcaagaccatcttggccaacatggtgaaactccgtctctactaaaatataaaaattagccaggagtggtggcgcgtgcctgtaatcccagctacttggaaggctgaggcaggggaatcgtttgaacctgggaggcggaggttgcagtgagctgagatcgcaccactgcactccagcctggcaacagaccaagactccatctcaaagaaaaaaaaaaaaggatataatcagaaatttctgtagtttatttataatcacaagtgactaaattctaaactattttataatttctaagcatttttattcaaatttggatttaatgcaaaaagacttttctgtacccttacacagctacttccaggaaaatgtcagtaactcttttagcttccctttatagttcttcatgtatcagaatactcaatatttccaaacaaaaaacatttctttagaagaatggcaataagtttaaatgttcccattatatctcattaccaggataactaataaaagtacttccttgttcccatcaatttagcaaagattatttacgttttcaacatcaatttactagtaatcaaatcataccacactcaattcctaaactgcctcattgtctgatcatttggaaaaataagcgagatgtctgtatttaatcctaactataataaaaatgatggcagcaggtagaaatgttacatggaatcaacagtagagaaacttcactctgaaatcacagatccaacgtggcagggtgaagcacaagctttaatagtatcttctgtccttttacattcttacctctctttttccttggttctcgaattatcttctgagctatcctcctccaatggggcaaagaacttaacaatttaaacttagacattatagagaggtcattacaaacagcaggtctcaattcattaaagaggaatctcaaacgtttgatgacaggagcgcagacctccttgtaagaacggccctgttcttgatgagtctgcaaagttaaccaggaaaagacaactttaacaacaaatatttcagcaactgtctgcaaagcacagaataaaaagaattaaaatctatcaccttaatgagcgaacattttgcttggtagacaactctacaaacatccaccactgacttaggcaacgttctgtgctttacttgctcaatatcaagtgcacctgcatgaactaaagataatgccacatgacctgtaaaaagacatttaaaagaagggcagtgaaggaatgaatacgtaccacaggttagtcgaggaatctgcagtgtagctaaagtacaaagatattgagctccttacctaaatcttcatgttttaagaggcaacataacagcaagcgaccgacctcttccacgggatgctcggggggaaacatgatcggtgtggtcaaatggcactgcctacagtacctttctatttgacacaaaaagtcctgcaacaggaacagctggaagtaacttcagggaaacccagtgagtcttcacaaatcttaaacatgccacagcttctgacgcacttgcaatcactaatgcttctgaagcctcgctagcatgttaacacaatcaggttctcacctcaaaaccctccaaataatacatgaaacaaagtctgtgctgtgttaaccaaagagcacataagtattcctatgtcaaagtcctcagataaacagagcactgaggtggcagtgggggcaggcctagctcaccttcacgttgtgatcctgaatgttgttgtctgcaatggcttgcagaaatgcctgggaatggtcccccagggcccgtctgtgggagcagagtcgagatttgctggcaggtgtgccccctggggagctgcagtggtcctcgtctttctcctcgttgtagctgtagtggatctggctggtctgcaggcctccagagaagatggatgactgaagccattctagaaaatgcacacacaaacatgaaagagaaactcaagtgcacaactcaaaataaatactaaaaaaaaaaaaagatgctcaactgaacactcaatttagaaggtgaaattcagcatcattcatatgaaagagctccacctaacatgtttacacaggttgacttataattcctctatctacgtgaacacactttctggtgattccacacgcctcaggcatggcatcagaactcaggatcgtagttccagtccaacattctctggatacctgtgctctgcctgcagctgcctggttccacaggtaccgtgtgaagactgaggtgcacattctaacagggaaggcagcaaagggcaccgctgacacaattaatcacaggatttcaagtccgaaactgtgcaacagatgactatgggggtaccagggagactggaagacagaccaccgctattctgagggtcagtgagggacttgtggaagcaacaactgagctaagatgaggaataagacccagacgctgagtatccaggcagggaatagcacatctgaagggtttctacaaagaattacatcctcagggtaggctatgtattcctagagcacttataaaggaatgaaaaggagaaaatatttaagaaacacacaatctgtaatgaaggatagatccttggagatgggagggccgatggactggaaaggagacctgtgcgtggtgcaaggcatgggatcaaccagtgcgaatgttaattacaactgcttatggcaacttgagggagtgcaccactacagatctctattaacgatctgtgttatcaaatactgctccaaatccaagcaatcaaagcgggatgcacttagtgttcttttactggacatttagattttagagcactcaggagcattccccaacacaccacattcgttcttctgaaacactaatccaatgccgactctctctggccccctctctttaagcacaggacagcccctccttactgctccaagataagcctctgatcctcctgtggatcggacccacctgccagggcccatggcaccctctgccctggagctcgccagccctgccctccttgccaatttaaacaaagcccatcttctggcaagcaatgagccttgaggaggagggaaggaagcagacacctcagagggcaccacaggcagcccagcacctagcactgcacaaaggtccgcccaacggggggctgtatggacaccaagatcctccttccctgcaagcctctgccacacccactcctgcaagcagcaggaaagccctgctcctctcagcagtgcccttgacactcctgtgttttctgcccagaatgctctctcacgcaatttcaggactgctgccaatgtgaagcctttcttctcccagaaccatgtatgaacatctccatttcaccattcaccaccttgtaatgtgacctgcttagaatggtggctcatcaacaagcagcagctgaaagcagaggcgtgtcctacccatcactgcatcctgaacacctcgcatggtaacggcaccagaaagcagaggtgtgtcctatctatcactgtatcctgaacacctcgtatggtaacggcaccaggcaaatgctcaacagaagctgctcacatggatggacagacagacagatgggaaatgcacaactacatgaaggaaaatggaaacacatcttaggagacagaaagaagcttattattttaggtggttacaaaggctgccatcctgaaatataactgacttgagcctggtctggtaaaaacgcagtgctcaaatagtatgctcttccctgagaggacagctgatccacattctgtgcaatttctgggcatgcagggagacaaaagccatgctgggcccatcaggcagaggctgcaatacgtgagaccaccaagggcagacgggtagacattcctgcacactttttagcttcctctgcagcaacagaccatgagggcaaatgacaaccactcacagctgtttctacctgattgagtctcactatccttattatttttttttttgtcatcatcaactgtgttgaatcctcctctccttttttttttttgagaccgagtctcgctcttgtcacccaggctggagtgcagtggcgtgatctcagctcactgcaacctccgtctcctgggttcaagcaattctcctacctcagcctcccgagtacctaggattacaggcacccgtcaccacacccagctaatttttgcatttttagtagacatggggtttcaccacattggccaggctggtcttgaactcctgacctcaggtgatccacccgcctcagcctcccaaagtgctgggattacaggcatgagccactgcctggccatctcctgcttttttaaagagagagtcttgctctgtcacccaggctggagtgcagtggtatgatcatgactcactgcagcctcaacctcccaggctcaagcaatcctcctacctcagcctcctgagtatctgggactacaaatacgtgccaacatgcctggctaatttttgtgttttttgtagagatggggttttgccatgttgcccaggctggtctcaaaatcttgatctcaagcaatccacgtgccacaacctcccaaagtgctgggattacaggcatgaaccactgtgcctggccctctcccactcttaatggcacttacagttcaaaaaaaaaaaaatctgctgattagcaaaaagtaaagattttcttactggcacattcaatctcgacaggagacagcggtgtgctcattgctaaataggaagcgtgtaatccgagaagcaggcccagattcctctctgtgtctatcagaggtgaggagagactccccagatctggtatggtgacgccttcttggtcaggctggaaaaataaatttaatcatcaatctgaggaaacagaattaattaaaaacataaaaccaaaaggacagctctctcctgcagctgtaccgcacgtgagcccaggggtgctctgggcgttctgcccctccatcctgtaatgagttggtgctgctgtgcccaagtaacagcagataccatataaacccacatgccctataaagcaggcagcaaccgcacagccctactgtagaaaaactaaaccacagatacatgatttggctagaatattccttaggaatcagtttccaaagtgactgtacaccatgcttcagaaagtataatgaattgttacatgcataaagaacccactgggcaacaaaactatgacaagtattcgatgacaagtattagtggactgtgaccacacatgtagaggaaatgaaatttattctaacaaaaatcaaactctgaaaaaagcaagagttcaactttttcagtcacagaagatatttacagcaaagttaattctccccttcataaactgttttaagccctgccctaatggcatttaatacatcttattacttgtcgatacctagtaagctaatcccaatatataaattctatgtgttcgtgaatacataggaaggacatatttctattgtaaagaattacacttctacatagttcttcccaaaaaatacatacctcaagattataagccattccaaatttctacataagaccaaagtttaacctcttttcttgtggaacactgcctatatttctcacaaattgatcatttaaaaaacaatctttcaagaccagtacatcacagatcttaacatgaataaatgtaaattcatttatgacaaaacttctaaaggatctttatatttatccctaatgccccgcaaaagacccagatatcagtacttctagatccaaatattcctatcacaaacacacagagggtatcccctgccatcctctgcatcactcaaggcatacagcctcacctccaaatactggccaacacaaaatgcgtgcatggattcccgggtgtcttcaaactgcaaagcagcttccaaagctaccactgggtcttcccctgcaaactgagctgaaacaaaaagggaaaaagcaacatgagttcaattcagcttgcctgaagagctacaggagaaatagtgagtaggaaataagttaggctcttaactcaaaagtgagggttaccagaatataatgacctcccactgtctcccagggttgcctgggccaactcggaacttgaaatgagttccaagtattaaaacaaaagatacataatgaaaggaaattcttcgaatgtgctgaatttgttgataagacagacaccaaagccacagatacattaaaatatgcgggggctggcacaaaactaaaggaatcatttataagccaaatactctgcttaaaatgatacaggctgtaacttttaaccaggaaataacaagtgtaatcttaccaagaatactattttctgttaacgactgtgtctggaagtcctttatatcatacactttcccgtcaatcacagtccagaagcctccatcgttattatggttctccaaatcagctatgcgtacaaatgtcactttctcattatttctacagttctgacctgtaaaaaatgactctgtatatacagaaaccagaatcagtccattgatcaatcaacaggtaaaatgaaaagaacaaactgtgtgaaagaactacaagcagaaataaacaaatccacaatcacaatgggagaaatacatacctagctctgaaactaataccacacatacaaattctgttaaatatagaatgctttaaaaaaaagtctaggcagcatgaataccaaatcgggccatgccaggccatagagtaaatctcaacagatttcaaagaaataaacttacagagcatgtgtgctgactacaatgcagttaaattacaaataggttttcaaaaattcattcaaaataaaataaaaatgactctgtatacacagaaaataaaaatattcatccacatatttgaaaattacaagatacacttataagtaacccaaaattctaagaaaaaatgactatgaaaattagaaaatgtgttcagttaataatcaaaatactgcagatcgaaattggtgacatacaactaaatgcatgcttgagggcatttatgcctttaaatgtatatatttacacattaaagggggaaaaagctaaaaaagaaaagaaacaccaaatcaataaaagtctgttagttcataaaaatactcaaaaaaaagaaaacctgagtggtggtcacctatgcaagtgctaggataccaactcaatattatgaaaaatagttaaagggaggtggcagttcaagaagtcaagcttagattatgtccttgctgtacaaattgtacctcctgctaaccagacagcagagggcaaggttggtaggggattttatagaggatacgcaacacatgaattccctggtctagcttcacagaactaaagcggggagccaccgagcattacaggcctcctgagccaacagaaagcatgcagcatgaccccagacataacaccgccccaacgagactgaattcaaatccaaccaaacctctagatctaaccagcagattaatgtaactaacagaagaacatgttggtctagaataagagaatgcaatcaaccaagttcagaaaatgtgaagttctccaaaataaccaacctgcttctttgaaaaagaaaacggtatgatcagagacagggagaagagggcctggagccatgttgtttggggaaagagactagaagcatatgtcaagcaatgccaatacgcagaacatgctcaggtcttaattcaaaattaccacctaaaaaaggcatttttgagatagtccaggaaaatgtaacatggactgcatgttagattaaggaatcactgttaatcttatagacaggataatgatattgtagggtttttttaaaatccttatcattaagaggtaaaataccttaaaatgttttaaagacagagttatgctttaaaataatccaatcagccgggcgcggtggctcatgcctataatcccagcactttgggaggccgaggcgggcagatcatgaagtcaggagatcgagaccatcctggctaacacagtgaaaccccatctcgtaccatgccatattactgcatttaacaggtatgatgaagcaactgaacaggctatttttccatttccattgcatttcaacagagcccattaaaaagtagtataaatggcccttaaatactaatatattttaaaatgctcaaactatatcggggtcaccactttgtgctttagcaggcaaaatcccaaaagcccacacacaaggctgggagaccagcatccctattggtggtgagagaaatcaagatgtacaggagcaatctggtgacaaccagcccacacgaggtccatccccacctgtgcatgtgcacaggcacacacgcgtgcacacatggaggacacgtgttccaggccaggccttgcagtactatttgtgttttctgttgttgttgtttgagatggagtttcactcttgttgcccagcctggagtgcagtggcgcgatctcggctcactgcaacctctgcctcccaggttcaagcgattctcctgcctcagcctcccaagtagctgggattacaggcacccgtcaccacgccccgctaatttttgtattttttagtagagacggggtttctccaagttggccaggctgatctcaaactcccaacctcaggtgatccacccacctcgacctcccaaagtgctgggattacaggcgtgagccactacacccgaccctcagcactatttgtatagcaacattgtggcaataagcccaagtgtccaccaataagagactcactaaagaaagatagataaaagacacatccacacactgaagactaagctgatttataaaaacaaagagggacactctgataaggtactccagtatatatggttagttaaaaaaaaaaacaaaaaacaagcaacacaagtaatgaagcatgctaccacgaacgtactcatgccagagaacaaggaggttacagaggagactggaaagtcagagggagcaggtgggaaaatgggtggaaggggtgggcaggggaagcgacagtgtgtctctgcctaggtttgatttttgaaccatgtgactgtattttttttttttaatgactgtaaaacaaaataaatactctttatactagaaataaaatgttagaaaaatctggattcaaaactaggattactgttctgcactggcaaagttcactaccattcccaaaggcagttttctcattgacataatgagatacaacagcgtgcatgaggtcctcagcgggcctgcaccctacaggtgctccacacatgcaaatcactaccattactattacataagagatataatacataattatactgtcactactataaccagcatgacatactaagacagcctgcgttcagagtatgaagaaggctgtggaaccccctgcagaaggtgggagggcctggggctgtggataaaggggagctctctggggctgtgccacctgaacctggaacccgggcccccaggttgggtcgccaggcctgtgcgcctcagcttgctcatcactcactctcaacacggataacaccttcaactgcaaacacgtttaaaaaccacaggccagctccccctaccaataccagaaaaaacaagtctccacacgggcccaggatgagaacctacaagtggtactagctacaaaacacatggagaacacggttcttgcacacaccttatgagacgtcggagagctacacagaggaggcatctacagggtgtagccagacggtctaaatgggccatgacaacaaccgccgtttgttgcagatcaatggcaagcctgttgtcttgtggaagggtgaggtacctcaggaaactctcactggggctcagaggaccagacaaaagctagaaaggaaaagtaaacaaaaattcagaaatggtgggaaaaactaaagtaacacagttttttacccaagctttatattttggtattgactcatttgacccatcaaatgacaatgttgatgatacagttatactatacgtctatatatttatgcagcatataaactgtataaatctctaaatctgctgtatacatgtacacaacattgactgtgcatgtatacatttatgataccataggtaagttgaatccacacagattactaacatgaccaaaccactctacaagcctaggacccctggagaaaggcagaaccacctctgtgggaacccagcacagcatctcaagctggccttgaaatctaaaaccaaaacctttattttaatctaaatgttgcccactctggagaacacctactttcatttgcaaattaaatcacagttctaattcttctaaaggcagaagacccctattatcattagtttaaagactgccaaataataggctgggcatggtggctcacacctgtaatcccagcactttgggaggccgaggcaggcagatcacaaggttaggactttgagaccaccctggccaacatggtgaaacctcatctctattaaaaatataaaactgagctgggcatggtggcgggtacctataatcccagctactcgagaggctcagacaggagaatcattcgaactagggaggcggcagttgcagtgagccgagaacgtgcactgcactccagcctgggaaacaggcagagactccgaagacgggaagggacgggatgggacgggataggacaggacgggatgggataggacaggacgggaagggagaaagaaagcaatgtacccgcaaaacaaacaaacaaacaaaaaaacagtctcggggacctatgggactataacaactccggtcactgaactcacgaagggacaggagaaagaaggtggggctgaaactgtactccatgaagtgatggcttacaagttcccaaatttggcaagagacataaatctacagatctaacgtaagcaaaccctaaacaggatgaacccaaagaaatccaaactaagacatataataatcaaactccaaaaaacaaaagacaaaacatttcaaaagccactaaacaaaaacagtgccttaactatcgtggattaacaagtcaaatgacagcgaatttctcatcagaaaccatggagcccagctgaaagtacaaaatatttttcaagcgatgaaaagaaccattaacccagaattcttatatccagcaaaaatgtccttcaggaatgaaaaggaaagcaaaacattctcagaggaagtgaaacagaatttgtcaccagaagacccacaccaaaagaaaggctaatggaagttctctaagcagaatggcaaccatcaaagaagaaaaccctggaacttctggaaggaggagatgacaagcacaccaacgcataaatacaatagacttttccctcacctcttgactttgctaaattacgtctgaaggttcaaccaaaaattataacattgtcatatgtggttatcaatgtaagtaaatgaaatatttaaggcaagtatattatgaacagaagaacataaaggaacatcaagggaggtagtttctatatccctgaagctggtaaatgacaacatcaggtaaaatctgataagtgttcatacatacacaggctgagtgtcccttataaaatgctcaggagcacaagtgttccaaatttcagatttttatcagatttaggaatatctgcatataaataatgagatattttggggataggacccaagtctaaatacattcatttatgttttatatataacttatacacagagcctgaaggtaattttatatagcatgcttagtaattttgtgcatgaaacaaagttcatgctaagtacttatgaatggaattttcaatttgggggcgtcatgctggagtgccataaagtttcgaattttggggcatttcagattttggattttgggtttacagatgctcaatctgtatgcaatatattacctagaaaagccactaaaaaagctatacaaaaagatacactctaaaacactacagatgaaatagaatgctaaaaatggtcaagtaaaccacagagagccaggaagaaccaaaccgaaaaaatgaaaaacagaagaaatagaaaatgcaaaacaaaatggcagtgttaagcctcaatttatcaatgacattaaattaaatgtaaacaatctaaatacatcaattaaaagacactaggagagtagactagagaacatgatccaactatatgttgtccataagaaagtgacttcaaacaggcaaactgaaaatagaagtatagaaaaaaaaagatcatgcaaacattactgaaaggacagcaggagttggctatatttataacaaataaagtaaacttcagaacaaagataattaccaggagggccgggcacagtggctcacgcctgtactcctagcactttgggaggccaaggtgggtggatctcaggagtttgagaccagcctggccaatatggcaaaaccccatctctactaaaaatacaaaaattagctgggtgtgatggcagaagcctataatcccagcttctcaggaggctgaggcaggagaatcacttgaacctggtagggtcggaagttgcagtgagctgagatcatgccacttcactcctgcctgggcaaaaggagcgaaactccgtctcaaaaaaaaaaaaaagataattaccaggaaccaacggcaacattacaaaatgagaacttggtcaatccaccattaagacacagcaattcgaaacgtgcagacaccaaacaaacaaaaaaacaatgaatagaaccgaaaggagaaaaagacatttatacttttatagttggagacctcaaaatctctctctacagctgataaaattaggagacagaaaagctgccaggatatagaacgcaacatcaccatccatcaactagagccaatcaaaatttatagaacactccagccaataataacagaatacataatcttttcaagtatccacaaaacaaatactaagttagaacatatcctgaggcataaaacaaacctaacaaattttttgaaattaaaatcacacagcatatgttccctcaaacaatgggaacaaatctgaagtcaacaagagaacaattacaggaaaattgcctaactctcagaaactaaacaataaacttctacataacccatggatcaaagagaaagtctcaagggaaattttaaaatatattgtgaactgagagaaaatgcaagtacaatacatcaaaatgtatgggaaagagctacagtgggtgacgagagacaaatttacagcactaaatgaatggtacattagaaacttggaaacaaatcaataatataagtgcccacgttgacaacctaaacgaaaattaaaaatagcaaaatcaacccaaaagtaagcagaaaggaagaaataattaaggtaagagtagaaacaaagtgaaaacagaaaaacaataaacagtaaagcaaaaagctggttctttgaaaagatcaataaaactgacacacctctctaagcaagactgacaaaaaaaaaaaaaagacataaattacccaacattagtgatgaaacaagctctaaagatatgaaaaaagataattaggaattactaggaacaactctacacacataactttgacaacttgggcaaaatagacttattcctcaaataatgcaaattaccacaactcaccaaatataaaatagatcatttgaatagctctaccactatcaagaaaactgaattcataattcaaagaatcccaaaaaaaaaaagaaattaccagatccaaatgaactcactggataattccatcaaacattaaaaaagaattaacacagactcaaaacaatctcttctggaaactagaaaaggaaaaacttcccaattcatattaagaagctaatattagagccaatattagcattttaagaagctaatattagagccaatattagcattttaagaagctaatattagagctaatattagcattttaagaagctaatattaggtaccgtaactaaagacagtacaaactacagaacaatataccttaatatatatatagacacaaaaatattcagtgaattattagcaagtagaagtaaacaatatataaaaagaattccacatcatcgccaagtagtttcattccaggaatgcaaagctggttcaacagtcaaatatcaatgtaacccaccctattaatagactaaagaacaaaaatcacataattacatatcaattgatttagaaaaagcaaatgacaaaattcaatactcgtgaatgataaaaattctcagaaaatagcaacaaatgggaacttcatcatcttgataaacagcatttacaacaccttaagctaaaacctatgccaacaagaatgtcagaaagggtcctcccagacctatttatacagcagagagaatcattaagaatgatttagatagttactaagagtttactctcctaagagattacaacacccaatggccagcaagcccttttcattagacaaaaagaaaagctgtgatctgtcaacactctcagaaggttcactgtgaaatgtgcacttctgaactcctgctgagggcctacacgctgcaatgttgagaagcaagtgtccagaggtctccttggaaacattgcaaaaaaaatgtgagggactgatggatgaatagaaggatgaaaaggtggagagaacggtgataaagcacgtgggatgatgccagcggcacaatcttaggtggtgaatatgtgggtgcgcgctgtaaaattctttcaacttttctgtatatatttttttcataataaaatgttggaaaaaataaacctgtgaaaaaggaagctttagtcaaacatatctaagcaaaagaaaaaacaaattctaaattcctatggctcaaattaacgtgtttttctttttaggctgagatggaagagtaaaaaaacagaaaaagaaatgaaaggaataggagctattctaacagctacaaattccacctgcagtttgattaaagatggcgtggctcaagaatatgctttgaatccaagccccttcaaggctgccaggtacagagtcggttctgcaaaagctctgtacctgtgaacaagcagagcttccaaataaaccgattaaagctgccctgagtcaataagccgggctttaatctgagcaagaaaggtacatttttagtctagttacccacccataactgtaggtactttgatacctaggtgaggggaaacatggagaaaggcaaaataacagatttttaaaatcacaacaaatctttatcaaacatttgtgccaggcactgacttaagagcttcaaatgcattatttcatgtcatttgcacagcaactctctgagtaagtactttcacttattttatatataattttaattatttacattatattatacttattccttttttttgtttgttttttttgttttgagatggagtctcaccctgtcacccaggctacagtggtggtgcaatcttggctcactgcaagctccgcctcctgggttcatgccattctcctgcctgagcttcccgagtagctgggactacaggtgcccaccaccacgcccagctaatttttttgtatctttagtagagacagggtttcaccacgttagccaggatggtctcgatctcctgacctcatgatccgcccgtctcagcctcccaaagtgctgggattacaggcatgagcctctgcacctggccacttattcctattttatacatgagaggcccaaggtgagacaaagtgatttgtgtagagtcagagataaagccaaaattgatacccagacagactgaaaaacttctctgtcagaaaatctagaaatggtaaagggagatcttcaaactgaaggaacatgataacacaaggtagctgggacagaaacaaaaccttaagggcccataatggtaaaatgaaagttaacataaaaaacttttttttggccagccatggtggctctttgggaggccgaggtgggtggatcacctgaggtcaggagttcgaaaccagcctgaccaacatgacgaaaccatgtctctactcaaaaatacaaaattagccaggtgtggtggcgtatgcctgtaatcccagctactcgggaggctgagccagaatcgtttgaacccaggaggcagaggctgcagtgagccaagatcatgccattgcactccatcctggcagcctgggcaacaagaccaaaactccgcctcaaaaaaaaaaaaaaaaagaggccaggtgtggtggctcacacctataatcctataatcccagcacttaagggtggctgaggcacgtggatcacctaaggtcaggagttcgaggcgagcctggcaaacatagtgaaaccctgtctctactaaaaatacaaaaacgttagccaggcacggtggtgtgtgtctgtaatcccagctactagggaggctgaggcaggagactcgcttgaacctgggtggcggaggttgcagtgagctgagattgtgccattacactccagtctgggcaacaacagcaaaactccgtctcaaaaaaaaaaagacttttttttctcttttcaaatttgaggggaaaaaatgtaattgcctatttaaagcaaaaacaaaaacatcatattgtggggtttataccatgtttcacttggacatgacacagcaacactaccaaccaagaacatgtgagaagcaggaagctacagtcagagcactgccccgcggctcaggcagtgtaataccatttgagagtgggcagtgacaagtgaaagatgtaactgaaaacgccagagatgatagatttaaacccaagtagtctaaagattccaaataaaaaacagaggttgtcagggtgaataaagaagcaagacctaattaaatgatacctgaaagaaatctactttacacatacacaaagtttgaaagtgaaaaaagctaaacctggcaaacacaccacgcaaacaccaaatcagaagaaaggagagtagtcagaccaaggtgacttcacaacaaagaatgtcaccggagattaagggggtcaaatttatgaatatggcgtaaaaatcctaaaagtgcatgcaccttataacattctcaaatacatgaagcaaaacctgcagagctgaaagaaaataatccataattagcatgagagatttcaattctcctcagaagaaagaggaactaagcagtgaaattgctcttcatgcctccccagcacaatggagatactcctgggaaataaagccagtcactggggctgatctcccagaacactgagactggcttctctgtaaataaatgactggtatttgctaggagaagtgtccttatctatgaaatgtttttagcaagatgtggttagtttaggattgtgtttggtaaacatacctaaaatccatggacttatgggacatggctccctggaaaaggttccctaaggtgtataaactatctgactacaaaacgggaacactgcacatccttaatgctccttgtgcagtgagatgacgacacacctcagtgagaggaccacacgcctcagtgagaggtctcatctcgcaggccgggctcaaagaggatggacctgcgggggttgcacagactctcccacatctctccccactttgcctgagcacacaagtgaggatattacttgtatctttaaagttactaagtaatcagctacgggtaacatctctgagattcatgtcaaactaatgtggtaagccaaccttgtgtgttagttcaactcctctcctaacagtgactagaacaagcaggcagaaaactatttcaagtcaaggatacctgaacactatcaacttgatctcactaagctttacagagcagcaaaatacactttttttttttttttgagatgtagtcttgctttgtcacccagactaaagtgcaggggtgcaatcgagattacaggcacccaccaccacacccagctaatttttgtatgtttcgtagagacagggtttcactatgttggccaggctggtctcgaactcctgacctcaagtaatccacccacctcagcctcccaaagtgttgagattacaggcaggagccactgcacccagccacattcttattacatgtgcatgaaacattccacagaatgcaccatattctggggcttcagacaagcctcagcattgaaatcacagaatatgttctctgactacaactaatttagaaattgttaacaggagatatttgaaaatccccaaatatttggaaatgaaataacacatttccaaataataagtgagtaaaagaagaaattaaaagggaaattagaaaatattttcaactgaatgaagatgaaaatgaataaacatttccaaatttgtgaaatgtggctaaacaatgcttagagggaaatttatattatagtcttgaacacttgttagaaaagacaaaaaatctgaagtcaatgatctaagcctttaccttaagaaactagaagagacagaagaacaaatggaacccaaagccagcagaaaaaaggaaataataaagagtaaagcagaaatcaatgaaaaagaaaacaaacaaaatcaataaaaccaacaactggttctttgaaaaaactcaaactgatgacttctaggaagactgatcaaaatcgaaagagagaaaatacaaggcacatttcagcaaatttctggataacaggtagtatatgctggtacttactacatgcaaaataatagcatacgcactttgtctggcctactgtactgatcccataataacctatgaggtaggtactactactaaccccaaatacgaatttttttttaagagacagggtctcaccctgtcacccaggctggagtgtagaggcacaatcatagatcactgcagcttcaaactgatggcctcaagcaattctctcacctcagcgtcccaaagtgctgggattacaggcgtgagctaccatgcatggtgtcactaattatttttatatatgtacatttacatatgtatgtccatgccaggaaagaaaagcctgaatatccactctgaagggataatagtggctaactcttagaggaaaactgaaattggggtgggcagccaggtgaaatttctgcttttataatcgatacatttttataagaaaacatttatttgatgtatatttttaattggaacgaaaatgcatcagacattttaaaaaattcaattacacacaaaaaagtaagcaaagaataaatatatgggttttactgggttggagaaagggaagagattatgaaagtccatccatgataaggaactcctataacccaaaacaaaaaactcaattaaaaaatggaattagctgggtgtggtggtgcccgcctgtagtcccagctactcgggaggctgaggcaggagaatggcgtgaacccggaaggtggaggttgcagtaagccaagatcatgccactgtactccagcctgggtgacagaacaagactctgtctccaaaaaaaaaaaaaaaaaaaagaaagggcaaaagggccaggaacagtggctcatacctgtaatacagcactttaggaggccaaggtgggtggatcacctgaagtcaggagttcaagaccagcctggctaacatagtgaaacttcgtctctactaaaaatacaaaaaattagccaggcacggtggcggacacctgtaatcccagctactcgggaggatgaggcaggagaatcacttgaacctgggaggtggaggttgcaatgagccaagattgcaccactgcactccagcgtgggcaacaagagccaaactccatctccccaaaaaaaaaaaaaaacaaaaaacgggcaaaggatttgaatagacatttctccagtgaatgtatacaaatggccaataagcatgtaaaaagatgctcagcatgactaatcaacagggaaatataaatcaaaacaatgagatgctgtacctactcacacaaattaggatggctatcatcagaaaacaaaaagtgttggtgagggtgtggagaaattggaaccttagtatactgctgcaagaatgtaaaacaatgtagccactgtggaaaacagtttactgcttcctcaaaaagttacacatagtgccaggtgcgatggctcacatctgaaatctcagcaactcaggagtctgaggcaggaagatcccgtgaagccaggagtataagaccggcctgggcaacacagtgagattctgtctctaattagtcaagcgtgatggctgggcaacaatgtcaatatatttaatgccaatgaactgtacacataaaactggttaaaacggtaagttacatggtatgtatattttaccacaatatttaaattttttaattagtttttaaaaaattgttaccaaaaaaatactaagaatccattcaagttatttagaaagggagtgtcagatcaacctttccaaagtgccaaaattcgcaagatcacctggttgcttgccccatacccagctgtccagaattgacttggccctatatataggtgcaggagtttcttcttcatcttttttctctttgtcattcagatctttctttgtcccacttggttcgacactatcatctgcagaattaaaaattttttaatctgtcaccgcttttcagaatgtcataccgttagcctctgcaaatgtccctccccgaaaagttacaacacacatgattaactgaatgcttgacaacttaaaaataaaatacatcaatcatacctgtaacagatccagtataattttcataaagaaaccaatatattggccgggcgtggtggctcatgcctgtaatcccagcactttgggaagccatggcgggtggatcaggaggtcaggatatcgacaccatcctggctaacacggtgaaacctcgtctctactaaaaatacaaaaaattagctgagcatgatggcaggcgcctgtattcccagctactcgggaggctgaggcaggagaatggtgtgaacctgggaggcagagcttgcagtgtgctgagatcatgccactgcactccagcctgggtgacagagcgagactccatctcaaaaaaaaaaaaaaaagaaaccaatacaacaaattatttaaaggatgtcttccaaaatgatattccatctacttcctagtacatttcttaactgagaaacttaagtctttcatatttacctacttcaatttcacaccaattgcttttatccagtgagtcccagtgcttgtgtatccatgggaaaagggagggtgtagaacaagagtatgattcaaaaatcttttaactctttacaaggccctactccactgccaactgggaagcactgctatgcaggggcactgtcactgctggcataattcaagagcactgggacacaaaggaaaagctgagaaaaatcactttaggccactgacaatgtcaagtttcagtcaaaaacaactgtcataaaactccttacacagtaagcgaagagaagagagaactaaccttaaccttgaagtgtaaacacattccatcacagaaggctgtgactaaatgtctaacaacataattagaaaaatgtatctcaatcggggaaagacatgatatcccatccagattacaaataatgactatctaaaaatctcgaaggaaacagttcctctgtttataacacttctgacaccaaatgtatggacttttgcaccaagcaattctccagttctctgcgacacccagctttgtgtcccacagtgcaattcaattctgaaactaactacctagaattagcacagaccccacaggttaataacaagagagaaaaggtgaatgctgaaaaaaatatccaaagaactaatggctgaaaacttcctaggttcagcaaatgacataaacccaggcagactgaagaatctgcacaaagcccacacaagataaatccaaaggaagccatgacgaggcacatcataatcaactgctaaacactaaggacaaaaccttttgaaaagtgccacggaaagtagatacagaagaatttctcgtgtggcctgaaattaagactaaatattacgtgctgccttgacattggtaaaatcaagaaggcctcaaatagcctaaccacaaggtctcccctgagctctgctctcacggataagatcccaaagccaaacaacctccttatcgcggaaacccgaccccagcctgctcatccctgccggcccagagttattcaaacaagccagtcacatcttcccatggaagcaaggtcatctcaccctcctgttactacaaaatgtgcctcccacagcccctcgtggttcgctctgttcccaagtgcagcccccgtgtggcatgcggtgtcccccaccccagggctgtgagcatgcgtgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaactcacagaggatacaagagtggcaaaaaagaacatgatattcagcattgttagccattacagaattgcaaattaaaaccacaatgagatcccactagacttgttagaatggctcaactaaaaatcactgataacaccaagtgctaacaaagacacagagcaacagaaacgtgacagattgtcagcgggaatgcaaactaaaacagcctccagtttaccaaggtagacacctcgagtcacagaatacagagtagaacccagccaggaacacggctcaggtgagaacacaggtgctggctctgaatgccagactctgccgtgtgtgtgtgtgtgtgtgtgtgtgtgtgtgtggtcactaaccacagcccacaggacaaacccagcccacagcctttttgtgtatggtctgaacacagagaaagtattttagttttgttgttcttttgagatggagtcttggctcaccacaacctctgcctcccaggctcaagcgattctcccaggttcaagtgattctcatgcctcaacctccgaggagctgggattacaggggtgcatcaccatgcccggctaattttttgttttcagtagagatggggtttcaccatgttggccaggctggtctcgaactcctgacctcaggtgatccgcctgcctcagcctccaaaagtgctgggattacaggtgtgagccaccacgcccagccaccgtattttatagtttttaataattgaaaaataatcaaaagaaaaacagtattttgtgacttgcaaacattctgtggacttcatcttttcgtgtccataaataaagtttacagaatgaacgtccccagcccgctgacgtagtattgtctgtggctactctggcactacagctgcaaggtcccatggctatgacagagaccatagggtccattgagagcttaaaatatttactatctggccctttacagaaagtaggccacccctaccctacatctggctataaattttacaaatttgacaaattctgagaccctgtctcagaaaataaaataaaatattcatagtcttaataatggaaaacaaaaacatttactgaatgccaaaacatctccctaacaatcccaatcagttgggatctacataaagaacaattatgctctgctttccaaccatgatttttaaaagaacaaaagacaaaaaaattcatcaaatgtgggctgggcatggtggctcacacctgtaaacccagcactttgggaggccgaggtgggttatgaggtcaggagttcaagaccagcctgaccaagatggtgaaactccgtctttactaaaaattcaacaattagctgggcatggtggagggcgcctgtaatcctagctgagtactcaggaggctgaggcagagaactgcttgaacccgagaggaaggggttgcagtgagccaaaatcatgccgctgcaccccagcctgagcgacagaacaagactccctctcgagaggaaaaaacaaaaaaaattcatcaaatgtaatgaataaaacatatactttggattttgccatgtacttagcttttcttagagcaccttttagaactattgtttcacagaaaacactttgggaaacgttttaatttataaacaaatactggagggctaggaagaagaggttaaaactttttaaaatatacagaatgaattactgatacagaaaaacaaaaaaaggttgctgattcctgtcttggaagacactgtcatatggacactcttagcctcagcatccagaggtccagaaagggaaaatttcaagtcagagagaattctatatataccacttacttggaacattcagccctcaaaatcccaacatcatgacctcagtttcaacacaattgtccttagtccttatgtcactgcttttggtgctgcctgctgtcaaggcagtggaagccagtgatgcaactgctctctcgttaaaaggtgtggttctcagtattacaggtgtttgtacttgcttgcgggtatacgcacgaaagataaaaatgaacagatgtgactttgaagggcctaatgaatgaaacctcaccctgaaaacctttgtgctactgaaactaaatgtaagctttggtgtctgaaagtttccaagaattagtaagtaggagagttttactttctgagttgattccatgaaatgggaacaaattggtacataaatggattttgcccagaatcctaggaaatcgccactgttcagtcgtaatcactgcctcctaaatcactgagtctgttctctgtatttttattagacttttgtcatctcccaaattcagatatccaatagtcagccaaaaagggaaacttttatctctggaaagaaaaaaaatcatttagaaaaatgtattcagtgtatctaatactgaaatggagaaaagacttaatgttaaagaaaaaaaaaacactatagacattgacatggaaaagagatttaatgttaataaaaactttatattaactgagtaacacctcctgatgagaagtgctatattaaatataaacccattatgttgtttaaaaaaaaaaaacatgaaaatcaaaagcactaaacagagtgaaagaagccaagacacagaagaacccgactacatgattccatgtatggagttctagaacaggcgcaatttgtcaatgctggagaaacatcaggccagctattgcctctgggaagaaggggcaggacaccagagaactttctgagcaagagtcatgataaagatgtgggttacacgggttacatttgtcaaaacttgtgaaatggtaaactcaaaatagatacatttcattatatataaattttacctgaaagtcaaaaacaaagttgaactagaatcaattacatacatgagtgtctaaggagctaggtgagacaaacggtggatggacagacagcaggatgtggagccaaatacggtggcagaacatggaggtgggtctgcagccactcactgtacacgtctgtcagttattgtgtgtgtgtgtgtgtgtgtgtgtgtgtgtgtgtgtgaatattttcaaacaaatataaaaaataaattaaaataaaaacacaggtaactctgcttgacactgaaactgaagagggagactaatactttttcccatggtttgttttgtgttttttgtttttttttttttgagatggagtctcactctgtcacccaggctggagtgcagtagcacaatatctgctcactgcaacctccacctcccggctccaagcaattctcctgccgtgccctcccaagtagctgggattacaggcgcccgccactatgcctggctaatttttgtattttttagtagagacggggtttcaccatgttggccaggctggtctcaaactcccaacctcaaatgatctgcccgcctcagcctcccaaagtgctggaattacaggcacgatccaccgcgcccggtccccaagtattttcaagtggacaccatcccaattcattccacaaaagaagaataaatacttgccaggcacggtggctcacgcctataatcccagcactttgggaggctgaggcgggcggatcacgaggtcaggagattgagaccatcctggctaacacggtgaaaccctgtctctactaaaaaatacaaaaaattagccgggcgtggtggtggacacctgtagtcccagctacttgggaggctgaggcaggagaatggcatgaacccaggaggtggagcttgcagtgagctgagatcgcgccactgcactccagcctcagcgacagagcaagactccttcccaaaaaaaaaaaaaaagaagaagaaatactttcttcagactaatgctctcccaactgagctatttcaacttagaataaatactttctaaagtggtagctttatccacgttgatgactctcaagcagggggaccaacgaacttcaacagtggttctcaaccaaggatcttttcagattcaacaagtttagggtgtatacaagcatccatttttttaaacctcaatggggactctgaaacacagccactgttatgaacaacctaatgatagtcctattgagcatgcaaaactacaacgctaaataagattgttcaatggcatttccttgcaggccaaaggcttccaataagtgtttaatacacccccaaagaacaccacaaatgcagcaagacggttttgcaataaaaatgccttcaattcacgtaaaacaataaaatccgggcagcttgtattaactaccattttagacaacaatctccaaagtaaaaagcaaaacttcaaagagttaagctcaaagctcctgttcctatagcacattacaaaatttctataaaatgcattttataatggtctttaccaaataaaaaacactagttaaaggcccttaccttttccaggagggagctatccgttctgggttgattctgttccagtgtatacaatttctccatctttaaccatttcattccacagaccacagagcccatctcttgtgaatgcaagctggcaatgataaacgagataagctcacactcacactgcaatttttaaagaatgatatgggaaaaaatctcaatcccccttatgtattcgatcattcggtaataaaatcaatgatttactgaattagtgacttaatcattttacatttcatgaaagtcatccaagaaatataaatgaaaaggtgcataatagtataaatactattctacctcttatgtaacatacaagaaaaatgacacgtggtcaggcgaggtggctcatgcttgtcatcccagcactttgggaggccgagcggggcacatcacgggggatcaggaatttgagaccagcctggccaacacggtgaaacgccgtcccaactaaaaatacaaaaaattagccaggcgtggtggcgggcgcctataatcccagctactcacgaagccgaggcaagagaattgcttgaacccaggaggcagaggttgcagtgagccaagatcgcgccacagcactcagcctgagttgataagagcgagactcggtgttaaaaaaaaaaaaaaagaaaaaaaagacacacacacaaacacacacacgtgcatatgctctgaaaagataaaccgaaagcaagtaccaatgactacctacggggaaatggggaggggacatggacaaaggcagcaggaccagaaaaagcaacaacattgtgagtatactttagatgtctttacttctgaaacatacatgactttcatcctcaaaaattaaaattaaatcataaaaaagcaaaacctacaactggcaacaagcaaattaacccatgcatatacaaagaaaagtatgtcaagggacttttgaactacatatcattaatagaatatactataatgaaaaataaaatatttatcggtattgataacactctcacaattttagaactacttcatgttgcacaataaagcagtgtaaatacaataaaacatgtttatgataaagtattaaatgttctcagaaattaaggttttaggccggccatggtggctcacacccgtaatcccagcatttggcaggccaaggcaggtaaatcacttgagatcaggagttcatgaccagcctggccaacatggtgaaaccccatctctactaaaaatatgaaaaattagccgggtgtgctggtgcatgcctgtaatcccagtcactcgggaggctgaagcagaagactagcatgaacccaggaggcagaggtttcagtgagccgagattatgtcactgtgctccagcctgggtaaacagaacgagactccatctcaaaaaaaaaaaaaaaaaaaaaaaaaaaaaaaaaaattaaggttttcagtggaaaagaggaaaaaaaatcaaagaaattttgaaaaacaacttaaattggaaatctatgaactttatttttgaatatatttgcttactctgttttttaaaggactagaatcaaaggcaatctgacagcggcacccagattttggtctcttagaaccatttcccgataaaagacgctagggctcttgggaaaataagtagattcaagggccagggcagacaaagatgagcctgtttcctcaaagaaaaagctgtttcctcaaacatggccaggtgcggtggctcacgcctataatcctagcattttgggaggctgaggcgggcagatcacttgaggtcaggagttcgagaccagcctagccaacatgccgaaaccccatcttttttaaaaatacaaaaattagctgggcatggtggcaggcgcccataatcccagctacttgggaggctgaggcaggagaatagcctgaacccaggaggcggaggttacagtgggccaagactgtgccactgcactccagcctgggtgacagagcaagactttttctcaaaaaaaaaaaaaaaaaaaaaaaaaaaaagcagctgttcaaagatgatagggactcctggccaaatttataataattataataactgtgagcatcaaaatcaaaaacgcctttgcttgtcaacatttgtgagtcagaaaaggcttcccagaacaggaaaagggagcatttcagacactgggggaaggcatccattctgaaaactgcgtatgtgacagaagctcccttgtctggcaaaacaaaagccatttttaattaaaagagacagatgtttgcccatcttttttttttttttaacttctgtggatacacactagttgtatgtatatatatatgggttatatattctatctaactcttttttttttttggagacggatctcgttctggcactaagctggagtgcagttgtgcgatctcagctcactgcaacctttgccttctgggttcaagggtttctcctgcctcagcctcccaagtagctgggactacaggctcacaccaccacacccagctaatttttgtatttttggtagagatggggtttcaccgtgttggccaggatggtctgggtctcttgacctcatgatccacctgacttggcctcccaaagagctgggattacaggcgtaagccactgtgcccagccctatctaactccatttttatacccattaaccatccgcacttcacccccactttatccttcccagtctctgataaccatcattctactctatctccatgagttcaattactttcatttgcttagcacctacaaataagtgagaacatgcaaagttcgattttctgggtctggctcatgacattctgttcctgacttaacataacgacctccagttctatccatgttgttgcaaacggcagtatcccattctttttcatggttgaatagtactccgttgagtatatataccacattttcttcatccattcatctgctgggaacacttaggttgcttccaaatcttggctattgagaatagtgctgcaataaacatgagagtgtacatatttcttcaacatactgatattctttcctctgggtatatacctaccagtgggattgctgaatcatatgatagtcctatttttagttttttgaggaacctccaagctaatctccataatggctgtgctaatttacattcccaccaacagtgcacaagggttcccttttctctatattcttgccagcatttgttcttgtcttttggatataagccattttaattagggtgagataatatctcattatagttttgatttgcatgtctctgatgaccaaccatgttgagcacctgttcgtactgcctgtttgtcatttgtatatcttcttttgagaaatgtctattcaaatcttttgcccattcttattggattattagatttttttcctatagagttgcttaagctaattatatattctggttattaatcctttgtcagatgggtagtttgcaaatattttctcccattctgtgggttgtctcttcattttgttgattgtttcctttgctgtgcagctttttaactcaatgtgatcccacttgtccattttagctttggttgcctgtgtttacgaagtattactcaagaaatcactacccagtgcaatgtcctggagagtctccccaatgttttcttttagcactttcatagtctgaagtcttaggtttaagtctttactccattttgatgtgattttcgtatatggtgagagatagtggtctagtttcatttttctgcatatgggtgccccattttcccagcaccatttatcaatgaggctatcctttccctcatgtatcctccgggcacctctgtcaaaggtgagttcactgtagatgtatagatctgtttctgggttctctattctgttccattggtctaggtgtctgtttttataccagtaccatgctgttttggtatacctttctagtaaactttgcacttgatctaagccaaaaaagaccaggaagtgactgtagtataattttaagtcaggtaatgcaatttctccagttttgttttttgctcaggatggctttggctattctgtctcttgtgattccatacaaatttcaggatttttttttctatttctgtgaagaatgtcattggtattttgatagggattacattgaacctgtagattgctttgggtagtacagacattttaacaatattgattcttccaatccatgaacacagagtatcttttccttttctgtgtgtcttcttcaattttctgcatcaatgttttacagttttcgtggtagagatcttttcacttcttgggttaggtttattcctacgtattttactttatttgtagctattataaatggaattatttttcttgatttatttttcatattgttcactgttgacatatagaaatgctactgatttggctgggcaaagtggctcatacctgtaatcccagcactttgggaggccgaggcaggcggatcacctgaggtcaggagttcgagaccagcctggccaatgtggtgaaaccctgtctctactaaaaatacaaaaattagccaggcctggtggcaggcgcctgtaatcccagctactcaggcggctaacacaggcggatcgcttgaacccaggaggcagaggttgcagtgagccgagattgcgccattgctttccagcctgggccacagagtgagactccatctcaaaaaaaaaaaaaaaaaaaaaaaagagagagagaaatgctactgatttttgtatgttaatttagtatcctgcaattttactgaatttatcagttctaatcattttttggtggagtttttaggtttttccaaatacaacaatcatctgcaaacaagagtaacttggcatcttcatttccaatttggatgccctttatttcttcttcttttttttttttttctgagatggagtcttgctccatagcccaggctggaatacagcggcacaatctcagctcactgcaatctccacctctggggttcaagtgatttccctgcctcagcctcccgagtagctgggacaacagacacccgccaccacgcctagctaatttttatatttttagtagagatagggtatcaccatgttggccaggcttcaaactcctgacctcaagtgatccactcacctcagcctcccaaagtgctgggattacaggtgtgagccactgcacccggcctttctctctcttatctgactcctctagcaagggcttccattattatattgaataacagtggtgacagtgggcatccgtgtcttgttccagatcttagaggaaaggctttcagtttttcacctttcagtatgatactagctgtgtgtcagttgtatatggcttttattgcgttgaggtgtgttccttctataaccagttttttggggtttttatcatgaaaggatgttgaattttatcaaatgccttttcagcatgaatttaaatgatcatatggttttttatccttcattctattgatatgatgtatcaaactgattgatttggatatggtgaaccatcctggcatccctgggataaaccccactttggtcatgatgaacgatgtttctaatgtgttgttgaattcggtttgctggtattttgttgggtatttctgcatcaatgttcatctgggatactggcctgttttgtttttttgattatgtctttgtctggttttggtatcagggtaatattggccttctacaataagtttggaagtattccctcctcctctatttttcagaatagtttcactaggattggtaatagttcttctttaaatgtttggtaaaattcagcagtgaagtcactgggtcctggggtttttctttgctggaagactttttattattacagtttcaatctcattacctgttattggtatgttcaggttctggatttcttcatggttcaaacttggaaggctgtatgtgcctgtgaaattatccatttctttttccttctttttttgaagacacagtctcactctttcacccagggtggagtgcagtaacatgatctcagcacactgcaacctccccctcccagggctcaagtgactctcgtgcctcagccttccaagtggctggaattacaggcacgcaaaaccacacctggttaatttttgtatttttagtagagatggagtttcaccatgttggccagactggtctcaaactcctgacctcaagcgatccacccgcctcagcctcccaaggtgctgggattacaggtatgagccaccacgcccagcctgcaaacttatctatttcttccacgtttcccaatttattgacatatagctgttcatagtctctaatgaccctttgaatttctgcaatatcagttgtaatgcctactttttcacctctgatttgggtcttctttttctcttagcctgcctgaaagcttgtcaatttatcttttagaaaaaccaacttttcatttcattgatcttttgtattattttcttcatttcaactccattttatttctgctctaatttttattatttctgtccttaaaattatgggtttggttagctccttcatttctagttctttaagatgtatcattaggttatttatttgaagtttttctacttttttgattttcctcttagtattgctttcactatatcccacaggtttcgtatgctgtgctgccattgccatttgcttcaagaaattgtttaatttcattcttaatttcttcactgacctgttggtcattcaggagcatattgtttaattcccatgtgttggtggagtttccaaaattcctcgttattgatttttagttatagtccattgtgatcagagaagatacttaacataatttttttaacttttatatggcaaaagaggaatctagcttcattcttctgcatatgaatatcaagttttcccaacaccatttattgaagagattgtcttttccccagtgtttgttcttggtacctttgtcgaaaatgagttcaccgtagatgtgcggatttgtttctggattctctattctgttctgttggtctgtgtctgttttatgctagtactatgctgttttggttactatagctctgtagtataatttgaagtcaggtaatctgattcctccagtttgtttctttttaattacgagagcttcggctattctgggtcttttgtggttcaacatgaattttaggattttttttttttctgtttctgtgaagaatgtcattggtattttgctagggattgcactcaatcggtagattgctttgggtagtatggacattttaacaatattgattcttccaatccatgaagatgaaatatttttccatcttttgtgtcctctttaatgtctttcatcagggttttagagttttcattacagagatctttgtaattatcttctttggttacttcccaggtacttaatttcatgtgtggctactataaatgggattagttttctaatttttttcatattgtttactgttggcacacagaaatgctactgatttttgtatgttgatttcgtatactgcaactgtactgaatttatcagctctaatcattttcttgtggagtctttaggtttttccacatataagatcatatcatctgcaaacaaggataatttgacttcttcctttccaatgtggaggccttttatttctttctcttgtctgattgctctagcaagaacttccagtactatgttgaataacggtggccacactgagcatccttgtcatgttccagatcttagaggaaagactttcagtttttcaccattcagtatgatactagctgtgggtctgtcatatacggcttttattatgttgaggtatgtttcttccataatcagttttaagagattttatcatgaaaggatgttgaattttatcaaatgccttttcagcatcgactgaaataatcacatggtttttatccttctgttgacatgatgtgtcacatcgattgatttgcatatgttgaaccatccttgtaccccagggataaaccccacttcatcacaatgaacgatctttctaacgtattgctgaatttggtttgctagtattttgttgaggatatttgcatcaatattcatcagagacattggcctgtagtattctttctttgacgtgtctttgtctgcttttagtatcaaggtttcaatttttaatgacttattttgtggcctaacatatggtctaaccttgaggacgatccatgtgctaaagagaacaatgtaaattctgcagccatcagatgaaatgttctagaaatatctattaaatccatttggtctacagtgcagattaagtttgatgtttcttcgttaattttgtctggatgatctgatctgtccaatgctgaagtggagtgttgaagcctccatctattaatgtattaacgcctctctctctctttagctgtaatatttgttttatgtatctgggtgctctagtgttgagtgcatatatacatatatttataatagttatagcctcttgctgaattggcccctttatcattacataatgacttttttggtctccttttatagttttggtcttgaaatttatttggtctgatataaccgctatgctcttttgtgatttccatttgcctctccctttttccatccctctgcactgtcctgaagagatggtctccaatctgaagaagcaagcagccaatgaactgcctgtggggaggggcagcctccaagagcccagggtttcagtcccacaaccacaatggattcaattctaccaatgaggacctgagctccagatgacagcgtgccctagccaacaccttgactacagcctgtgacacctgaagtagaggatagaactaagctatggccagactcctgacccacagaaactgtgagagtgtaaatgcttgttgttacaagctgccaaatttgtgtttggtaacttgttctgtagcgacagaaaccaagccagcatccttcagtttttgtagaaggaacagctttccctcagcactgttattttttctgttcacatcactaacaggataactgccataaacatacttggaaccaaaacatatgacttttggtaaaaatatcagctggtgggggagaggtaaactccttcctaaaaagtgagccctggccagatagagtgactcacatctctaatcccagcaccttggaagactgaggcaagagaatcacttgtgcccaggagttcaaaaccaatctaagcaacatagcaagaccctgtctctacaaaaaaattgtaaaattggccagaaagctgggcatggtggctcacacctgtaatcccagcacttgggaggccacggcgggtgaattgtttgagctcaggagtacaagaccagcctgaacaacatggcaaaaccgcatttctaccaaaaatacaaaaaattagccagaggtggtggcgcgcctgtactcccagctacttgggaggctgaggtgggagaactgcttgagaccaggaggtagaggctgcagtgagttgagatcactccactgtactccagcctgggcaatagagcaagaccctgtcaaaaaaaatttttaatttaaatttaaaaaattaaaataatataaaaaataaaattaaaaagtgagccaaaaacattcagggcccctgaagtttaacgagtgaatggaaagctttgactcttctagtcttcagtcagaggagagcagtgaatacgtgcactggggttcagtccaaaccctaccacaatgcacatgataagaggctaacagtggtcagaactcacagctccatgtgggccgtgctccaggagtttcagactatctttaggcactcaagggaatacgacatttgacccgtgtcttaaagtgtttcagaaaacagaaacagagaaggtgaactaagaagctattactggccaggcacggtggctgacgcctgtaatcccagcactttgggaggccgaagcgggtggatcatgaagtcaggagataaagaccatcctggctaacacagcgaaaacccatctctactaaaaatacaaaaaattagccagatgtggtggcaacgcacctatagtcccagctactcgggaggctgaggcaagggaattgcttgaacctgggaggcggacgttgcagtgagtggagatcgcaccactgcactccagcctgggtgacagagtgggactgcatctcaaaaaaaaaaaaaaaaaaaaaaaggctattaccaagtgtccaaaaaagaaaggatgacagcagaagtcaacacagggaagtacagtctttaagattatttcaggcagggcacggtggctcacatttgtaatcccagcagtttgggaggccaaggtgggcagactgcttgagcccaggagttcgagaccagccagagcaacatggtgaaacccggtctctacaaaaaatacaaaaattaaccaggcgtggtggtacgcacctgtagtcccactactcagggggctgaagtgggaggatcacctgagcccggggaggttaaggctgcagtgagccgtgacggtgccactgcattccagcctgggcaacagagtgagaccctgacttaaaaaacaaaaaaagaaactatttcaaatcacgtaagttaaatcaaatgtgaaagggaaaataagggagggaacagaagaggaatgagaattagttccgttttaaccactaagatttgcactaactactgaacataaacatggagctcctccccactccaccaaccctcagtaaatatagatccagatcttagcagagtgttcagggctagagactcaaatctgggagtagtcaacaaatggactgtaggtgatgtcctggagaagatgccaacacccaagcagagaggggagacccctgcccagccctgaaagcactctaagatcgccccagactggctgggctccacacatcagtgttctgcggtacagcctagattgagaaacattagtgttacagaggtaccatttaaaaaaaaaaagccaaaagatggaacatttaaagactaagccaaagaggaagcccagtttacatggaaacaagaataattaccaccacctttcgattattacctgggtagcactgggaaggaagaggataggccagaccttgtccttctgagtaacaaggaattcttttttggaaggtagacactggactcctggaaggacatgcactgtggaagcctcctaggaactgatgacccaaataaatggtaagcaccattcaaaaaactatttgggcaccttaaaggtggaacattactaaggcaataaagcaagcctcactggaggaggtctccagagagttagactctgaacaagcaaaagtgaagcccagaagagctctccagatcacaaacagtacaggatcctgactgaggaagcagcagcctgggaacaactggaagacagccgtggcactgagaagaatggagactacaggcagggcgtggtggcccacgccgtaatcccagagctttgggaggccaagacagaagaactgcttgaggccaagatttcaagatcagcctgggcaacatggtaagaccgtgtctctacagaaatgtaaaaattacccaagtgcatggcacgtgcctgtaatcccagctactcaggaggctacagcaggacggtcacctgcacccaggagtttgaggttacagtaagctctgatcacaccacagcattccaacctgggtgacagagaccctattcatttaaaaaaaaaaaaagaaagaaaaagaaaaaaatgaatgggactttccatttgtaaagtgagagtatttatttctacaactgtctccaattagctttttattagtagctgacttacctaaacgtgcccagtagcttttcaacttttgacttttttggttcagatcccagaagcttctaattaggttatttgggctaagaactcttttccaatcttttccaatctcacattcctatcttacacctctgaaatgacatggcaagtaaaggcactttcatcgtcaaaagaccccagcaaaagaggcagtaacaggctcactttttgtaagttactaaactgaagctcagaaggccaatgacttgaccaaaggccacacaacactgaggctgtgagaggcgggatttgggaagaggcccaactccaaggcttattcgcttcccaccaacaccataacatgcacccacacctgcagcacggcagccagggcaagccttcacgctcccatacataggccaccaatattttaataccaatcaggactaggcaagcaaacagttaaggcatttttttttttttttttttttgagacagagtcttgctctgtcgcccaggctcgagtgcagtggcgccatcttggctccccgggttcatgccattctcctgcctcagcctcccgagtagctgggactacaggcgcacgccaccacgcccggctaattttttgtgtatttttagtagagacagggtttcaccgtgttagcctggatggtctcgatctcctgaccttgtgatccacccgcctcggcctgggattacaggcgggagccaccgcacccagcccgttaaggcatttattaaagtgacttcagaactatagagtcaggcaataaaatccaaaactgaataatataacaaatgaatatctgattaatgtataggttagaaaatgtttctttttcatgtccttacaatttgacagaaaagtaatcttcaaatatttgcagatgagtaaaggtatacggctttttttcttaaacctacagaaaaatactaaacacctactgaacgtaggacaacatatgaaaaaatgttaagaacaggttcctagaacaattagaaaggtcagacaggaacattaagtacgtcgatttgaagacatcctagaagcagcaagggagtgaggtcttcctaaagtctaagacccacgagaggaagaaagaggcccagagaacctaagcacgcagggatgagactgagaagcaaaacggagcttctgagagactcccagggccctcatacaggagaaagaggcctggcagatcccatgctctgagctggaacctcaaagggccacacaccagaaatacaggtgagttagaagtagaccagccttcacggaaaaccagcccagtttcgcattctctcaatttccaaagggactgcagtgacctgggattgcctagaacatcctctctggaggaagatattgttacctagagcctcgatttattgctacaatattgcatatacaatatctgaaagtcaagcaaatataataatgacaaagatacaagaccacatcattgaaaaatgaaaaaaaaatagaagtcattagaacagactgagtagatcctgaaaacagaaacataaagacttctgtcatgaaagaagagcctgaggaatgaactgaagtgttgacactctgctcagcagatgtcagctcggggcaatggggtgagggaagtgggaaagcgagacaaggagatcaatgaagtaacgatatgcagtatatgacttcacagtcagctaagtgtgattttagcctactctgcctatgtaggagccattcttatttcctttaatttcctaaaaaaagaaaaatatatattaaaaaagagtgattttatatttttcaatggttgcaacataatcaaaagaatcatatgtcagccaagcacggtggctcacacctgtcatctcagactttgggaggccaaggcaggcggatcacgaggtaaggagttcacgaccagcctggccaacatgatgaaaccccatctctactaaaaatacaaaaaaaaaaattagtgaggcatgatggtacacgcctgtaatcccagctactccagagtctgaggcagaacaattgcttaaacccaggaggtggaggttgcagtgagccaagatcgcgccactgcactccagcctgggcaacagagcaagactccctctcagaaaaaaaaaaaaaaaaaatcatatgtcaacaaatgaaaattatatgacattcaaattctggtatccacgaagttttcctggaatatagccatacacatgtttggcagcttctcgcaggacaatggccaaggtgagctgttctaaaagagcacgtacggcccacataaacatttactatctggtgctttacagaaaaaatgtgctgacccctatgttagtgccacctcttctcaatgagctgcaaatacaaccaactgttcagccagcacattcactaggcatatgtggcttttccagaaggtttgcaagaagaaactacaccataaaatagtccaaagaggaaagaaaaaagggaggaataaaaacactgagttccctcatctctccttgtaaagtggtgaacgttcataccacaaggaattcacacccacacacactcgccacaccttccaggctgtgtcactggctccttggtaggcagtcaggaagccatactccaactctcttgcgtgacatcacagcggagactggagccgaagggcggctcacaggcatgagtcagccaagagggacagagagaggcggctaaggaatctatggggtcggacaaggtttataaacacacttttaaaataactacctttaatagagtcaagcaattaaaagatcctattaacagccgggcacggttcatgcttgtaatcccagcactttgggaggccaaggcaggcggatcacgaggtcacgagttcaagaccagcctggccaatctggtgaaaccccatctctattaaaaatacaaaaattagccaggtgtggtggcaggcacctgcagtcccagctactcgggaggctgaggcaggagaatcacttgaacccaggagatggaggttgcagtgagccgagattgtgccactgcactacagcctgagcgacagagcgagactccttgtcaaaaaaaaaaaaaaaaaaaaaaagatcacattaacaatttcaacacagaagttgaaactagaaaaaagtacctaaagtggcagttaaagaaactgtcaaacatttcaaactaaacattttaaagggatgtgtttaatataattatacctcaataaagttgatatgtttaaaaaatggaaattctggaatagaaaaatataatagtaaaatttaaaactcaatggatttgattaaaaacagattgggaaggcctgtgcttcctccacctataaaggatgaattctgtagaaatcacttccttgctataatcaactagaaaaccagacagaatataccgaaaagctgttaccaaaaactggacaacagacagcccagagctgggatccctgagagaagggaaacactgcccagaagcagcttccaggctgcagcacaggaaaggggaacccaaatagagcccaaagaacttgctgagctcaggagacagatcagctatacgtaggccaaatgacaagaatacagcaagctccagagatgagtggaggggccccttgagtatctgtctgagtactactctgagcataggttaagaaaactatggaatactggggaaagcagcactagaaagtaataagcagcactgccatgatgcacagtctgggaaaagcctgtgtttccacaaacaaggaaagaaagatcttctcatacaccaagcatcaggtggagtcctgagaacagtattgccttcgttgtatggataaatgagcccaagagtaaagcctgtgtggatcagcctaacaaacctcagaatcaagctttgaaaagatcaaactgaccccatgtaacttacatgtatggcagaagaaaactaaggctctttaaaaaaataaaacaaaatcctgcacagaagataaaattaatgcctagcattcaatcaaaaattagcaggcatacaaccatgcccccataactagggcaatcaatcaatagaaatgacagaatcaatcaacagagatggatctagaagtgatcagagattacagaattcacagacaaggacattaaaagctctcttacagaaatgctccctatactaatagaaggaaagcatgaatgttataaggagtgaaacagaagatataaaaaggactcaaatggaatctctagaaatgaaaatacaaaatggatggatgagattaacagaactgcataacagttacaaccataatctacaatgtctaagcacatggctatgccatgctctctcccttaacactcatgcagtctaggtttaacaaataactgtttcatgcccatcatcagttgcaggttgatctacagtcatccagttgtctaaagatctttctccactccattcctaaggaagggctcatgagaacaatacttcctaagttacagctcactgagaagtttgtgtgtttttcatctgaaaagtcggttttgctggaacaaaaaatgctttactcacattttcttttcttgagtgccttaaacaggatactcaatttcttcttcataaagaattgtcatctgctgggctcagtggctcactgctgtaatcccaccactctgggaggccaaggcaggtggactgcctgagctcaggagttcaagaccagcctgggcaacatggtgaaaccccatctctactaaaaatataaaaaattatctgggtgtggtggtgcacacttgtaattccagccacttaggaggctgaggcacgagaatggcttgaacctgggaggtggaggttgcagtgagctgagatagtgccactgtactccaacctgggcaacagagtgagactctgtctcaaaaaaaaaaaaaaaaaaaaaaggaattgtcatcaaagtcctacggctaaacccttttccttttttttataacaagtattgctagtcttttccaagaaccaaagttaaaagttagttctttaaaacaccaggccaggcacagtggctcacatatctaatcacagcactttgggaggccaaggcaggaggatcacttgaatgcagaagttctagaccagcctggacaacaaagcaagaccctgcctctacaaaaaacttttttttttgctgcaaaatgctcttaattaacctgacaaaatgccacatacagggttactgcatcttttttatcatggaattttgaaaacaaaaattgttctcttgaggcagcagtatttggatattagaggtaaaaaccacccttagaatccagtcctaaaaacatcaatgaatattcctatatttacaaattcttctatttctacatgtcatctatcaacaggattatgaacctgaaagcctgagaatagaatttatcaagatactcatgtttgtactttttttatctactgcccttttttattttttttgagacagattctcactctctcaccaggctgtagtgcagtggcgcgatctcagctcactacaacctccgccacctgggttcaagcgattctcctgcctcagcctcctaagtagctgggactacaggcacgtgccaccacacccagctaatttttgtatttttagtagagatggggtttcaccatgttggccaggatgatctcgatctcctgacctcagcctcccaaactgttaggattacaggctaagccaccacacccggccatctactgatatttctaagcatgaagtgacattttttttttttgagaaggagtcttgctgtgttggccaggctggagtgcaatggcatgatctcggctcactgcaacctccaccttctgggttcaagcagttctcctgcctcaacctcccaagtagctgggattacaagcgcacaccaccacacctggctcatttgtatttttagtagagacagggtttcaccatgggggccaggttggttttgaactcctgacctcaagtgatccgccctcctcggcctcccaaagtgctgtgattacaggcgtgagccaccgcgcccagccgaagtgacaatatttatatacaataagtttaactgtaaaagcttacatttatgcgtggtcatttttaattgatgattagatgaagagacaaataaatggtcccagtttagctactgatatactcaacaaaccttgacggacctgagggcattatgctgagtaaagaaaatcatttccgaaggtcacatatcacttggtaatctcacagtaacaaaattatagagatggagaacagatcagtggttggcaggagttagagatggtggcagaagagaggcaggagagagatctttctggtgatgaaacagttctgcataggaaattgtagtagtagttatatttacagacacttgatagaatggcacagaactacgcacacacattgtaccaacttcaatttctgggtttttatactctattatggttacataaaatgtaaccactggggcagtatgcgcaaatatacaatgacctctctagtttctttacaacttcctgagagtctattattatttcaaaataaaaagtttttttaaaaattgcttcatgcatatctagtttcatgtgccacttaaaaaagaacccaaaaatagaaactgtaggaaattcatctgagtgcagcttatgcaagaaggggcaggataactccattctggacctatgctcaaagacatgcacctttaccttacaacaaaactggcgaacaggcatgtgttttaagaataaaaagcttttaaggtctcatatattggtttttatgattcctttgcttaactgactttttggtttgctaaaaaactaccaatcacatcagattagaagtactttcacggtaaaaataaaaagtgatgtgactgacacctcttacctctgtaatgtattactcttcacgagagcagtgaaggaaaacatggtgattcaatcactccacacatcaagcagaaaagagtgttgaacaggccgggcgcggtggctcacgcctgtaatcccagcactttgggaggccgaggcgggtggatcacttgaggtcaggagttcaaaaccagcctggcccacatggtggaaccctgtctctactaaaagtacacaaaattagccaggcgtggtggtggacacccgtagtcccagctactcgggaggctgaggcaggagaatggcatgaacccaggaggcttgcagtgagccaagatggcaccactgcactccagcctgggagacagagtgagactccgtctcaaaaaaaaaaaaaaaaagtgttgaacaattaaactgtttatatgtaataaccagatatatatgcctggcataaaatgagccctgcattagaggttgctggatgtagggtcctaggcctgacgtatccaaataatgtctatgataaagaagtcaataagtgctctctataacacacaagcattataagttttcacactccaaaaactcttcctttctaaagttactaaaacttttaagggcatttcgaacaaaaacagctgtggaaaacagatcggttaaatcctatggctaagaaacatcttcctatcccatgtattattcattacccaggtgtcaattctgtttccaatacaaaagtctcaagcagtgaagcgcttcccactccagctgggagagccatcctcaacaagataagggtaaaacctgtgagcacaaggcttccatctgcaattcctgtctgcagggaagctccccaaagagggaaaccatgtcttattccttacggtaaaacaccaccattcattccttgtgtttaacaaccaatgctggtggaacataaaacaaaacttagcaatcacttttttcatgctacttagacctgtaacacatttttcctctggtgcacactatccaaaacctagtcgtttcccttactcctaggaggaatttagatgactttttttttttggccaggtgcagtggctcacgcctgtaatcccagcaatttgggaggccgaggcaggcagatcgctttgaggtcaggagaccagccaggccaacacagtgaaaccccatctctactaaaaatacaaaaattagtcgggcatgcatggtggcacacacttgtaatcccagctactcggaaggctgaggtgggagaatcacttgcattcgggaggcggaagttgcagtgagccaagattgcgccactgcacgccagcctgggcgacagagcaagactgcgtctcaaaaaaaagactttctaatcatattggaaatgtgtaacaaggaccaagtactgtgtattaaacttaataaatcaaaacaacaggccctctaagatataaatggtgcttcactgtatgtttatctgcccaacccatcataggaactcaattcagcattaaactggttttagatcaagacactagaactcatgtttagcagttattaaattacaattattaagaaaaaaacttcattacgtaaagtcctttactccaaaaagtttctcaaaatacataaacactaatataaaaacaactattaaaactttgcctgaatctcaggatttcagaaatatgaaagtactcatctctcacgtctcccatccacttaaaatgacaaaacagatcattatagctaaatcaaaggaaatgtttaaagagaaacaaacccaaagagtaactacaccaattcttgacccaattctctgtactctgtcttatgtaacattacactatgaataacaatcccatcatccacaacagctttttttttttttttgaaaaaaaagctctcattgtccaggctggagtgcaacggcacaatcttgacccactgcaacctccacctcccgggttcaagcgattctcctgcctcagcctcccgagtggctgggattacaggcatacaccaccacgcctggctaattttgtatttttagtagagacggggtttcaccatgttggtcaggctggtctccaactcctgacctcagggaatgagtgagtttctataggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttctctattaatagatctcaagtttcgtgcacttgcaagaaactaattaaaaggcagccgcgcacgatctacaaaaacagccataagactgttacattttaagttacaggaaataaacctgctcctctaattcagcaagatacaactgacttccccttacataccctaaaaaaaagccttacacgagaaatttaaacatggaagcagaaacacaccaagaaaaagacatgtcaaaccccacctgtatatctgttttcaaccatttggagtcgaggcgagcctgggcagccaaacacaaagattcagagggcatcttttctccagcttcctcccaggtctcaggcctgcaagtaaacacatacgctgaagacctaatgctttttaatagtttacaaagacactcccgaaaggttcaatgcagaaaagaaaaaagagagagagaacagaaaggggggagagaagagctggtggaggggagagaaggggagagagggaaagagggaagagatggagagagagggaggtggggaagggaaagcctgcttccaaggtaggcagggtgtgccgagtttctgcaccacgctgacgagaccttgagaatggacggtcacaggaagccaagttacaatgtcatccccctgccctcaaatccaagaagtacacacacataacagggagcccatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccgccgcgcccacgcccgcctcccgggctcggccgcccgccagccccgcgcccgtaccgcccccgccaccggccgcccaggtgccccaggccaggacctgacgcgcagggcccggccgcctcgccccgccggcgcgcggacgcagcctcccaagagccgctggctcagccggcgcccgcgatcccggcgcctctcgcggcccgaggggcgggccga

SEQ ID NO: 1219 - DNA, 3222 bp, Homo sapiens
aggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcactcactgttgtgtgtattgcgacttcgtttttattattgggaagttttccattttataggtgtagtactgtttgttagttcattctcctattgaaggacatgtaattgtttttggtttttgttttcttttttttttttttttttttgagacagggtcttgctctgtcacccaggctgtatacagtgacctgatgttggctcactgcagccttgtactcctaggttcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggttagtgtgtgttcatagtttcccaaagtggctttgccatttgcatttgaaccaggacttttgtgtgtgagaattctagctccttcttgtccttacagagcagctggatgctgtgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacagatgagttggggtttccaacagggcaggtgggggcctgtgggtggatgggtgtggcagccacagaggctgggatagcttggcactggggtcagggctcagccagcctgtgtgccttcacacctggtaatgagatcacttgtaaacaatttctgtttgtcaattacaggatacaaaaaaagaagcacggaaggaaaaagaaatttatgaacaggaagcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggcccgagtgcagtggtgcgatcttgactcactgcaacctccgcctcccaggttcaagtaattcctctgcctcagcctctcgagcagctgggattacaggcatgcgccaccatgccccactaattttgtaattttattagagacagggtttcttcatgttggtcaggccggtcttgaactcccaacctcaggtggtccatccactttggcctatcaaaatgttgggattacaggcattagccaccacgcctggcctatttatttacttattaatggtgttttttttttttttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactgattgtatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtgtaaaaatgatcattcaagaagagcgaaacagcaaggtgatttgtgaaagagatttattagaaaatgaaacacatttatacctctgttcaataaaaatctgcttttcgtcaa

SEQ ID NO: 1220 - DNA, 12871 bp, Homo sapiens
tctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 1221 - DNA, 1700 bp, Homo sapiens
ccatctctacattttttttactcaatcgaccctgaatgctacagcattatccagggccgcagaaaacacacataatactttattcctgataaacaattcgatgtccttaagtccgccaatatcaccgtacattctgtgcaatcaagaaatttactcagctgggcacagtggctcacacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcaaaaaaaaaaaaaaaaaaaaaagaaagaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccagaccaagtcccaccatctggcagtcaggtcagtccaaccacagtcatatcagggcccttccaggaattctcgacgcaaactggaggccgatggcgcgggtcttttcgtggacggcggcagcacggtcctcggcttgcgtccgtagttgctcaggcttctggttcagggctgggcggcggcgcccctgcggcgggcggcccgcaccaggctctgctgcagcacggggtagaggcgctggcagccctcgaggcccaggcgtacggcctccgcccagctctctgtcaggccgccctcgccgctgcccagcagcccggccacctgattcagcacaggcatgagcgccacggtgaggccggcggcggcgcgctcttcctcgagccgcgtggggtccaggagccaggtgggcgcgggccccggcgcgaggctgaggccgcagcccaccaccaggtcgtacatctccacgcccgcgtcggccagggcgagcgcggcggcggtgagcgcggcggccagggccgagccaccgtcctccagcagcagcgccgacacctcgagctgcgcgcgcgggtagcggcccaggcgcacagccggctccagcgcctcctgcagcgccagcgccagctcacgctcctcgcagccgcccgggggagcgcggcgccggcggcccgcgaagggtgcgcggcggaagtcgcagagcaggcgaccgcgcagcgcggccggggcctcgccgcctgctccggccgggccgccgccgcgctcgccgccctcggcctgtcgcgggcccgacacggcacacagcaccttggtgcctcccgcctccaggtaggccgagcccttggcctggctcagcagcccggcgcgcgcgtacacgggccgtagccgcgttgggtcgcgggtgccgggcgcctcctcctcgtcggccgcgtacagctgcggcggctgcgattcttcagggccgcggatgcggcggtgatccccaggcatggcggttcttggcgtgcgaaccccttccgc

SEQ ID NO: 1222 - DNA, 6453 bp, Homo sapiens
atgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttg

SEQ ID NO: 1223 - DNA, 281960 bp, Homo sapiens
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgtatctactcaaaattggaacagagtcgaagctgggaattcctgtaagtatacagcaaatgatttaaaacttgctggggggctctctgcaaaactttgattctgttggtttgatgatgattatttgcagctgggattgctgcaaagcgtattgctgtaaaccaagcatcacttaaaaatcttgccaatgtgaccggttaacacttgtctctcctcttggtctggtcaaaataggcaaagtgtcatttctctttttgtctactcgcagaatcttaccctctggtctttgagtattcattgagaatgcccaagttctagtaaaacatgaaattagcatcttatcgggggaatagcctgtgaatatcttcatttcttcttttttaaagaactactgaattttattggaattatgtctaagaggaaaacaactggcagactttacattatgctgcattggcttagatttctgaagtttgcaattgggcagaccagtagctgcctgcatctttaaaataatgcaggctaataactgaaatgtactgcaggcttcaggagcaccagcactggctgaggcgagtctcagtattaagagctgtgccctcgctgctaagagaatgagacttagcgctctccggaaagaggagcctcttcctacatttcgcttaaaggaaaaccagtcaggtggtctttcaaaagtaggattcctttgtggttgaatgcttaactgcataaatttgtaattgaatgttctgatgaaatagaacctatttagggaagattgaaatcttatttataatttagatatcatccataataatttggcagactcccttcatccactctttattagagatagaaaaagttttaaaagttatctttggcttaaattctctaaatgggagaattttcccctcctgattaatgacaaacaagcttggcaaatacaactttttattttttcttggattttaaaggaaaagctcatttgctttccaagaactggctatgaggcctgtccaggaatttatgttgctgctgtatcatcaggcttagatttggggaacagaggcagtaatcagacatttgctatggcatatcacttgactatgttaagagttctgatatgtgaaaaacatgacaaactcatgggcacaagtcaaatgtcccctcacagtacctggctcccgtgatttcgtgtttcagttcagaatgggctcatttaatgtcacagggtatccatcactctgaaagaaggaacctcacttcaggtgctgcacatcagattcaactttagtttgagtgttgtgataatctcataagtcaataaaatgtataatttcacctagtcaaaaccttggaatcttataatggtagcattagaaaaacattgcatcatacaagcaaacaataacaacaacacccacacacaaatggaagttctgtagaaaaggcataagtaattcatcttccaaccactaaagttcaaccaaaaagaaaagcactagaggtcactcttacaatgtaaagcacatcaccccaagcatccttccctcaagaaaagcagagcttaaatctggcctgtactccattcagtctttccactagactgcctgtagttgggtttaaaatacattaatctaattatttgggctgctagttgtttatgtttgcttgttttcttgaagctcaataaaaagtgtagggtgtacatcaacattaaatagctttcttttgccatatatcttcttagaaaagaaaaggtgctgaaagagatctgaggagagtgtaatatttatgtctgcttggctctggttggatccctcactgacacttaaaatttcagtgctggttctatattctttcagccttggtttgttaaggaagtagtctaatgctcttttaaacatctgatgaacttgcaaaacctatacgatttttcattataaaaaacatttaaagttggagttcttgcttaccatgcatgtggagttgactgttcttcaagtgtcaaaaataaaatgaaatgaccttatataattaaagttgcactcagtaatttattgtgaatattttgacaatatgatttgcagcagtatgtgtaaaagaaaatatttcatttctcaatttctatttcatttttcaatatttaagaagtattttctttttggaagaagtaaggtctacttgtaccaagccatggtggaaagtacttcatatgtttcatcctttttggaaggacaagtgtatatatatttcccagcaagactggaatttagtgtaaggacaagcaactatcaaccagcatatgcatttctaaagtattataatgactccaataattcttctggacaagactttatattaagaaaaagtgagtcagtcttgactaccaatagtaatattggaaataactgaatataaataaataaaattaaaggactagaaagacttttcccctttatttacagctgatgagccaggagcaaatctgtcatctacagagtcagcccaaggttgccagtttgaaagctttcatgggacagaactctgcaaaaccagtacagctcagggattaggtgcactttaatttgaatgttaattgatccaattaaacagcagggaaactttacattagaaggattctgttcaaagacaaacatatatgttcacatatatgtatatgtgctcatttgtatataggtatatgtgtatgtagatatctaaactactagactcgtgctcatttgtatatacgtatatgtgtatgtagatatctgtaaactactagactcatgtgcttgcatatttttggtggccctgttaagtacttatctgtctaaagatgaaatatgttgaatgaaccacgctccctgcctactagtatcctgtctgacatttcaaaagcagtggactagccataatttttttctctttgttctcatcaagatgagcttttacaattatattgaagtgtcccttccatcaaagtttagagacggatccttgcagatgggtgtgctctttgagaagctgcactggctgttcttggtttctttgcttgctactaagagacatgcattaagaacagagacatttctctattttttaatagctcttataaatccagtttttgaacattaagacatggttgaagatggggtcaacttaccccaaaagaaggaatgggtacagtagtaaggctgataagagtttgcttttattttaactcttgcagattatgtgagggaggctctctagttactggtatactgagccgtactcttgagaataattaatgctccccaatgacttaattagaagttaacatctcactgtgttctttcttttctctgatggaaataaaggccgtatctgatacctaccctaaaagaagcactgaaggatagatgaaggcaaattgcctaagtagatgatcactcttgtgggtcctgggagacagctggacagattctcacattgttaaaactcaaccttgtaattctttctagaagctactttcttttcctccccccaccatatttactcctatagcagaaaataactagaatgcaatagtaaagtactgataaaatataattctatgaggcaatgcataaatggctagcccctataaagatcagcacgtactttgactcacttttctaatagcaatggtgatttattttcatctattcagtccattttctccacttcttattacatgcatctcaataatctctgataaaggcagcctctagctctggagataacgtgactcatgggccaacatggggatcaaacataactttcacataatacctggtgcttactctaggaaataaagattattgtcttgtaaaattaattttggaatttatatcatatgtaagcaatttctgtattggagctaatgagtatatcaagattaaattgacttttgttaaagaaaatagattaatagaattatataacatctatcataagataataaaatatttaactcaggttggtaaactgtggcccatgggctgaatctgacctgctagtagtgactgtttttgtatgacccatgggctaagaatagttcttccatttttagctgaaaaaaattaaaagaagaattcttcatggtaaaaaataattatatgaaattcaaattttattcttccacttattagtaaacctgcatgacaaaaatttctactcaaatattagtattatattttgaattttatcaattaaattttattaagattgtttaccctcttactatgtaactacttacataagattctttactctctggcactttatataaaaagttaattgacccctatttaaataatatacaataaaatgataagacatgaaaagtgtataaattatacttctatgataaaatttagtcttaattatttagcacacaaatatatacttgcagagttgtggtactgaacgcaatgctattattgccaggaactgtaacagaggatatcttcaagttaatgtttccttgtatgttttttcttaaagactttattgttcaaaaatcttgatatttcagtgggtataaattatttgtaaaattcccacagttttaatctcaagtggtcttgttaggataagatatttgatgaaatatataagtaatataagttcaatgaagtatataagtaatataagttcaattaactgtacaagtaattgcaacttagatgttttgaacaaaaattctgctgttattttacattttcatgagtataaaatattccactctatcttaatcagcaacttacatttggaatcaaagatcatatgaggaaaatgtttttgatagaagagtatttttgctcctgtgacttttaaagcagcagctttctaaaaattctgaaattggccaactttctagaataaactgaaaaatagattttcatttaagcactgcccactaagagctcatgatatttaagcaagtgattttcacttacccttgtcaataataaatttctgggtaaatggtttgtgtatttgaaattgtatttattttagaattccaggaactgatctttggccccattttatttacgctatactttttcctacagttttttgaaaaattaaattaaaaatatgatgtaatatcatttaaaaacccattttcattttttcagttttttttcaaaacaaatggtcacttgttaaaatagtttattttttcattatattgtttttagtgcttcagctttaaatgaagatttctaagtctcatcaaaaggccaatttccaaaaagaaaataaacccccccaccaaaaaaactaggatagtctcaaagagcttaactgaaatatgactttctctgagtgtcaaaggaattgtgatgagattcgtgatcatccactgtaagtagacaacgattagggataatgacattggcattacatggctttgagtttttaaaaatagaatatcagctctgctctacaaataccgatttttcttgtttaaatactatgtttaaaatttaaagctattctacttcagattaaacaatattgaggccttaatattgttcactaatgaatcatatgacctttaggttgccaattagtcccaggttgtttaagaaatcgttctgttataaagacacatgcacatgtatgttcattgcagcactctttacaatagcaaagacatggaatcaacctaagtgcccattagtgatagactggataaagaaaactggtacatatacaccgtggaatactacgtagtcacaaaatagaatgagatcacatactttgtagtgccatggatggtgctggagaccactattcttggcaaactaacaagggaacagaaaaccaaatactgcatgttctcacttataagtgggagctaaatgatgagaacacatggacacatagagggaaacaacacacactggggctttttggaggatggagagtgggaggagagagagaataaggaacaataactaatgggtactaggcttaatacctgagtgttgaaataatctatacaacaaacccccatgacacaagtttacttatgtaacaaacctgcacttgtacccctgaacttaaaaaataaaagttaaacaaacaaaagaagtccttcactatcctttaaaaaatattttcattttgttttcactgactgaaagtttacagaatgatctagctcctgaaaacagtaggaagagtaagaaaaatgcatccaacattgttatgtgcatgttcagattgttagttgaatatatctgatgaaatattaaatcatgcagactttgacctgattgtcttccatgctctagtgtttcaattattatttatagcttatttttcatttttattcattcaataattttgacctcaactttagaatttatctataatcattgaaattatatttttcaaattaactagtatgatagggaagggttgacccatcacagtgtatgtgcttaaataggagatgtttcctatattgttgcatgatgttcctatgttgtgggtggtggtggcatgcaaattcttataaaatgtatggatgattgttttcatgggtatttcagttaggaatatttaggaatactctttaacagattttcaagaacaggtcttgagttgtagcatcaaatgctaatatcagtttgattttgatcactttaaaaagaaaaatctcagaaagtgaaagaaatgccccaaacctcatgcagacaaaaattacagagttttggagaccctgtgattaactgaaaacactgaaatgaagtagtttacccagaagattaacattggaattggaaggattcagggttttaaaaacagggtttaaaatcttaagaaatagtagtttacccataattttaagttacaacaaattgtatctctaaataacaaaaatgtcattgactgttgaattgtcttcttatatttttggggaaaattttgatgtctaagagtttaacacttaaatttcttccatgagctcttaagctgtgattgtctgtgtattgcaattaaatatgcatgcctgtatgtgtatgcatgcatttatttgacttttgaaactggctttccttgtttttaatctatgatttttaggctctccaaagtgctgattacttcagggggctgatggctctgtgttggtaaagaccaatctgacatataattgcacaagcaaagatacttttgtttcttaattgacttttggaggacaaagattttttccaaaacgtcttttgttagggtcttcatagttagttcatagttactaactacagttacatagttctgtagttagtgaaaaactacagaactgtgtaatgataaagaatgtacatgccaaacgcattacaagttatcattattgcttcagtttgcccatggaacattggtatttggaagaggaagtggatatgcttgggtgttttttttcccctccttccagtgaattttcattatggttcatggaaaagtggtactctagtaataaaactgggaaaatagcataacagcaggtaaaaatgagcctgtttatgttacagttaatgagtcattccaatgtaataattggagaagtgagtgaagcctgaaaacatttgacattttaagtagttcaaaattagtaactataaaattttttaatgccataagtatttaatagagcagtgatgaaatttatctccaaggtttttaaatcacaacggaaaaaaatggtgtgatattatcagttggcctatagctctaattgctttttttattaagtacctctcattacttggcagtgctctagaataagatattatgggcttctaaatcgtaaaagacatattagtttctgtaaccattttcttcccactggcaattatgatacttataaatggggtcataggttgatattactttaaaagcaccatgtaaatatataaattcacctgccttcctaaattacgtttattgtatactttttagaaaaattataacctgtaatttcattaatggacttactctgcaattatgacctacggaagtatttttttcaatgtcctttgaataaggacacggataaactctcctagcaattggttgtaagccttagggttgatagttgcttggatgaccttgaacagacatttgattcccttggcccaccacagagacccccacattttcccatcaatataaagcaattgcctttgctataccaggcccaatagagggatttcttggaaaatctgagaaagtcaaatttctaggctaatagctttgctctaaaagagtgcatgtagatttatatctttaagacttgtcttcagtattcaaagatactatgtattggtattttaaaatctgctggtcagctgacgactgaccaaggacaaaaaaggaactagattgaaagtggtctttaagggaaatgagttgctgagatagaattatcagtgtgtgtgtgtgtgtgtgtgtgtgtgtgtgtgtgtgtgtgtgtgaagataactgtgggtgggaattggaaaacagaccattttggtaggggaaatagaaagcattgcccctaggtggcacattttgaattaaatagtgatgggatgtagaataagattgcttcatatttgctatccataccagagtagtctccagtatgcttttaaaccagtatgtgggattaaaaattagcaagaggtcttcttggctctagtttaaattcacccaaacagagaagtgatattacccttttgcgatctcaaagatctttattttctaggactcggtgtaaagacctcaggatccccagtagttaactcaacttcttctcccaccgtgggtgctagtctttctgaacctagcaatgaagcagaatatgttgggagagattttggcttaaaaatcactagataaattgaagcataatttaactcctgaagacaatgcggtaaagtgatacgggtggcaagagaagggcatgataaacaaagttgaacattttttcacatctttcacttttatctctcaattttggctgattttaaacaaaaagaatttatgtccaaggcagaaagctgcaagaatgcttagtgatcctcataattaaggatttataatacatatttacatttgccatgttttagatgtttaggacttaattaaaagaacattgctaaaataaaagcaattctatctaaattggtgatgagggaattctatgcaaggttgtaaagctgctcaattaggctcttttgtttcatagtgtgtatgatttctgtgcttatttgaactgctgtactttaacatgacaactgtgtcacaatcctgttaagaaaacttcatgctcacatacagcttcataacactacctcttaagtatcaaaagatgtaagcttttctaaaacaaatatacaaaaaatagcaataatttgaggaaagaactagggtacatttaagaaagcaaagagcaaacactgtagataacatttagtttcttaaactcctagcatcctttatcacaaaatgaaacatgataaaacaaaacatttcatggtcaaatacatactaggggaatggaaaaaggaggctaatgtagaattttagctactaaaaataaaattgtgatcaccataatttgctacgcttaacacgcaaaacagcctgattcatttttttaacctgttctctttgtaaatgatcacattggtttcttggaagctttgctatgtgcttgcctgtgggatagtttctttatatttatgtataattgcaacatgaaccagattagcatgaaagtatgtaggtagtaccattaatcactgaaacattctctagagaagatgtcaggaagttctctgtttttctgagttagcaaaatcgagcctcctgtgatcattttcctttttcattttcctggatatgaggatgatctggctgtgacatctgtcgtgttagcgatggccagggttgatttggctgagatggctggtaaggcagctgttccctcttccttcctcactgctccctgtgaccctgattcactccattttatatcatacaatattttacctactacacatattattgtagttttaggtaagcttgacataatgtactgttatatttcaccaaaggtacagattttaagaaaaagcaagttttgccttgcagctatatttcattgttaggcacatccaacattaagttgaggcttatgaacatggcaaacaaatgtcttcctactcagtacttgctgatctttccacttttgtctgtctttactgcttgatatagcttggctctatttcccccacccaaatctcaccttgaattgtaataactcccacgtgtcaaggacaggaccaggtggagataattgaaccatgggggcggttgtccccatactgttcttgttatagtgaatgagatctcgtgagatatgatggttttataggaggctttccccttcacttggctctcagtcttctcttgcctgccaccatgtaagacgtgcctgttttgccttctgccgtgattttaagtttcctgaggcctctctagccatgcagaacagtgagtcaattaaacttcttttctttgtaaattactcagtctcaggtatgtcttcatagcagcatgagagcaaactaatacactgctttttcttcttcaatcctggtgtcccctgtgtcctctactcttcatttcttggcctttgcatctgttgttccctttgcgtaaattaccctcaaatacttcactctaaaacctcttggaaaatgtctacccaaaacaagcctcatctcctttgtccatggagtctcaccacctcaactttaatcattctctagcagaaatttcatagcacttcaaatgtttgcttattcctgccctgatcatagactatcaaaatggatttttaaaaagtttcctttgcaaaactgaaatttttgaaagacagaagtattatgttaatcacttcagtatctgcaacatctagcacagtgcctggaataaagagcatattcagtaaatgggaaaacaatacgttgatggatgataatttgtattttttttcagttgaaacaccaaaaacagagaagatgaacagaatcaggctagacaaattggaaaattgtgttattttggtgatttaaacgtcctttttatttaggatcccattgatttttgctatcattttaaaactttgactttgtatttaactctattccatttcatttcattaggttgcatacatattctagtctgtcataatccattatggtacatattctcctggtcaacctattcttactatttctcactatctctcttttcctttccctctcaccttttaaaaaaaaaatttatagcaaatgtaatttgataggccactacatcaaattattttggattgaggactctcaatagacaaacaaaagatacatcatgagtataaaataaaattggaacagcatcagctacttccaatccatcctcatgtcttcctatgcctgtagcacgtgcccgatcatctctagcaatttgaaagtagtactgaaaattactctccacattatgagaagaaattttcaactccatccagtttggacttcaagtcttttgtattggtttttattttccattttctctttaaagacttttctcattcacatagggtagaagaaaaataaaattcattctctattttttcttttcattattaacttttacaaagcagtgtgaccacagcctccttgcccttcttttgcctacaaacatatgcaagatgtttcttttcattgcctttagcattttttttttttttaccagcattaatgagttccaaacttttattttccgcctgtttttttttgagacagagtcttgctctgtctcccaggctggattgcagtggcacaatctcggctcactgcaacctctgcttcccaggttcaagcaattctccttgccttagtctcccatgtagtgactacaggcacctgccaccatgcctggctaatttttgtacatttagtagaggcggggtttcaccatgttggtcaagctggtcttgaactgctggactcaagtgatccacccgcctcagcctcccaaagtgctgggattacaggcatgaaccaccgcacctgtccttattttcctctcttaattgcacatatgttccttttattattttctggtaaaacccatcacttgtatttagattctgctcacgtttcatcctcctcatggtacacatttgtgatttttattgccagaagtttatagtcataacttttcatgcatgttgacatatgttatcattaataatgacaaatattccttttgcagtgggctctgtggactccaaggtggtgaagtgtgccctgtgttattttattctcacacaggcctgtgagacaagtgttactatgattattttacaaactaggaaacaaatttagaaggtgcttccaaagctactgagtaaggaagaacaaaaatgaggcttagacccaatgactccaaaatccattgttctttgaaatggaaagtgcccatcttctccctgcatctgtgaaatctcctctcctgaatatcaaaaccacacatgctcattctcaaggttctcgctctggcacgatagtaaattctaagaacccatataccacatatgctcattccttcctcttttttccaaggatctgtcactttcatcttaacaacaagccccttttgattagtcggagtgaagtggcaggcactcgctcatgtagataactaacgttttctcctctgagtgtacactgtcctgcttgcttcttggtacccaaagacctattcacttcctctaaattccttctttgagtcaacaatttcaagaaaagggtaagtggttgaaacagcctaaatcacaaagaaaatccaactcctttctgcaagattgcagcactgcctgaccaaggcattctaccagttttgttcctttcctccataaaagcttcactccttcccgatgttcagagacatattccctttggtgccatattagtcttctatggctgccataaccgaataccacagaatgagtggcttaaacaatgtacattaattttgtcacagttctggaggccaaaagtccatcaaaatgccatctaggttggtttttggtgtagcctctcctcctgacttgcagatgaccacctccttgctgtgtcttatgtggcctttcctttgtgcacatgggagagagagagcgatatctctggtgtctcttactcttcttataaggggccagtcttattggattagggcctcacccttacaacctcatttaaacataattgcctcctgttatggccctctctctgaataaagtcacattggggattagggctttgacatattaattgtggagtggggggtataattcagtccataacaggtgctctcactgttgcaactgtctaaattacattgctttttttcagtattgggaaacaatttttgaaagttcaacagtagatacattgcttttacaggttaaaacttaacagctgagtggagtcatcctgaagttgaatcctggttcagtgcattgccgagatcaatggcatggcattctcatccatcagccaccactgcctggtggacatgggggtaccactatctatcccttctttttctctttgcttttatctgcacctggtgctgtctaggtgcctctagtacccaagagtttctgatatcccaacatttccatagccattatcacaagtattattttatccccttccaaagtactttcttctgtatgttacccagctccagttgtgctgtgatttgctctgtgtgtttctcatatccccttctcaaaagttgattgtacagtttgttttatctggcactttcccacttcgtaatcagtaaatctcagtacacacagctcctcctccttcttcctgtgatacattctatgcttagtcaaaaacaaacaaataaaacataaataaagcaaacaaacaataatctttctagtaagttttgaaaagtcagtttaaaatttatcatctaattttaaatttgtaggatgccctccacgaattgagaactgggacagatgcttgccatacattatttcagtcaatcttagcacagcatctgttcatgcccagtgttttctcatacgcatgctttcccatcctttccagtgcatttctcttgtggctaagtagcctttggatttatcttttcaaaggtttcacagtagcccatcaagtggatatacttttatttaaacattcctctattttgaactcattggttgtccattgacttattttttgatttctcagtctatcagcatctgcttgtagtagtatatggctcccttaagattcttgtatttctctaatataacggtatcttaacccatttgcaaatgtcaatgtcatgaactgttcaatgtcatccaactttgtcttgcaagagtccacatttcttttggaaggagaaatgtaacgttaccactgtctccttgcacccctccccttcctgctcaagaatttatggcacttaaagataattccttgcctcttcgagcactatcatttgttcaaccatgaacctgtggtggtgggtacagactgtcatgtatgacggatctcagaagtgcatctgtcaccctccaggaaaccctttcactcatcaattggtcttgtcatttataggcacagctgtctctccagccctcagcggcattaccaatcttccctacatgtgttcctctctggagctcagtgcctgtggcctctgataggctgctgcaaatgcaggttttcggttgtaaccatcagcctagtgtcttctccagaggcatgatttactatttatgggtaggacctcctaactgctgtatcattcctctcttggtactgattttgatttccttctggcatcatagagttttctgtcttccttatcaaaaatatttttttttctgtctttttgaagaaaaaataggcatcttaagaaaacagactagtgtttctcaatacttctactttctgcttatcagggacagcaacctatatttaatgaacatcaaaatgaaaaagaaaacacttcagatttagaattttgaatgagaagtctgtttccattgctaaaccagaaccagtgctacttaagccagtctcctggagagtgaatatgattctgtaaaatatcaaatatgcttttgagtagtgctactgattaattccagccactttcaaaaaagaaaaatatcagagactttcaggccacgttttacctcactctttcttagactgttaacccctatacacctgtatagcccagctctctttatagttatgcctgaagctcttaatatttcttttttctttctttctttttttttttcttttccggagcctcactctgttgccaggctggagtgcagtggtgcaatctcggctaactgcaacctccacctcccgggttcgagcgattctcctgcctcagcctcctgagtagctgagactacaggcatgtgccatcacgcccagctaatttttgtatgtttagtagagacggggtttcaccatgttggccaggatggtcttgatgacctcgtgatctcgtttttcactattcacaagcacctttaagcatttgctctatcaaacaaagcaatgtgatcgtaattttaatgatattttctttgatataacaatatttatgagctgttttctagttttcttcctatctacctgtctatttacttgtgtatggtttacacaagtaacaaaatattaagggaaagtgatttcagagggaattaattaatttgttctgaaatgaatttcttcttaatttgtataatcaatttttaggtggatttgagtgactgcacttaagggatcacttgacagagcatctcttcatagttttatagctctttgcttggaacttactggacattgttgaaaataaaagaatttaatcacatttcatatgctaggcaaaatatcaggtgaaatagtacaagcaagtggctgatcttagaggtgcaaatcatggcatctaagaacaagctgcttttttttttttttttaaaaaaaaggatataattgatgcccgtgactgaatgtagcatttttagtagtgtggtttgaaccgagaattgtatttagcctttctctttatgttctacagtcatttcctaagacatccattcttctcagagcaagagaggcaaacagagaaagtccctgtctgtctatctagtttccatttcagggacacttcttatttctaagtggacttccagtgtgatatacagaaaataaattatcagagattttggagagcgagtaagaaacccactcattcaacttctgaaacagctacatgtgagtttcttcttccagtcagggtggtgaggtacgatgataaatgtgtcgcaatccctgctattcagggacccacaagcaaatggagaagacaaaaagtaactctaacaaagagcagactgtgatccatactacacttcagtatggattcctgatctaatacaattctgacttatttggtaacctgtgtgtttcctctcatttctcttaaaaatcaataaataaccagtaatatcactagagttgacatcagatgggtttttatatttttcacctacctatgaagtgatagtttaaaaatttatccccaagaattacactggctgaatatgtttcatgctaaatgtactctgtaatagcacactttgggactctggttatttttccattgacactgatgattcagtgaattgtatctaagaaagaaagaaactaaatatgttaaaaaatttcttagtaaaatattttttacattccttggatagttttggtttcatacactcactcttctctgggttgggctattattcattcagtctattaaagtgttccaaaacatagtaatttctgcaacttcttggggtttcactttactctgcacatttcattcatttattcactcaacaaatagttagtaagcctccacattgtggtacctgtcattacacatgtcttcagcaccagttttcttgaaatgttattatggtctcaatctgtaaattcttgctcgcaattgagaacagaagtttcgactctcagatacacaatgcttttgtgaccacattttatgctgaaggttttgcttttttcttaagacaaaatgtattgtattgtttaaggtgcttataggggggccggtgttcttacaggcaatgtgctcagaggctgtgctcttacagctcaccctggcttaaagctcagctttgccacttcctggtcctgtagaaaaacagcacagtgtggtaagtgcaatgagggagaggcatacacaatatttggagtggtcacaggcagaacatcagatgtgagcagtgggagtcagtgaaaggtgtttactgaaggatgaataggacagctagatgaggaaagaaggcggaaacacatgcccatcatagcgaggtccacaaaagcatggagtctttgaatgcaccacagtagtgcagaaggacaaaaatgttcagaagtggccaggtcatgaggaatcctgtaggtaaagctaaggactaaggatctgatccagaatcttgaggggtcattttattactataagtgttatgcatgcacatgtgtgtgacactgattagatttgctttttataaacttaaaattctcaggagggtgaaggatgggaatgataaaaaacaggaaatggagtctaacttgagtccacagagactagatattaagctggtgaactaactcctgtaaaaagtaataagagctacagaaaaacagagacagtgacaatgctaataaagaacaggcaacaacagagttgttccacatgagcacgtaggactgacagcacgtcatggctgtcggaaagtagtgacatgtgagaggaaggagtggccaattcaagttggtggcttttgctttttattgtattacaataaatgtgcttatatcttccaaaggatgtactatgctttttgtatgtagctactattcttctgaataagaatttatttatttattttttgaaacagagtcttgctctttcccccaggctggaatgtagtggtgcaatctcagctcactgcagcctctgcctcctgggttccagcgattctcctgcctcagcctcccaagtagactagcggagattacagacatgtgccaccatggccagctactgaataagaaattttaagtgtgttcattttttgaaactctcttcctaaacttctctacaaaggatcgtatttaaaagcttttttgagattgtgtgtgatttctacaatgcaatgtttgaggaatatgccatggtaatgtattgagtaaaatctttctgaaataaggctgatacaaaatgttttctaacattatgtattgttgcattttaatgaaatattttgcttttggcaagaataagaatttatcctgaattgaaggtttcataggtgattcttccgcaacacagagcattataatgttttcctgccttccattcaaatacctacctccaccccacccatttgacttaaatagtaaagattaaatacatctgccttatgatagaagactgaattcctatagctgagttatttcaatgctttgggaaagatacatttagggcttatgtatttatcattggatgtgtaaaaagagaatttggtaaaatgataaaatggaaaagcaagtttaaaattttataatgtgttcttcaagttatattcaatttaattaagcaaacatttaccaagtgcctgccatattgaagtatgttctagaacacaggcatataaagatatagagatgctgatctcaaaatggacgaaagagagaggcagagagagagagagagagaagaaagagaaatggtatagctaatcatgatggtacaaatggtactacttttggaaattccacatcaatttgaatccagtatttttgctgtatctaaggattcagcagccaaagatgaatgctattgaattattgaccatatttgataccccaagcattgagaagagctgaaataattgcccctccagagagctttaattctccagtgtgttctgtagcattaaatcttatgagatttaaaaatccatggcaggaaacatttgaggcttccagttgctctccgttggcaactgttacatttttaaaatatgcccctggacatatccagccatgaagaaaaacccagaaggttttcactcaacaaagttgtaaagaagtaacctttagtaacttataactgaactcaaaagacttaaacataagagggaaatctctttttcaaaaagtgttttagcattttggacatcagaattgcaagtacaacaaaacaaacaactgctctttagaaagctattttaattgatggcactgtttagctaaatcttcttgggcatttagatttcatcatttctaaaacactgttattcaatttaattttgcttgaaaccaatacacatgtatttgaaatcatattgactgggaatttggatcctagcaatataaattccccacatcacaaagtacttgaggtgctgaatgaactaaaataaaagataactatttatatttatttttgttcaatcataataatgtatttaatttattatgttgcagccctaaagaattaaagggagctgttttttcaaatgtgcatgctccgagttgtgttacagtgaaaaattaaattcttagtactgaggaagaagataattttatttgatttacttgactttacttgattataatctattgctgaaatttcccctggggtcattgaaatatatgttctcaggctatgacataatctattatcttttaaatttatcaacatttactatacaaaaagaagctcagaagcttatgatagatagatacacaatccttcacttggctactggttatatgcaaatccttcagcatgctgtttcagaatactttatccaagaacttcagataacttgctctctttaattttgtttggcatctgcagcattaaaaaatatctgttaaaaacttttattttttcatttttcataaaagaagacctgataaaccagatactaaattagaatcagaaatagtctctgcttctccttttcctcatctactctttatgtcaaacatattatttttttttcttatcacccgtaatcagaaacctgaagagacccttctgtttttctgctatcttcacccgtctcttcacatagtcacaaattactgtggctgcctctttagtgtccctacatcttccccatctcttttgttctactgccacagtctttcaaactacacagctgagcacacatttttaatgttttattaattactgtgctagggtcttatacagggtgccataaagacaaagaggacacttaagtccaaggaggttagccggtaggtcttcatctggaggccattccaagctgataatctcagtgaacctgaatagaactgtgtgtttaatcaaaatgtaacagtcaagtttaactaaaatgcaataagcaaaatgtaattttcctggagcagccatatgaaaggttgattgggtgggagaaagtagaattgaaaatgagtttagaattaacagtctagcttttatgaatggcaattagattctttggattaccccattcattgtgtgtgcacatgtgtgtacatgtatgtgtgtgtgtgtgtgtgtgtgtgtgtgtgtgtgtgtgtgtgtgaggtaaggggctgtgctgagaagcagccagagtctcagttctagggtccacccaagcggaagaattcattagaatctgaaatgaaagcagaaagccaacaagtggagtaaacacacccttaaagtaatggggtggctgcagccatatagagctctccaagggctcagttgcctgcagggatgctggccaactggactgctgatcctctcctagaccacattcttatcaaggggcacatttcctgagacattcagtctctttctttttaagccatggagtggagccaaacaatatgtgggtggtggacgtttaataccaatagtgagttgggtgggggcaggtagggcagaaatgattcaagtgtggtttgtattaaatcagttcctctttaatgattgtgacttgatgttctctagaacctggtagggacttctaacttcattagttacaacgtcttattaattcaagatggattaaagacttaaatgttagatctaaaaccataaaaaccctagaagaaaacctaggcagtactactattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacatacagaatgggagaaaatttttgcaacctactcatctgacaaagggctaatatccagaatctataatgagctcaaacaaatttacaagaaaaaaacaaccccatcaacaaatgggcgaaggatatgaatagacacttcacaaaagaagacatttatgcagccgacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacctagccatcccattactggatatatacccaaaggattataaatcatgctgctataaagacacacgcacaggtatgtttattgtggcactattcacagtagcaaagacttggaaccaggccaaatgtccaacaatgatagactggattaagaaaatgtggcacatatacaccacagaatactatgcagccataaaaaatgataagttcatgtcctttgtagggacatggatgaagctggaaaccatcattatcagcaaactatcacaaggacaaaaaaccaaacacctcatgttctcactcataggtgggatttgaacaacgagaacacatggacacaggaaggggaacattgcacactggggcctgttgtggggtgggggagtggggagggatagcattaggagatatgcctaatgttaaatgatgagttaatgggtgcagcacaccaacacggcgcatgtatacatatgtaacaaacctgcacgttgtgcacatctaccctaaaacttaaaagtataataataataaaaaaagaagttaaggcaactttttgcaggtgacatctggaatatcactgatgtacttttaaagaatatcacttttaaagagaacacattccattgttgcttataagcagatatcttgcctatcccacatcatgtccacatagcacaatgtcctcaaatacttgctgaaatagctagttcaagcaataaaatgggagagctgtgctgttggacacagggaggggaacatcacacaccagggcctgtcggggttggggtctaggggagagatagcattaggagaaatacctaatgtagatgatgggttgataggtgcacaaaccaccatggcacgtgtatacctatgcaacaaacctgcacgttttgcacatgtatcccagaacttaaagtataatcaaaaattataaattaaaaacaaagatgttgaatggcaaataaatgagaccaatgtcatcagcaagaaattaaaattctctgaccttcaatttttcatatagaaaataaatagaatatctttctcacaaagttgtagtaaagatttaacgtggttgagatatagcatgcaatacatgtaactataattaacatttttctctagagggctccagtcaaaacattggcacgttggcaagcatcaatttattttattcatgtcttcatcgataaacatgaaatcaatttgcagtacattagacactatgacatatgttagggaagtacctggatgtcaaggaaggggtatcttttattttatttatttattttatttttttcactttccttttttttaaattattattatactttaagttttagggtacttttataaaagagtgcctaggtgatgaacaagtacatacttggtcagtttaacagtattttataggaactaacatggaaattataacttacagacatgaaaacaaagaaaaactataccatagtcttcataattccaggaaattgtgggtaagagtagtgtataaaaaattaacacacacaaaaagagcatttttgaatgagactgttgatctttgtcttttactatgggaatgatcaatttttaagcagctgtcttgaaaaacaaaatgacaaatggtggctacttgtaaagccatcatcatattaatagctccaagggttactttcaactgatgattttaagttctaaaatccaaaaacaaaaatttaaacataatttttttaaaaactgtgtttgaggccaaaagtggttcatggtgggatatgcaaatgaattgaattgaaacaggtgttttctattttaaaataatttatgatctaattcaaggcatggtacataacatctaagataatattaacgattaatatagtggtatttgcaaacagtatgtgaactcatgtatactgaaagacctggaagtacatgagttaccagtacttggtttagtaatgaagaaatgttatcaggactttgggagggttacagtttttactggcgtggtccaggtctgttctgcttacacggggtaaatcagtcactgtgacaaaggttttgcaaaagaggaaagatttattggcaaggtctccaagtgaggaggtgggagaacagctctcaaatccgcctccctgaagatgaggcttagggatgtttatgggttaaggaagtggcatgatctaaggcatggggaaggtgattggcagtggggaaaaatgaagtgacaggttggttttgcacaggaataatcagagttcatggcatttcgtaggacatatgtacagaaaacagtggcattagcatgatctgagggtggagttttggctctctgacatcaaaaagccacctctcgggcacttgcacaggcccagttgaaaggccagtggtctctactggtttgaactgaacagcagctggcccaagtttctgagaaacaaccgaagcgaccattaccatggtgacttaggaatgatatccacctataagtagccagggaaggtacaatttcagcttcagtggcgaggccttcagctaccatggacttcagcttcatagaaaaaggaaaaataaaaaacaaaaaacagaaagtgacaaaaagcaagcagggcaagtagatctgacaaaattaacccttcacttcacaatagttttgaaaagagctgaaggacctagaaatatgaaggatcaatcctatgatctcatctaaggcttgggattctctccaagctcacgttaattagcagaatttccttggagctgaacctccgtttatgggcttgctgtcaatccagggccattttcgggtcctagaggctgtccatcgtttcttgacaggtgaccctttctataacacggtgattttctccctccaggcctgtaagataaatttcacccatgcttcttatctctttcactttttgtgtctctgacctttagaccttttgaaggtctcccctgattaggtcaacccactcaggataataccctttttaggtaattaaattaaggacctcaattaattaattacatctgcaagattagttttgctatataacataacataagcacaggactgataccccgtcatattcacaaattctgcctgcactcgaggggaggggattatcctaggcctatacaagtggctgaaatcttgaagaccatcttagaattctgtccactgaggggctcacacaccacacacctgactatctctccagaagggagggctctatgccacgatgctgcatgttgtttagggagatcaggagctggaaacatttgagtgtccttgtaatagtgatgggtccctggtagggggtgtagtcttgttggaaagagtccagagcttagaatggttatcagttcttctgtactgagctaatgcacacctactctgccagcttttagccaagcttctaaaacagtggaaatgaacctctgagaccagccaaactttttccttgcttgattatgaaatcaaacacaataatcttagctaatgaaatggaaatattctccatctaatctcatgttattgctcagagaagcttattgtttctagttggcttgattttttttcccttagtgagaaatagctatttattaaactagctttatgcactcccctattaaaacccatttatctgcaggaaaattccttatcactaggaaacatttcagccttcatctttaagtgtgatactttgagatacaaataacaactcttaaaataatttagtaataaaatggaacatttgttcagtgatgttgaaatatcacctaatatgactagaataagaattgaattgagacttactcaattttccctccaggaatcaaagtcaaaaccatggcaatttcaggttgaaaatatcagtaatggaagtagcacatacttaggaggacattgttgctgtgacttcatggacatgtggtttagttggcacagtgtgaatttctaactgtatcatcaaaggtgtccaaataaagagatgcccatgttctctgaattcctttctctctttcttaataaattgtggctgtttgatttctgcatcatgtgcagtttaaaattctgcttttctggagaaaatgaaacaaacagctctgaagctgaagagatgtaaagaaaactatggtcttttggaacatcaaaaattatttcataatgagaaaacaatgcatcgtaagaacagttttactttctttttaagtaattcagtaaaatcccctttttttttaagagggaaggatagccatgtggttacgaatgttgaatgctgatttctctctttctctttgaggaataattcttataagattttgtaagacatatctacaaaacttttattcagttcacttttattcagttcacttttattcagttccaactttggaatttataataaacacttaaagcagcaatcataaacacttacatagtactttttatacaccaggtaccaactactctttatctgctgactcatttaattctcagaaatccatgttttgtttagtatgtaccatcattatcctcatttcgagataggaaaggcgatttaaataaaatgcctaagatcatgtagtacttagcagaggcagaacttgaacccacagaggaggcttcaagagctacacttgtaatcactatgctgcacaatattctggcttcagtgcaaggcgacaggtaacctgatattgatcttccagtcacttaacatctcagcaagcagagacccagaccaccacagaagtgccataatagaagcctgttcaagttaaggaagaatttcccggtaggatgggagggttgagggctctcaagaggtgtcagagaaaagggggcactatggctgagcctggagcatccccaagggctcaaaaaggagggaagaacatttctcagctttgtgcattgaagggaggattgggataatcttccaagtgactttgggagggatccagttttgtgtaactcaaaataaaattatacatgtggactccattgttaaatggctctctcagaatgtgaggtctcatcactaaagcaatatatgtgtgtcgccacatccgccttcaaaactgcttttgaccaatcagtgggcaatattttgaggcacaaaatctgaaaaaattaattgtttggttctgcaattacagtttggcaacagtggtaggcagaaatgtggtcccccgaggatgtccatatcttaatccctaaaatcattcagtttgtaacctttaagatagacttttttactcaatctcatttcttgggaatccatccaaattgtacatcagtagtctgttcacttttattgcagagtagtatttggtgatatgtatgtagcacagtttgtttaatcactcacctgttgaagtgaggttggactgctatgaacatttgtgtacaggtttttgtgtgaacataagtttttatttttctggaataaatgcctaaatgaaattgctgggatatatgtaaattgcacgtttagttttacaagaaattgctaaattgctttcctctaaatttgtgaattgattttcatgtatttgagaaaagtgatcatatagttatttcaattttctctatgtctgtgacaatttcctggtttaattctcattttgtatacttatactttctccataagaataggtagtgggattttttggttataatttattgtcttttttgttttgaagaactagatcgtagattgattgattttgttgttattgcattttctaactgattagctggcattttttttaaaaccaattccttccttgtgctttcctgatgtttatttcattgttttttctaagttgagtgctacgtaatttattttcattgcccgtttttaataaagaaattatctaaggcttttgaatttaaggctctaaattccccatccttaatttagctattactgagaactggggccgacctgaccatgggaagtgggtttacttggcttagcagtggggaaggaactgagggtgtccagagcctggcagtctggcaagacccatcattcgtttttgttgttgttttaattcagcttttatttagatacagggggtacatgtgtagatttgctacatgggtatattgcacccaggtagtgagactagcacccaacaggtagtttttcaacacatggtcccctccctttctccccactcaagtagtctgcagtgtcagctgttcccatgtttatgtccatgtgtgctcaatgtttagctctcacttataagtgagaatatgtgataactgcttttctcttcctgcattaatttacttaagcttatggcttccagcttcatctgtgttgctgtgaaggagatgattttattctagtttttggctgcataatattccatggtatatatgtatcacagtttctttatccagtccaccactggtgggcacctcgattgattccacatctttgctattctgaacagtatggtgatgaatatatgaatgtatgtgtctttttggtataaaggtctagttgtcctttgcatgtatacccagtaatgagattgctggatcaaatagctccgttttaagttctttgagaaatatctaaactgctttctacagtggctgaacccatccttcttaataaggttatagactttcatttcgaagcagttagttggttttgatatttttctgaagatctgtcttttctcattgttttccactgcgtatcaacagtgggcccttaacatccagtggcaaatatgccctttcccgactccccaatctctacaaaaacaaacaaaatcccacgtgaatgcaataaaacatgattggctcctacactctgaaactgtgaatatttagttggaccagttatagaaagcaaaatgttgaaagcaaaaagtgaaaaatctaactggtgctcaagtcagaggatttgaacgtgagatgtcacaggcaggagtcaagatgattcgcatacgtccagtgacaggtacagtgcttgatacgaagattttgtttccacaattccaaatcaatttatcacactgactaattttcgaggtggtgcattaaagacaggcatatgaaaaatccttgatgagaacacacttttctttgcttaatggtattgggaggtataagaagaagggatggattattttaagtacctactctgtactttttaaatgttatgtatggtataacatgaagttcttgcagttctgttgtgaaggggatattttcatctgcactttataggcagaggtacatcaagttgaagcagtatgtatcagacctcgggaagtaccagagcaagaatttgaggactggcctctctgaatccagaccccatgttttcacaatgcttaaataggtcactaacaaagagacaaatgtttgattacaatagatggttaagcacacagccatagcctaacaataacaaaagtacttcattgaataacacaaaaagcatgagcaaaattaaagatgaacataaaaacagaaaaagcaactgaaacaaatatgtttggccaacaatgtatataatatcgtaattaatttaaattatgtttctaagtggaaaaacagaggataatgacagacaatttgcaggtattgagaatggataacaacatatggaaaacattgtttgactgcattaatcaaagcaacgatataaatacacaactactacaatttgttcacttagtaaatcagcaaaccttgctgaggtgtgtgtgatgaaatggagactaaattgatattatcattgtggaaaaaatggaaatatgtttcagcatctttggatatattttttaaaattaacttttgatcctctaattctcctagatatctattttaaatgcatatatatatatatatatatatatatatatatatataccaaactccagaaatgcttaccccataaagatgttcttttcactattcctgatatcaaattaggtgacatggcgtcacatatggccaaattatctgtcaataaaagtctgtaatgtgtgcagatttctagatctctgatgctctctttactttctaaaaaattattatttcttctaccccttcacctttgattggtctctttgtcttaatatctggactttaaatagttgctattaaacctctaaaatcaatcagcccctggctgttctgtcattagaagttaactgccttcccattaatccattaattgtgaagattaattggaaaagctattcaaactcaggctataacttggagcatgtaagccagtgtttgcctccaaatgaaagcttaggtcaataacatcacagagaattaacagttatatataaattctactcatgtctcctataagagaaaatgcatagaaatttataggctgctgtctaaatgaattacttgacaattagaaaattatccctgtcttagtagtttagctctaggaaaacatactgatagttacttgttttaaattgcaggaacattttttttttagatttaagccaatgactgacagaattagaagctcatgtttgtgttatttcaaatatctaaaaccaggattctcaagtaaatgttaattttcatgtcaatgtcaaattaatacttaaagaagctaaagaactgcatagtagtctacactcgtggcatttaatcgagttgaaatatcattttaggtaatgatgagaggatgagagacgatgccaggattggctcatatttcatcacctatgcttagaaaaattatattttattcaatcctaggtgtattgtcagttttccctaaacttattctctttctcatcagaatgtgacagtgcagcagcttcctccacacaccgtcaggcaccatggctactacatagggagagaggggtggggtgtcacaccacaaaagttccttcagtccttcgggctgtgttccttcacagtcccgtgaaacagtatggaaagcataaggacattatgaaaggaacaatgctcatcactggacagaaattaatttgcagctctattttagtggtttccagactagcatggttctggctgtgggacacaatcatgggaaatttgacatctccccgaggtgatgctaccaggcagttaggatgaatcactgaagatgcacactacagagatgcgacaaccctgcaacctggagctaagccatagaattttatttttatttttaattttattttagagatggggtcttgctctgttgtccaggctggtgtgcagtggtgcgatcatagctcagggcagcctcgaactcctgggctcaagagaccctcctgcctcagccgtctgagtagctaggattccaggctaatttttttttttttttaaagagatggggcttgacatcttgcttaggctgatcttgaactcctggcctcaagagatcttcccaccttggccttgaaagtgctgggattacaagcatgagcgagcacacctggcctataatactttttaccaggtggctgatgctgctttttaaacatacttgtgtcttctgggtgcttaaaatggactttggtggctcttttttggtgttgagtgtagactgtacagctgcagctgtgaggatgagatggcagagctgggggaaagctccagggtatggagataaatgatgcccacccaaaggaaatcaagcagaggctgtttatttagagtttgctgcagcaaggtggttggccaccaccatttgagtttggcagagactcaaaggcaggcagaggagaggaaactttacactggagtaaaggggcaggctcaggtatgccctggttggaggccttggctaggggaggctgtaggcaggctgaccagaagtggggcatcctatgggattagttagaggtatacatttggctttctctatacttagtaaaatttctaaatatttcctaaacatattcagctggttctaaattggaaacatgggcaaaaatgagggaagctgtaagttattaagtcctggctatttggggctgataggatttggctgtgtccccattcaaatctcaacttgaattgtatctcccagaattcccacgtgttgtgacagggacccaggtggaggtaattgaattggggtttgggcggagggggtggtccgggctttcccgtgctattctcgtgatagtgagtaagtgtcatgagatctgatgggttgctcaggggtttccgcttttgctgcttcctcattttctcttgcagccgccatgattctgaggccttcccagctatgtggaactgtgagtccggttaagtctctttttcttccccgtctcgggtatgtctttatcagcagcatggaaacggactaaaacaggggccagttgctacaggagttattatttggcttcttgcactggttgcttcagacagaagtctggcttcctggactggctcctgtagatagtagtttggcttcctgggctagttgctacaggttctgttttttgcatgcagactggccatttgccatttgtgtattcagtctctcgttgggcaggaaacagaggtacatcaggtactgggttgtgtgtcatggtagggcgaggagacaagacgccacctgggatcctgaaatgaacctgaaatttgtagcagtagcccagactgggtttatggttacagtacaatgtcattgtcaaaatttctgaatgaaatcttgactaacaagtaatattttttgatatatgcaaacataattccatactttcttaaatatgttgatgatttctaattttaactggatggaaattgtaatatagattggaataaaatgttttgttcaggaaaatagatgtcttgaagggaaggccattccttaatcctgtatctgtcaatggactatttggaataggtctaaataaactattttctgatgggaacgagactccaatctttccaaagcttcctgtcaaaggtctcaccctgcctctggtgtatgaggatttttgatgatttaaactatgtttgctacctattctatttattctagtctgttctgtaatggatatttttatgggacatacgattcattagcaggcatgcaactaattttggcatgtcttccaaataactgagaagatgactactcagtggcaactaagctgaatactgctgaaaatcagccctattttttttttttgaaaagtatattttaggtcaccagtgcttgtttcaacaaagtactggttcagaatagaagatctggcaccagattgcctgaatttaaatacactttctaccacctattagtcatgggtccttaggtaaattgtttaattttcctaatttaattatttaattcttgtgctcttttttcctcaagtgtccctagagttaataatatcaaatatattgggtgtttatcaggatcagttgagttaatgcatgtaaagcactgagaacgtagcacctaataatatatacctattatcttagtacaggtaatattacacacagattaagaaaattgaattacttttattaaaaactgaacagcttttatttgcttatgagaattatgcattaaagccatttgtaaaataaaattttcattaattgagctatattaaaatattttcagtataccttgcatcaattaagatgcaagctatagtgaaggaggctattgagtttttttgtatatacaatctgccagagatctaatttaccatttactttttaatgacaatggtaagtttttctgtcatgtaaagagtaaatggtgacttttctgagatattgaacggaaagccatagatttgtatgtatatggtgtatctatatgaaaatgactcagcatatttttttctaatgtggatatttaacagaattcattaaaacatattgtagatgtaactagtatatatacattttttaatgaaaagactaaagctatcgttttactacttccaactgatatcaaggtctatgtggaaattctaatatgactgagaaaagtcaaataaaatgtaatacaatgttggataagcatggagtaatgagagtgatgttcatttcttctctaattgaaagaaacaatgatgaactcaacatacccagctgcatttttaattgtacagacgtccatgaaatgtttggttactcgattactaaatttcactagtgaatgcagacgtccatggtctcctgtgcccttttttaccaagaatcttgtctgtggctcagcagtaaagggaccaggatgatgtgccaatctgatatagcacttaattttttaaaaatgcaattatgttttaggctgaaatagctaaaatgttatttccaatttgaaaagccccctacttaaatgcctgtatactcacgtgcagtgaataatctttatttgcatctgaaaattagctgtaaattagagctaataatcattgaaagttctagctgtgagattactccaggagaagactagttttctgagttgctttaccagattctagaatattgtttctcaaccttggcactattgacatttgagaccagaccattctttgtggtggaaggctaccctgtgttttgtcaaatgtttaacagcacccctggattcaacccagtagatgccagaagtatcctctcttagttgtgatgacaaaagtgtcttcagatattgctgatatttcttggaagtggggagcagtagggtgaaattacctctggttgagaacctctgaattggaatgtggtccttagctttgcaagtctagatcctgtgttttattggtgcagtcagagaaaactggttttctggaattaaactcaggagactcatgcttaatccacaattccaaatttaatttatatgtagagaaaaatatcatgtttactccacactgattattactgtttgaggttctcttcctctcttgtcaagactgttgaagatcaaatgggaaataaaaaaatagcatggcaaacctggaactggagtacacactccttgagagaatttgttcatgctattatggtgtctgatggaactcctacacttcaaacctaaagaaataataattatagtcatggtattcttacatagtggattctggaccgcaactcacgttatagatacggttctatcacaatgagaagagcaaattaatcgaactgtgttcaatgatctcatctgcaagagagtaacattaatatatcaacaaggaggggtaaagattagttactatgtgtggcaggattataacttcctagcacagagtgctctctaaatgtgtcttagttattattagttctgtaagaataactacaatatatcattgtaaaataaacatacaacagattgtaggggcaggtgtatgcccatggtaaagaataataatgccatgtaaccaccaaggccaacaaccaaaacttgaccaaatatcacaagcctcctgtgtgcccttctgttttccatattacatgtctttctccccacgaatgtaaaaagttccccttcttttgttttaattccactcttttaaagctagaggtagaacaatattgattcttaatttatagttggcaaaaacaaatgaacaataaatatatgttccctagagtggttgtaccagagaggcattacatccaaaacatcgatctgaatctacataattgattttgtattgcaattaaacacccttttcaccacacttacacctgcatgctgaaaatgattttaaaaattcctagttctagtaaacacacacccacatgtgcgccctccttccatatacataatgcactctcttgtgtgtgtaaacatacatgccacagtttccagagcatactaaaacatttttgttgttgcctgtaattggcaataatcagaatttccttcaccactccatgggttgtatatctttttatgtctgtattccttattcttgaattacaactggattggctggctttagtacttaagctagtcagtagacatgcaggaactgtctgtcataatggtgaaagaatttaaggtaagaataagaaaaagtagactttgaatgaaaacgagacaatcttgaaaagtaaaatgctacctcaggtaagctcttgggaaaggcattcaagaacaaattaggttcatgtataataaacttaataaaatttcaggtgaatctagataattcttagatttatttaaataattgcttaccattaatgaaaacatttgggacaataaccctgtataattttaaattatagaatgtatatgttaaaaactaaatagagaaatatttttctgattaatgcaaaaatgggaacaacttaagagtataaaataaaaggcaaatgctttaaagatgacatcgaatgaagaattggctgaataaattaaacatgtatggatttcatgatacacatgagattatactttccctcgctctttgtgctttatcttttaatattagaagcaatatatgtgatacacataaaagggtagatagacgataaatatgtatatgcattaatatgtatgtatacacattgatacatatgtaaatgtatgtgcatgtgtaatatattttatatgaaacatcataattataagcctttgactatgccactattaccacaaagggatcccaatccagagcccaagaaagggttcttgaatcttgcgaaagaaagctttcagagcgagtccgcagtgcaaagcaaaagcaagtttattaagaaagtaaagtggtgaaagttcagtgactcgatagacagagtagggcattcacgaaagtaggaggaataatgcggtcacccttggtacaaatacttgtgtgtatatgtgtatacacacatatgtataggattagaaaagatcatggggagatgagctctgctacaagggtttgtgataaaggattaattttcttaactactacattttgcaagaatcaatgaatatctttaaagcaaaattagggatgcttttgttctcaaattattgggacatcaggacacgcccaagtctgggtctgttaagtaaacgttatcaatcggttcccttaaccataagcatctggaggctaggaatacctcactttctgggaatgcagcccagcaagtctcagcctcattttcctagccctcactcaagatggtgtcactctggttctaacacctctgagaccacctatccccaaattagagcattccatcacattaaaactgtatacatgtgtgttgattctgcttttttctcaaggtaaccaagatcctgaattttataattttcatttttttttgtaaaagtagttttttaaactcatatatgtccctaaacaacatacagtattacttagctttgctttttaagattctcaaaacgatcaacatattacatattattttataacttgattttgttttcctcaaaaatgtcgcttctaagattcaactattttgttttgtgttgttgttgtttcttttactggcgtgtattatactgttgtgaaaagcactgttttatttgttctttggccattgggtatctggtcgttaattttttgtttgtttgtttgctattatgagcaacgttgctagaaatcatacatgtctcctggtgcacaaatgcaagctcctctgagtacatttttatttccataggacacaaaattactaatatttatatatcacctttgggtaaaaagacaaaactccttgaggctgggggttcatcataggaggacctacgtatatcaaagggactggtggaacatagggtatgggaaagttcaaatatacgtctaatgacaagttgtttttataaaagtagttgctcaagtttatactcccacgagcaatgtgtcagagtttctcttggcctacattttgctagtctaatgtccataaactagtatccttttgtagtcccagtttacatctctttttgctgatatatttgaggatcaatttatataggatctgtgctgtgaagtctgttttttgagacagcgtcttactccgtcacccaggctggagtgcagtggtgtgatctcggctcactgcaacctctgcctctcaggttaaagcgattctcctgcctcagcctccctagcagctgagactacaggcgtgtgccaccacaccctgctaatttttttatttctggtagagatggggtttcaccatgttggctaggcttgtcttgaactcctgacatccagtaatgcacctgcctcagcctcccaaagtgctgggaccacaggtgtgagccaccacgccaggctgtgctgtgaagtctgatcgtgccttgtgttatttttgttaatgtgtgtcatgatttaaaggtggtttttgttttactttattttgtgttttattttcctttatttggaatactaattgtatactgggttataggttttgcaagtactttctccattttgtgatttttctttttaatttctttacagtgtcttttggaaaccttaagtatttaattttcatacagttaaatttgtgaatcttttataatgaggtataatcttttctaccttaagatattgttttattatataattttatgatttttaaagtattttcatattctcctgtctttaagttttttcttttctcattgaacttactagacttctagtaagccctggaagtagtaggcatatttttagagatcttagatcctagtttttgatgttgttgttttacttgttggttgttttgtctattgattccacgaaagcctcagcactaactaaccctaacgtggcattgttcctcctggcagatgactgtgatgatcctcttgtgtctgccttgcctcaggcatccttcagcagttcttccgagctctccagcagtcatggtcctggatttgcaaggctgaatagaagagatggtaagtctgcttttctcctctgactggcccatagaaaatctcactagtttttcattatctttgcatacagtcattatgaatgatacatggtaaaagaaagtaaatttcgaaataagcaaatggttaaaactcatgagatgtatatgacatctagcttctgttctggaatgtgaaagggatacatcctatattacgaagaattgagttccttccatctgacaagctttttatatatcttactaaatattttctacaataatatacaatccttatggacacattagtgatgaaaccttaattggccttcagtttcaagttaaagaagtaattttcaaaaacgctaattatttaaaaataacaatccctcagtgttttggattctcaatgtggttgacatgattttcttatcagctgaagaataggaacataataagattttcatggtcctttaggagtactcagccaggtgtggtggttcatgcctataatgccaacactttaggaggctgaggtgggaagatcacttgaagtgaggagttcaagaccagcctgggcaacacagcaagaccttgtctctacaaaataataaaaataaattcacctgtgatgcatgcctgtagtcccagctatggctgaagcaggagtatcactgaactcagaagttggagacagtgagctatgattgtgccactgaactagagcctgggcgacaaagtgagaccctgtctcaaaaaaaaaaaacaaaaaaaaaaaccaaaaaaaaaaaaacccaaaaaaccccccaaaaaaaaaaactcagttcatcttagtttgtgtttgatcacttgaatatgttaaaaggaaactgaagataattaaatggcaccttgctgtagaaataagacagaatttcaaaaacactgtgtacttagagacagagtgtcactgtgatctcttttcataacatactaaggtaaaattcatctgcacatgcattggaggaaaacacgcttggcaatactaatacataaaacgttttaacaatcataaaaagttttaatgcatgatgtttttggttctcccatttattatcctcctctcgtggcaacatcagtcagtcacttctaattttactctttgatgttatccttaatatgtgcttaatgcttgagcacactgaacattggacatgacaaataggtaagagtgtgtgtgtgtgtgtgtatgtgtgtgtgtattttgccatctggtatacataatatatatcacacatagttctaattacaatatagatataacactttaacatgattttaagcttaagtttattttaaaatttcatttcatattattggagatacctacttttgtgtgcttctgaatgtgaaggtatcagtggagagtgagaactgagatccttctgtcaaatgggaaactggggggtgtttgaatatatttgtgtagataatgctagcgttttctttttgagtgacttgcagtaagagttactggtcacatgggactgtctcttcctctttgcaattctgagtccctgacccatcaggggactttcctagcctctctgatggccattccaggccctgtacctatggacccaccagcaggaatgctgttattgcaatgctaatcctagaataaggtctccattctgtgcttctttatagagaaaaacagagtttgacatttaccaccacttcatttgagtcataaaagctttcacagaatgtgggccagtgaaaggaacacaacattttaatctacctatttatcttgatttcctttgttgaggttcaatacatcacaaaatatatgttattaattagatcaaatcatatttttcattaatttatatactcatcaggagtctccatcagtgggactcattttcattcttaattcatttctatggctcttggtaaaacacaatatcaaacttcatgaatctcatttacatgttaatgaaaccgagacacaaaacaggatcattttaattatcttttgctggttgtaaacctacttgattacatttttctttttgatttaggttttctttttttcccctgttaattacatgaagttttcacaaaggaacatcagattttcagtgatttattaaaggctatattttatttctagtattgaaatactagaaatttctcataatatttctcataatgatttatttattagagagaataaattaattatttttattaataataatcataataatattcataataataatcataatcataataattaataattatgagaaattattctcataatttctcataacatttctcataatatttcagtcaggctaggaaaaagtgttcagccaagtctgcagtcatatgtaaataaattaaaccagcaaataaaggtcctagtatcttagatacacagaatgacttctttcctacagaattatgaaaacttagagccaaagaatagagcaaaaaaatgagaaagttacccacttattttccatctgtgggataagaagtgtcaagggtaatactgtgaaaatgagtagggccctagtaatgagggaaggggatcaaaaaaaggctaccattgctactaaaagtggctcacacctgtaatcctagcactttgaaagtctgaggcaggaggattacttgagctcaggagtttgagatcagcctgggcaacatggcaaaactctgtctctactacagatacaaaaaagttagccaggcatggtggtgtacacccgcggtcctagctatccaggaggctgaggcatgagaatcgtttgaacccagggggtgcaggtaacgtgagccaagattgtgctgttgcactccagggtgacagagtgagactctgtctcaaaagagagagagggaggggaggagaggggaggattaccattaaacatactttccattcgaagtatgctaatttaattttgccacgtatgtgctgttttgggttgaattgtgtcctcctaaaagattgaaatcctaacccaaataccgatgaaggtgaccttatttggacatagggtcttatcagatatcatcaagttaagatgaggccatactggattaaggggtggggggctaaatccaatgactggtgtccttataaggagtgtgagatttggagacatacagagacaggaaagacagagtagaccagatgaagatggaagcagagattggagtgatacagctgcaaaccaagaaatgcgaaggattgccagcaaccatcagaagttagaaagaaagaaagaggggttcttctctaagcccacagagggagtatggccctgcctgtggacatcttgatttcagactgctagtttccagaactgtgagagaataaacttgcattcttttaagatgccctgtttgtagtactttgctactgcagcccttgaaaacaaatacagattttggtactagaagtttagtgccactggaataaataccttaaaatatggaagtggctttggaattgagtaatgagcaaaggttggaagaattttgaggcacttgatagaaaaaactcagattgccttgaaaagaccgttggtgtaaatacaaaggtttaaagtgtatctggcaagggttcagaaagaaaagagggtcatgttattggacataggagggaaagcaatccttgttaaaaagtggtagaaaatttggtcgaattgtgttctaatgctgggtaaagattagatcttgtaaacaatgaacttagataattacctgaggagctttccaagcaaaatagaaaaggtatacctttgtttctccttgaagcttatagcaaaatgtgtgagggaagaaatacattgagaaagaaactgataagcaaaaaaggcaatcagacttgatggtttggaacattcttggcctattcatattgcagaagatgggaaattttgcatgctctgaagagaacattaaggatgggtaggacagattttgctaaagagattagttatgtgactcttgaatccaatcaaccatccaacaggaatccaggaatagagagaaggttatctagaaaagatagctgcatagtattgtcattgttggagtttcagtatagcttaaattttaatgggcaatttaaagttaagtgtacattgactcttagtgttgtcaatgtagagttcaaacaggttctagtgtcccatttggttgtctaaatgtgtccttagtacatttagaatccagaatatggagaaaccacatcttttatagtgttataatctgaacgtaagtctttattttaatgtacttggacaaccttggaaatgagtgattgcaaattgataaatttgtgtacaggaaaaataatacaatagtaaataaaatgattgtccaaagcaaaaataatatatttacaagtgtgagtagaaaaatacatatgtacacctctttaagtatataaaagatggtttccatagctgacaaatactgtgagtttccactcacatcttctgtaagataagaatgttttctgatgttaaaaaattggatatttgtctatcataatatttcctgatgttaaaaattggatatttgtctatatttttccattttctattttttaaaccacaactacacccttctattctaaatggttgttaagcaatgttttcccaatacctatagaatttgatattaaaatcaagcacttatctgtagaggaattagcttacttggttaattgacagagataactcccattcttggatggatctctataagaataattatagcaatctatatagcgttgtttggcaattttgactgccctaaattgttatgcttctttgcaaacaactattatgcttcattaaatcttccaagatatgcatgttgcatgtcagtgcttaagaggatagatccctaaagataaaaaaaaagtaggtgcttttttatgagttggatatttcctggtgttaaacgtattatattttttaaaaacctctataggccgggtgcagtggctcatgcttgtaatcccagcactttgggaggccaaagcgggtggatcacgaggtcaggagatcgagaccatcctggctaacatggtgaaaccccatctctactaaaaatacaaaaaattagccgggcgtggtggcgggtccctgtaaccccagctactcaggaggctggggcaggagaatggcatgaacccgggaggtggaggttgtagtgagctgagatcacaccactgcactccagcctggtgacagagcgtgactcagtctcaaaaaaaaaaaaaaaaaaaactttataataattaaatttttaaaatgatagtattaatatatttaataaccaatactttctgtatgaaaaaagagtaagatataacttttgtacaggattgaaaaatctcaagcctagagaaaggggaacctggctggcacaactggtatgagtctgaaatttgcctgagaggtcccatgaccaggctggggcaggtgaacttcactgactgagtttgttgcactggagatgccctgtacttgtggagtttgttggaaaacagaacatgccagcaatttatttgcttctagaccaactcatgatatccagaatccgatgtgctgagagtatgcctttggcaactgaagaattacgtgaattgcaagagtcccctgccttcctgctgattcaggctgtggcatgtgatttgttagcactgcctgatatttctgtcttgagccctaattttttctgggtttgggccttgtcttaaatccataggtgtacagctcttgatattgagatgggggtgctaatatggctgaaactctgaatactcatccctaacagtcacagaacttgagcctcccagacacacttgaacttcagctcttccactctccttcttctctttcgtattctttcctgcagatcataaaagtttagttgaagagcgacttctttggtgttagacatatctggaattaattcactattcttgggtcttaatcactactacattttactcccttaaggattggcaagatatttcaccaccaaactttaatttcctacgggaagagcagggataacagtgagatggtattgtccttctgaaaatgattgtggcactgtgatggggccacataaattacaaaaacacagtgctgtacacattttaaccagtttcaaagtgtgtcctgccagttaaccccattttagcaaactaaatatatatactcatttatataaaggtaatctcagagaattctgacctccacagaactgtgctggaaagagtcaatttattcctttttattttattttttattttttgttttttttttgagacagtcttactttgtcacctacgctacagtgcagtggcacaatcccagctcactgcaacctctgccttgtgggttcaagcgagtctcgtgccttggtctgctgagtatctgggtgtacaggcacgcaccaccacacccacctaattttttttgttgttgttgtattattagtagagatggggtttcaccatgttggcaaggctgatttcgaactcctgacctcacgtgatctgcctgcctcggcctccctaagtgctgaggttacacgcctgagccactgtatctggcaatattcctgattaattacaaagcaaaacagagtcaaataattagttttttaatgtttgttattagattgaagtaaagctaaaacagtctgatatatccttagtcaaaatctgtgaattagggtgataggatggttttatttaatatttttaccttttttttttcctcagcagtctggatttagtttgtgaagtttaaaaaaaacttactaaaacattaacattttgataaaggttggaaaataaagttccagattaattttatgatcagtgatgtatcacttgttctaataaattatattttgtataccagccttgagaaggtgaaataaaaataagtgaagggttacacatttatttctaaatatgctgatatcttctattaaagtagtggagagtttgctaccacttctgagattaatatagaatcacttctatttttgtgtcgatttatttgatttaacaccatagatgactgtccacctgcctggctggttccctcttggctttcgatattgccctccctccttggccccttccttagaacatgctgcaccttctctgatctccctgccagcgtcttggtgcgttttccatcttaccctttatcgtccttgtctgctctatggcccacagtcttcagctctaaatcaatctgatggtgtcatccgtgggaatgcgccaagtagctaatcctaagtaatgtgtagttctgaaatcagggaaactagattataatactaaattgtgaatggccttaaggaaatgacattacctctctttttttaccccctgggtagaggattgaatttgaggatctctaaattctatgacaacgtactcttcttatgtgtaatattctactggcaatgtagctatcttctgtttctaactcttagaaatctttaaagcatgtgagtaagagaaattggtagtccctcaataagaaggtgaggggagtaccttaaggcagattatccttctaagttttcctcaaacaagatgacacaggatgctcccgccttaggagatgtcttcagctttcataagatacaggaattcaaaatataaatgtggcccaactgaaatcgatacagtggctcaaatttggtcaattaaaatatattcacaaaattaaacattatcactaatacataaacatttcttttagtatccatctgatattttcagtgctgagtaggaaaattttacatgcaggtgcaatgaataaaccatgagttaagtaatcaagggtgtctttggttgggttctcctagaagcacacctggagcaatgtctgaggtacaagtgatttatgagggcatagctgccaggagaaaacagagcatgggggaagcaggttaaggaagaagaaaccaaataatttcagaaatctcaggcacagcataatctctcaggaaactctgagggataaattttaccttggactttgccttacctcaaggtgacggtagagtctagcatggtgtctggctatatgaataattaatttagaaatgttagctgccatgtcatacaactggcagcagatttgatgtcttgttagggcccttttgctggcttactgatagctctctcctgaatttatgcttaagtgacctttcctggtacttactcatgaaaagagatctctctctctgtttcctcttcttataaaagcattaatcatatcatgagtggcccaccctcgtgacaatgtaaacctaattacctcccaaaggccccctctccaaatgccatcacactggggattagggcttcagcctgtgaattttgttgggacacaaacattcagcccatagtagttagctacatttccagaaactagtaaactaactacttgacatacctgagagaaaccaagacagccagccctcgggggcaaagatccccccaaaaaggaaatatcatgtagtgagcctgacattttctgcaccaaataacagagttttaaaaatatgtaaaggaaaatggacagaaataatagaggtagacagtacatacagaaatacaaaattgttaatgtatatcattctgtagcttattgaacaagtaggcaaaaaaatgaaaataaagatttgaacaaaaaattaaaatatgtaatgtatatttatatactgtgtgtaatgtatatttatatactctgtgtagttatttatatactctgtgtagtatatctccaactgcagaatacacattcttattaagtatacttagaatatttacctaaatttatgctggaccataaattgtttcaatatatctcaaaggattgaaatcatacagagtaagtgccctagctatagtggaattcagctagaaatcattaattagagaatacttgaaaagccagaaaggcgtggaatttaatacattcctccaaaagaaatctcaatggaaatgagaaaacattttaactgaatgataagaaaatactgcaaatcagaattgtgagatgcagattagaccataattcatggccttaattacaaatatgacaaaagaaaaaaggttaaatatgaatgatttttccatgcattcatcccaaaaaactacaaaaagaacaacaaattaagccaaaaataagcaaaaggaaggaaaaaacccaaagtgcattaattaataaaatggaaaacaagcatgtaatacaatcaagaagacaaaaatgtaaggatactttaagaaactttctgctaattttgagaatttaaatgaattgaaaaaatgtttcaaaaacaaacctgcaaaactgcactcaataaataaaaaaaattaaaatatttctctacctgtaagagagaaatttataattaaaaatgtttcaacaaagaaaactacaagttaatatgccttcaaatatgacttcttgcaaacatatttaaggaagatatgactgtaaacttacacattctctcccagagaacagaaaaaaagtcaaaatactccctaactcattcaaggaggccagcataaccttgataccaaacagtgtcaaggacaaacaagaaaggaaaattaaaagccactctgttgcatgaatataaatgcagaatgctctaaacaaaatactagcgtacatgtgtgaagggccccagactctgcctcagaatgagaatgcctcccctcagctggaatgtacatgtgctctgaaagtgtggtgggtggcacaaccacagaaatatcaaaagccaggactcctagctttcttgcctgatgccagttcatgtgtgtcctgagcatcttgcccagcaggggatggacggatcttgctaagagatgggaaaagctagcaaaaggattataaattatgctgctataaagacacatgcacatgtatgtttattgcggcactattcacaatagcaaagacttggaaccaatccaaatgtccaacaatgatagactggattaagaaaatgtggcacatatacaccatggaatactatgcagccataaaaaatgatgagttcatgtcctttgtagggacatggataaagctggaaaccatcattctcagcaaactatcacaaggacaaaaaaaccaaacactgcatgttctcactcataggtgggaattgaacaatgagaacacttggacacaggaaggggaacatcacacaccggggcctgttgtggggtgggggtgggggagagggaaagcattaggagatatacctaatgctaaatgacgagttaatgtgtgcagcacaccaacatggcacatgtatacatatgtaacaaacctgcacgttgtgcacatgtaccctaaaacttaaagtaagaataaaatttaaaaaatacaaaaaaaaaagaaaaccaaaaaagctcattcacccatatgagagatggttaaaattaagatgtgtcatgtggattggacatgtcttcttttccaacatttatcttaaaatcagaggtacatgtgcaggtttgttacaaaggtatattgcataatgctcaggttttgggtatgactgaattcgtcacccaggtagtgagcatagtatccgtaggtaggtttcaacccctgccccatcactgcctctcctgtcttgtattcctcagtgtcttttgttcccaactttaggtccatacgctcccaatattttagctcccacttacaagataacatgtggtattaggttttctatttctgtataaattcttttaggataacggtttctagctgtatccatgttgctgcaaaggaaatggttttgttgtttttttatggctatgtagtattccatggtgtgtatatacgacattttctttattcagtccatcattgatgggtacctgggttgataccatgtctttgctgttgtgaccagctctgtgatatggacaatttttgtatgacacttacatcctctaaaccctgtctctctctcagccagaattgcagtgaccaaatccagctttccacaggtgtgatagggtctcatctagggctgtatcatttccctgtagcttcttgccctatggctcctctgatattgatggatggccttcccctgggagtccactggactcattctagtagtgagggatgaggaggagtgcctgcctgtgaggctaaacgtgccaaagaggatgagagctgatggacagaaactttctgcttttgttctcagaatggaaattctgagatgcatctgataaggctgctcagaagtgtgtgtggcattggataccagtagcttgtagtttcatccaagtcaataacacatttcctttggccttccgtcattgtttcaccccttcctgcgtgccacatctgtcctgtggggtcacttcttcaatgtgagtgatcaaacttttgcctcaaagtcatgcttctcatcacccagtgaagtggaacgaaatgcttcctgattcctgctcagaagaattccaaataatttatatagattttctccgttcaaggaagtagatcataattctctacctctgaagtgtaagatgtgtataacaacttcaacactgtacattattggactttacagtggagaaatctgacaaacaccacctcatcttggtgatcaaagttaatcagtgataaattatattgatagtatgtacccttgatttgatgcagtgaaaatggcattttacctctgtggtcctgctctcaaaaacctctgtggaaaacattagacctacctgaagtatagaatcttctacacaatacctgaccagccattctcagaaatgttaaggttgtcaaaaaacaaggaaagcctgaaacggtcataaccaaaaggagtctgagacgtgatcactaaatgtaacatgattcacatgactaaacgcaacaacatgaaatgaacatgatgtaacctttatgggatcgtggaacgcagaaaggacatttagtaaaaactaaggagatccaaataaagcatggaccttagttaataataataatgtatcaatagtgatgcattagttgtgacaaatgtaccatatgcctgtaaggtgtgtttttttttttgagatggaggtttgctcttgtttcccatgctggagtgcattagcgcaatcttggctcactgcaacctccgcctcccaggttcaagtgattctcctgcctcagcctcctgagtagctgggactacaggcgcctgccaccgcacctggctaattttgtatttttagtagagacggggtttctccattttggtcaggctggtctcaaactcctgacctcaggtgatccacctgcctcagccgcccaaagtgctgggcgtgagccactgtgcctggcacctgtaaggtattaataggacaggggactgggcaaagggtgttttgggaaccctctgtaatattcttgcaacttttctgtaactctaaaagtattttaaaataaaaagtttgttaaaaacacatgtaaatacttcagctttgttagtacgaaatgcaaaatgtcaatatgaaaagaatatttgtgtgtgcctgtataataaaacatggtaaaaactcatttgagaaggagggaaaggaatgtaaaaatgcaatgcaaaaattaatatggactgaatgtcacttaacagttagtgtgatgggtgtttaggcatccataattatccaaaatgtcaggaggcttgtgaaataaacatcaaagcctcagtggagcttgctttgtctctctggttttcccatttaattagattctgagtatgatgacattggaaagagttgtttgctctggcagtagtaatactttctatttgtttatagctttactatttatagttttataatttaaaatctgttcccgtgcactatctcctttgatttttaactgtagcccttccaaaggctactctatagatgtggttccatgagaaaagccatagaaaaaattgtgtgatttttataaagtctttctttcgattctcaaataagacattttatcaaagattttcttcctcagtgggaattattagccttatatatgtaataatttaaatagaaagctagcttaaaaccacatttaagtgacgtaaggattatttgttattttctgctacttttttctttgatctctttttaaaaagattgatatataattaatagtaacagtataaaataaaagggacacataaaatagattatataattggctgtataaaatataactgacttttataataggctataaaaatatctgactgtattaaaatgaaaaataaggtcagagactgtgtgccagaaagagaacgtttatgtgggtttttccaaagtctcaccattgaccttgactttgtacatgtcctccttaaatgtgcctgtccttcgccagagcctcgggagaagtgctgtgcagacacttcccacacctgtgctaaaggaaaaacacatctcaacaatcttctttctggaatttttaattgcctgcttgaattttccagctgcctgcaaggtgttttttctcactttatcaacttaagttaaatacatcacctccaaaccagctgctgcttgtaattatttttctttctggttcctggtggttttttaaatcaccatagtttcaaattcttagaatctccttttatttctcccttgatccctccttctgaaaaaggtgataaattctgtgtattcatggcctgtaatctctgtctcttaaactccttttatatttccattgctgctactgtaatgcagttctttgatttctatgcaaggttatttaggaccataatgggccatgcagttttgaggctttcttcaataaataaaatttaaagcatcattgtggccttgttgtgtgcctgcttatgactttcaaccccatctccattgcctatactggtgtttatgaatgcacttgccaatatccagctaatattctgcagtggttgaacagataatttggtagtttcaaagaaaaaggtgtaaaaattcacaaacattttacaaattaaactggaagataatttatgaattggctaccattcactaacagtatagtttctcttagctagcccgtctttgcttaatttgtgtgctatttcttatacttattagatttgctcttttgctcttagcactacatgacatcaattctatgattagtaaaaatacagaaagagcttactgatgcagaaaagcataagtgaaaaacagtaagaaatagaaattcagaaaaatgtcataaatataaggaatgactataattttagggcaaataaaacatatgaaccgggatatttgaatatttgaatgtggcaatttttaaaagcatctaaatagtgctggatagatctgtaaaaattggactttatttgatgagtgattattttactaaagtttttaaaaattgtggtgaaattcacataacatacaattaaccattgtaaagtataaaatttggtggcatttcacaattttgtgaaatcactatattcatcaggttccaaaatatgttctaaataggtttagttgatttttttttttgtggtctaccattttgattccattctcattcttttttgttgttttctgttttttctttttctttttttttagacagagtctcgctctgttgcccaggctggagtgcagtggcgcgatctcggctcactgtaagctccgcctcccgggttcacaccattgtcctgtctcagcctcccgagtagctgggactgcaggcgcccgccaccatgctcggctaattttttgtattttttagtagaggcagggtttcacagtgttagccaggatggtctcgatctcctgacctcgtgatccacctgcctcagcatcccaaagtgctgagattacaggcgtgagctaccacggccggcctgttttttctttcaagtttttttttttttcttagtgattactttgggaattagaaataatctctcaaatttgtaatgatctattttgaattaatattccttagctttaatggtatacaaaaacctctacttttgtatcgctttgtctctcctcttttgtatgattttcacaaattatatccttatgcattgtatgcactaacatagacacatagttataattattgttttatgcatttgtcttttaaattatataggaagaaaaggggaattacaaacctccaataaaataaaactttcttttgtgtttatgtagtttccatacagtgttctttacgtggctttgcatactgtctagtgcccttttctttctgtccaaaggactccctttgacatttcctgttggacaggcctacaggcaataaactccttcagttttgcttattcgggaatgtcacttcttcatttaaaaaaggtagttttactagatttagaatgtttggcaaatagttttatttttctttcagcactttaaatatatcatcccactgccttttggccgccctggtttctgcccagaaatctgctgttgaggaccctttataggtgacatcttctgacttgatgcttttaagattttttctttgtctttgacttacaacggtttgattgtaatgtgtctcagtgtagaactctttgggtttatctggctttgtgtttcaccttattggatgtggtgattcatgtcttttatcaaatttggaaagtttggggccaatattattattttgtgagacaggatgtcattctgttgcccaggctggagtgcagtggtgcaattataactcactgcagcctccacctcttaggctcaagtgatcctcctgccttagtctcctgagtagctgggaccacacaggcacgcaccaccacgccagactaatttttgtctttttttgtagagatgggattttgccatgttgcctaggctggtcttgaactcttgggctcaagcaatctggccacctcaacctcccaaagtgccattattatttttttttataattcactttttatactatttttattgatacataatcaactgacataacattatttatttaaatattctttcagccattctctctctcctatccttctgagattcccattatgcatacattgataaacttgatggttttccataggtctcttagattctgttcatttttttctttttatcatattttttcctttttatcatattcagggatcttgggtgatcctagccaaccagctttcccagggatgaattttccacttcagttcagtttgggccaaaggtgagtcttagataccgtctgatgttcaagcagtttattctggcagcgcttgtacataatggaaagtgggagcaggttagtggtacgggccagatacagtcaaggggtcaggtgacggactgaccaggaaggtctgtgtctggagaccattcccagagttttgggaattactcccctttcttacacatgtattcactttacactcattaacagatgtttctttcataaaggaagttaaactattcttgtaaggataaggtttgttttaaggtttatgagggttacatctgtgctgaggtggtcttgtcacctagaaatctctgggctagggttagtagtccccaggtcaggtcgtgccataccactaagtgacacatgatgtaggccccatgagatgtttgagtggaccttagagctatcattaatcttatagccatgatgtgtctcttgtatgtactacgctttctgtttcttgaatacatatgctcaatctatctctacattcactgaatatttcttctctctgctcaaatctgctgttgaagtcctctagtgaattcatttcagttgttgtactttgcaactccagaatgtttatttcattccttttaataatttatatctctttattgatgacctctatttgttgagacatcattctcctatttttcattaattgtttgtacattgtttcctttagctctttgagcgtattaaagatagctgatttaaaatccatgtttagttgatccaatatcattgcttcctcaggggcagtttctattaatttctcctgtgaatggactctacattcctttttttgcatgcatcatattttttggttgttgccgaaaactagacattttgaatattacagtgtactaactcaaaaatcagatgatctcttcctccataaagggtctgtttttgttgcttgtgtgggttataggtttttttttttttttttttttttttggtgacttttctagtactttaaaaaagcctattcttccacaatggttgaactagtttacagtcccaccaacagcgtaaaagtgttcctatttctccacatcctctacagcacctgttgtttcctgacttttgaatgatcgccattctaactggtgtgagatggtatctcattgtggttttgatttgcatttctctgatggccaatgatgatgagcattttttcatgcagccataaaaaatgatgagttcatgtcctttgtagatatacctaacactaaatgacgagttaatggatgcagcacaccaacatggcacatgtatacatgtgtaacaaacctgcacgttgtgcacatgtaccctaaaacttaaagtataataataataataataataataataaacagcctattctttgtcatgtatagtctttgaggtttatttttttttcagcttgtgggcaggtagtgttttgacaaagatttccttagaaactagtggaaaaaaagccaaaatgaaacaaaagcccttcccagtttttgcagattgggtctgtgttggggcaccacttagccaggccatataaaactctgccttatcttcgacttgctgctcacagacataatcctgtaagttacgttcactcttaatccccaaactgtgtctctgatgaaaaagtagaatgaaccttacaagacttttaattatccttcaaacaaaactctaatactacagttaaacttttctagataaaacacaaaatgtgctttttaataaggattttatactttttttctataatgggagtagaactacatatgtacaaagttgtatttctaatagcaaaaacacatctcattattaatgttatcctttgggaaaaagtacagtatgctatttgcaaaatccatctatcaaaagacactgtcaaaacccatgtattttttagtggctttggacgtgcaggaaacaatattctgagtaagtgttagtgactcctgctttattcaatatgagagctacttattttctgagttttaattctgctcctgcctagataagagcaaaacactcaacctttccatctggttaaccttgatagctcatactgtaggagccatcaaggctaaccagatggaaaggttgaatttttctagtatttgtgatcatttggtgtattgtgttgtagattggaaaatgctgtggatcagaatgaggcaagcactcgatagacaccagaagctttattcacagaagagagttgggagacggttatcaaactgaggtcacaggggaatggggtggggtgaggtgggttattttcattgtaatgtgtgaagtgatcagtagattctgcttttctgcatgacagtttgctggttgatcttgtaaaaggtgagcacatacatttctgcaaggaaggatgagataaaaacacattcagtgacaataataattccctcagaggctatttctatgtgtgagatgatgtagaaatagacacaatatctctgcaaacccttcatctcccacctagctcagacaggcatgagtcactcaatgcttaagagaaagcagatgactgcacagcttgggaacaaagctcattgttcccttaaggcttaaaacataaaggatttgaaagggaagatgagcaggcagaaggcatcccttttatccctttcctactgagaggaaggagagtttggaaaggaaggatgagggtaagacatgagcaagcaagtataaagaatcactttctctgaagccctgtcctcaaactaagtccagagtgagaggctgtatggaatcctcctttcacattcagttatctgaatgtgaaagatgtgcttagggtacgagcttggagaaaagactgcctgaacaaagaaaagtcacgaagtcattctgttgctgccatgtggagattgccatgtgacaagaaccccttatcagccccagagggcatgtgaggagaactaaaagctgctgggggtgccgagaagcacaggaggtagaggcagtgctgttggcaaggtctcacacctgggatgggtgtgagatatcagaatgtcatgaccaagtacatccttaacctgaaacagaccaacacagagcagaatggaagctgcttgattatcataggattgttcactgtccaggcagaagaccaagaagtgtgacccttcccccaccacaactgctcctaggactaactccagggttgatggaaaggtagacaaatccctgtaggcatgttaaatttgaaggtggcataaatataatcctgaattgactgagtaatctgtgaactggactgacttcctctgggatgattaggttgattttctacatgagaaagaataggaactaaaaatagaaaattagattgggttgggaaaaaaaatgcagattttcacacttgaggctgtaactgagaaattcataactgcaatattattctaactgctttgcttaagtagcttatctcagagatatgtacagtaatctgctggcttgtgggagcctactgtgaacatctcttcccagctcagcattatcaagttgttagcttgaaatcttccacagaaggagcatttacaccacgggaattgacaaatactacaaagcaagacttttcccccaaaagaaaaagttattaaacacttaccagcataccactgatcagaacttatcactcatgagccaaaatataatgatgttggataaaagatttaggctttattttaaaaattgaactgtgatgtaaaagacctgaaccaggttgccaggacttcattatttgttgctttaaaaagtaaagttaggaatttgttactgtgtatattcacaatgcacatataagttctttagcatagcttaaataacttgtttccagatggtgtacagcaactaggtgtggtaagaatatatattccaagttaacacatttaaacctccagcttttgagttgacatgttggttgataagttgtttgcttttttgcttaaagaaggacatttcttcattcaatgtctacctttgatcaaaatatccagaaatctctgttagggccacagaatttctgtttttctcagtgacctctactcatgaattaaatttttttatttaattaataccaagaataagaagttaaatcaacttgctttggaagccacccatgcagatcaaactaaccgctgtcaagctggttatagcttggtaggagattgcaaatactaaactatcttctcataaaacaacctgaaatattcatgaatattagtagtgatcttaaaatattatttattctgtacactttaaatgttggatggattctttttatttatctaaagttggtgatgaacatgtgtaccaaacacacactaagcggtttttggatgctgaaagactgagagttaggtttccttagccttgaatgaaagactttccactatctggtattcggggaaccagcccccagtatttcagtgtaggttcttttctattttccctaaatgtcagccggtctgagaaataaagagaaagagtacaaatagagaaattttacagctggacctccaggggtgacatcacatatcgacaggttctgtgatgcctacctgagctgcaaaaccagcaagtttttattagggatttcaaaaggggaggggtgtacgaatagggagtaggtcacagggatcacatgcttcagagggcaatagaagatcacaaggcagagggtgaaattagaattattgatgaggttccatgtcccactgggcatgcattgtattgataaacatcttaacaggaaacagggttcgagagcagacaactgatctgactagaattcaccaggctggaatttcccaatcctggtaagcctgagggtactgcaggagaccagggtgtatttcatcccttatcttcaactgcataagacagacactcccagagcagccgtccatagacctacccctgggaatgcattccttccccagggttcttccttgctgggaaaagaattcagtgatatttctcctacttgctttctgcaagaagaaaaatatggctctattctgcctgaccccgcaggcagtcagaccttaaggttatcttcccttgttccctgaagatcgctgttgttctattctttttcagggtgccctgatttcatattgttcaaacacacatgttttacaaacagtttgtacagttaacacaatcatcacaggatcctgaggtgacatacatcctaagcttacaaagatgacgggattaagagattaaagtaaagacagacataagaaattataagagtatcgattggggaagcgataaatgtccatgaaatcttcacaatttatgttcagagattgcagtaaggacaggcataagaaattataaaagtattaattttgggagctgatagatgtccgtgaaatcttcacaatttatgttcttctgctgctgcttcagctggtccctccattcggggtccccgacttcccataacaatctggctccattctcctttcttgccttgatgacaactgccctcctgttgccccctctattccctttgctcccttcactcccttcagtccaattactgctgtgctgaaagatgtgcctcacattggtttgccctcatgtcattcctctgcttggaaggctccaatccttcactgtggccttccagtgtcccaccctggaacccaagtgaaatgtttctgcttccctaaccattcagccagcagtgctctccacaccctgaacttctcaagtgctcattccatttcagtccctcttgtaatctgcatcacctgctgatgtgctgtcttactcttttataaaagatgaactccaggaggaaatgacatcatctgagatgaagaacagaccctggagacagactgttttcagggtttgcctgactttaccagatctttgtaacctttcataagtgactttacaaccttttggctcagtctcttcatgtttaaggtggggaaaaaaaatttccattgtgtaagattattgtgaaaatcaaacaaattaggacagtgaagcccttagtacactgtagaatacagaagtgatctctgtttatagccagcagatccagagtcattcccagcatttcttttgattatgtgctgataaatatattgatcacattttggtttggcttctaggatgaaaattgagggtagtagtagtgattagaatgatattaataagcccttcgacacagtagtttctgtgtttgaaattctgtgtgtgatctagtcctaaaagctgtaatcagaatatgcgattagggagatacattctatatgctttgctatgaaaggtggcatttagagatttttaaaagagtggtctttttaactgtctaatgtcttgtgctgccagagatcactgagcttctataatgtttattaacaattggaaatgtcttaaagtgcatagtcagcccctccccattcaacatataacatctcatttctgcctccttcctagcttaaaaagctactacgataggttatacatagtgtttagattgttgaaaaatataaactttaaacacttaatctaaacaccacattaatttaaattttaagatatttatgttaagatactagatgacattaatattcagcaaatactcatttattcattggaattcaaaacacatttcagacactctagagaagattgatgggaattaatcaaaactatttcttagaaaagaaatgacacaaagagaatttaagatcgtttgaaatgtcgcctttgctcattacaaaggtctgtcattttacttttgttatgggaaagacaaagctcttacagccctttgaccttctgaagttatctcagaatctatctaatttatttccatttctctgaatttggccatattagaacaataacagctcaactaatgagaagcctcgcttttatgtttgagcagttcacaagttttggtaaaagttccattcaaatatgtccatggctttctaatacgagatttgattcttagctattaatttaacaaacaaaagcaaactgtattcttttatattacaaagctcttatataacaagctaaatcatgggaaagttgatattttaactgcagctgggaggtggagggaaggaagtcctggctgagtgagaggcataagaacatgtataattcaaataaaattgtggagaacaagaacaggtttcatagaaaaatgcacggttttcttaggctccactgtcagattgggcttgtgttacatgctgcatcaagaggatgccttttgctaccaggaaaaataccatccaacctgcttttaccaaaacaactctggaaacaacagtgagaagggactggttatttaagaggcacgtattaaagatctctaggaagggaaggccatgaagcaggaacatagctgcccaagttcccccccaaatcctatatgcttacccaaatcccacaggccttgcttccttcattctcatcacccaaggagagctgtccctgtattctaaattaaatcactccaggttatcctaaatcttttgtagtggctcaggtttcctgttgcttcaatttacatttttcaaatttcccttgtactaatgactcttgactctgagcaccaccacccagaatgttttcaaacgaccaccctggactttgccctatccctctccaacatctgattgcgctcccaatgcctactatttatgggttacccacatcaccaagtcctgccaattctacctcactaaactttctccgatgctttcatgtcttcattcaatacatatttatagggagtttcctatgtgccaacacctattctagcatgcaaacatcaggaaggcagagacttacttctgttttgctcactttcgtggcgtttgcctgctagtagaacattatatttattcaagcgtgagaactcctaactctgattaatacaacaaccccaagattactctttttctctctgctaaaatttgatcaaggagatatgtctgcactgccaatcagcaatgtactccttagaatcctccagtggtgctaattttcccttctccactgtttagtatatcctttatagcccttaagattggctcctgctcaccatttcagtcccatctttcaacagtcagtccaatttctgacactttatattttttgctccaactatttcggacaaattgaagctccttaatgtgctacagcctctcacacttctggagtttgcctctgctctttttatgggaaagccattattcgttcttcacctcctaggtcattcctgttagtccttcagtataagtgtagatgccagctctccctgacatcttcctcaactttttcattgagagtctttacctcttttctgtgcctcttaacttaggatcttaaacctgtccttccacctagcacaaatgcatttttctcagacaaatacaatatattttatgtctagatggtgttccattgaaatgtacaaattctgccccccacccagtgacaagctgataaacagtgaaattattttttaattgagttgttgaactaataaggactcaaactaaggtagggacaaagccaaggaaagggctgtaatggaaatgactttgaaggttaaactgaccagatttggcaacttctatacagtattactgaaagggagtaattagaaatgatttttaacattttcagtccgaatgaatggaaggctagaattatgtggccatctggttttgacaggaggtaaaacatccatttttgaaatgttaagtttaacaaatctatagggcatccatgaatagatatatgggaggcattcaggatttgggatatggctttcaaaggaaagatcagagctagaaaaatagatttagtcttcagcatccaaaaaaaaaatcattgtagccacaagcatgagatgtgtagttcagtgaggatgtaaagcaagagaaaatgagagttgtgttagctttttagcgaaagtaaagaaaaatggctccatgaaagatgctgaaaaaggctggtcagggaagtttagaaaaaaacccaagaagttgccatgtcctatcgagtcacagaaggaggagcttgcccgaagtgacagaattttggtcatgacttctgatctagatgtttttgctgatgagttttctctcagttcatttattgacgtagaaggatattctacagatgcagtatgtcagcatagcagaagcaaaaagctgctgttcctttgttttgaaagcatcatccctcaagaatcatgcaaatcagaaattcattatggaaactgtgtatgaagatcatctgggaattcccctaaatataatgcccctggctgtcatattgtccctcccatttttatataaaggagcataaaatgctagaaatattacatccaggcttgcatttaattttgcaaaagtgatggattttaaaaatttcacaaagggcaattatataacacaatattcttcttctcagttatgcatctgttgaaggaaaaactggcatcattaaatgaaaacaaagtttttgacatttatggttgtctattgagtttggctgactctacaaatattatatttcctaaaattataaattgctaatttctttttttttttttttttttttttttgagatggagtcttgctctgtcgcccaggttggagtgcagtggtgcaatctcggctcactgcaagctccacctccgaggttcacaccattctcctgtgtcagcctcccaagcagctgggactacaggcacccgccaccacgcttggctaatttgttgtatttttagtactggcggggtttcaccgtattagccaggatggtctagatctcctgacctcgtgatctgcccacctcggcataaattgctaatttcttaagtaaaattctgaactctgaacatatatttcaaacaatgacaaactgacctgttttatattcctaagtatctgtgggttacaaattttcagaaaacagatataataaaagcaataacaactgcaacgtaattcatgctagtaatagattctccattttgcttatcaaaagtatttgcttttcacaattactgtagctctcatcacgaatgtgcattgagctgcttctgctgggatgccgtgtttcagctgccacattctctgtggtaacagcgttcaggaaaatgcaagggtgtggataagattcatagtattgccagaagcaatttgaaattggctaggcagaagcataacctatttttttttttttttggtccaccttttctgatccagaaaatgttggcattaactctcattcccagctggaagcactgctttattatgactcagtggatcaatatacactgggaaccatgaactgtgataggtggcctgacaatccgatgaaaggcctcattggtttgagtgaaaatgaggttgcattgtgagactttctttttatcaaaaaggacaatttagaactttccattatacattacaaatagaaataagatggagataaacagagcaaaatgatatgttttttccctcttctgcctcacttgtgcatctttcacatcctgacagacttgatcatgctccctcaaaaccctgactgatctttttcttggcaaatccagggaaacattcgcctgctttttctaatatagaataactagtagcatgtaatctgagaagagttttaaatctcgggttaggagatacaacaacaaggataattacacgtttataaccacaggttaaaatcagattaataaataaaagtgcctagattggaaaaatcacccaccaatggtttgttacatttgcttacatttgctctcttccccattttaacacaatgtaatactgaaaaatcaaatatgttgaaacttcattttttttttgtctgatgaggtaaagaaatcatttaaaacacgtgtaataatcaagaataaggcaaacaaatctaaatgtgttagtccccggcaaaagtaatggtaatgtatcatgattttgacataaacctcataatagcaaatcttttctctacatttttcataaaatcatgacccttgtgcattcctctcatttgtttgtaggccaggagccagatggaactagccagggtgcacggatgttacaggaagcaattcattgtgtagtaaaagggtctgcaattgaaagcatttctagaattgaatgcatgcataggggaatattgtacctgctagcttcaaactctgaattctctttgcataccaccctatcagtctattgtagaacacatctgttaaagccagcatgtatgtatgtatatgtacactgggaacagtgaaaatacatacatacacacatatatatatatatatttgcttatgtctgtccagtttgtagaaaaaatcattgtgatgcccaatgaatgtgaagtgattctgccccagaatgtgaatgtgactgtaccaatgctatacatatggcaaaatgctttttgaattggatagatgcattaattcttctgaccacctatctatacaggcaaacagcattattcttgataatccacataccgttttataaagtcataatatgtaaatgtattagcagatttggggatgttaagcacccaaacaaaatactcatgcacatacagtgagatatcttacagtactactacggtgtattaatcattcagatctgaaattggttgatactgttttcttaggccagttctaaaccgctgagtctgaatattagattaatagttgaggaataacacaaaatactccatatttttcagtgttgtcaaaactttagcagttatgaatattgtcaagatgagagagattctatttgttgtttagtccagagactattttccgtgtatgatcgtatatgagatcatctcaaaatccctagcctctgctagataaagtcacctctttcggttgtgtcagttccttctaggtaaatactcagattttctgatttcctaaccttctactcttttccaaaatggcagtgggtatataatgtactcatatgatgtcatggcacggttagatgggggctcccctggctaatgttggttattttgctagtgactaccacaagattgttggttggatctctgtgccaaggacagtgacatctgagtctgattgagttgatcctaacactggatatttattgatatacactatgacatttagtgacccatctattcctttgaatggtctcttggcaaagacaccttttactgactgggccccatgatacttcttgttggctattcagagttcctgaagctggctgtgactttcttttggctaatggatgcagcagttgtgtaatagcctttgagtattgccacttatcaggaagaattcctctggctagctcccagccagacccacattcacttctaggcagtgctcttcagcttcttctcttaggctctgactgttgaatggttaggttactggggagtatgattcattaggcagaatcatggaaaacacattgttttaataaaaacaaaacagtgatttcctgtcaaagaaaaattgcactgaattgagtgaagcagtcaaggaaggctattcaaaagtattgtgacagaggtcaagagtattgggagagggattgaactcaattccattgaaacaattccgttgaagcgctgggctgagctagtggaaatacactggaggacattggggatgcgggggggatttggccaatgtgataaggccatctgtgtttgctaattggatcttatgtaagttaggctcctaccctcccacagagcctggaagatggaagtcctgtctttcttgatgattacatttcaaaggggtggctcccaggtccttgagaaagatatccctggattgtaaaactggcaagaggctggatgaagatttacacctcaaggggcagagacagaatttacaatattaagttttataaagtaaatgctgtatgaaaagggaggtcaggagcttaaagtcagaaagaaacttgtctacagttgagttgagggcaatgttaaagctgtcttcatcacatacatcactaataatgtcccttcttgcctgtgaaacaaaaattattacagttgtctacaagccagggaacaagcccttaccaggaactgaatctgccagccccttgatcttggacttctcagcctctagaactgtgaaaaataaatgtctgttgtttaaaataaataaataaagcatgtaattctataagatatgtgtattcaagaccgaattcaacaaatacttaagcccagaggtaaacaaatctcatgaattgggaacataatgctatacgaatgtgttctagcattttactaattggggaaatattaaatgatttaatcaaccgaatgtctgaaattggttttgcactttacctttttgatatactatgccctagtaatgccggcttttctaccattaagtggaaatgatgtctgttgggtacaggagagtgacttcagtttgttgacccagaaggagtgatatgagaatatttggctcatgacagcttatcatctcagtctggctagggaagataaaaaaaaaaaaaaaaaaagaaggtagagaagcaaaaaatggtttttaaatttctgggatattgccagtaggctctctccgatgcatgatgtcatttactgaaatgacctgccttcctgtaaaagatctaaatcaaaactttcagaaaggtattataatgggcttagaaagcaaaacatgggcagatcctgattatcatctgaatttccagacgttatgtgctaaaaatcatttttccaaaactactagtttgaatgaaataaacctatctgtggtaaaaacaaaattaaggcacagaatttggcatatttgtaactttattctagtcttccaggggaaacttggctgtcataaaatttgcaaatcaaatacacaaatcaaaatgcctgcatagataaagcttgtaaatatttacttttcaaagcactgcattattaaagatttcagaaatgtccagtctggcaatacaagaagtaagactgaaagtcagtctgccagtttgccatgagggaatattgattgacagcaaagaactaaaacagaagacaatttagtgaggtattattaattaagaaccttgctggggagttgaagtgaaaaagcatctctttttcatcgtatcaaaaattccaaaacaaagcaatacatacatctttgaaatgtagtttacaaatgattaagctgtgtaggtgtgaggcaattggttgtgtgtgtgtgtgtgtgtgtgtgtgtgtatctcagttgagtgcttaaacttctgtttgaaaacttcataaaaaataccgtgcatcaaagaacagtattctgtgccttcagtttgggtacagttccagctttttcagtaggttgtataaatttagaccatgttatacccacgtgactacaattttatttcaatcttatatgcagtaaatacttttttaagcacctactatgtgtccagcaatgtgctagacacttggggtctatcaatgaataaaacaggtgaagacccctggtctcatagagcttgtattctaataaatataatacataaacactaaagatactacataaaaatcatatgctatataaaaaagatggagatttctgtcaaaaatgaaaaagtggttcaggggaagacaaatgggagtaggactgcggagcagaaggaattttaaatgggaggacaggagatacaagcctctaagacagggtaatattcgagcaagagacttataggcagcaaaggtattagcccagagtatctcagagaagagcattcctggcagaaacaagagcttaatacagcttctgagatggaaaatgactgatgttcagtttattcaaagaacagcaaggaggccattgtaaatggagggcagtgaactgggaagaagaaaaagagagaaggtagagatgatatgggggtggtttaagggggcagatcattgaggacattgcaggtggcatagtgagaacttcgtctttcactctgtagagttgagagttcttgcagtattgcagtattttgtgcacaggtataatatttcacacctgttgtgtagagaatagaatctcagtgggcacaggaagaaagagagacttactaggtgactgttgcaagaatccagggttgaataatatggcctgaatcaaaggagcatccatgaaggcagaaaaacagcaggattcttaataataaagcagcaccaacagcatcttctggtggtttggtagtgtggtatgagagaaagaaaggggtcaagcgtgactcttttttttttttttgtactgagaaactggaaggataagattaccattatatggggctgggaaaggatgtgaatagagtaggattcagaaggagaatggaaaatcagttttggaaatgttaaagagatcaagtagaatagaattctccagtcttgggttcagggaaggagtgtaggcagatttatgaataagggaatttttgacacgtgggtaatgcttaaattcatcaggctaagagagatcaacggggagtgaatgcagagagaaaagaaggagagcaaaggtctgagacctggagagtctcaactttaaaagatcatgtgagataaaagaagaaaccagcaatgagagcgagaaggagcaaacaattaggtagcaagaaaattaagagaaggtgcttttgtggaagctaagtgagcaaagtctatttgggcattgagaatgatcactagtatcaaacgccacagattgtccatgtgaacaggagactgaagcctgaacgctggatttagcaacatggagttcttggtgactttgacaagagcagttgcagttgagtggcagggagtgaaaatctgattggagtcggcccaagaaggaatggggtgagaaaaattggagagtgatgtggacctatattatttgaagactgttaacattaaaagaagccaaaaaaaaaaatagaatggggtcaagagaagttttttttcttttaaaatgagaaaaataagagcatgctgatgtaacagtgtactgatgggaattatccattaaagagaatataaaaataatgaagcaggagagaggagaattgctaaagcggtgaccgtgagaaggatcagcacaagcaaggggcccaacgaatgtcttatgtaactagaaagcacggcaaacactctgcaggcacagcaggacctagcggtcctgatcttgttttcagaacttgatctcacttcatttctcaactctccttctctctcttttggcctcactcagacaggctttccacaacaatacctcctacagcttgatgcctgtatcttatcttctcagcattaatagcagaaaagagtctgttctccaaatgtcctcacaaaatcctgaaattgctccatggtcatggctcaaggtcacctgcccatccctgaaacaatcactgtggtcaaagtaggcaaggtcaagatggagaagtgaacatgagaacagaccgacagcaacatacacagcatcagtagagtcacgttctcttccagctgaaacaaacaacactggtaaaaatacaaagctattaaaaggctctaaatggtggcctggggacacggcacaccatttaagggagccaaacaaatattggtaccacgttctttccatttccttacattattataattttatgtcaagatgaaaatgatctgggcaaacttggactcttggggaaatctagatgaaatcgcatttgaaaaaaaagtaattatcttggagggaaactttcttatgacaattttaattaagccaattattttctaggaatttagatgtcctaatggtggctagaaccatcattcaattatgttcacttgtgttttgtgtccttgaacatctgtgtccttttacactttaaaatctcgaggaagaaatgtaattccttctgtctctgcagtctctacttgaataaagttgatacgtcgcctttactgatgaccaccaggaatgtctgtcatgccatttttaatattactacgggataaaggtgattcttatctatattttaaagctccaactaagagtattttttcttcactttttccttttacttccctgaaattttaagatgtgtctcccttaccagcactaaatattggtgatatttagtagatgggatatatgagtcttaaacatgattcagccagccaggtaatttataattaaatcacacagaataaattatttgaacatattcttgggataaaatatactactatgagtcaaagatagttgtaattactccaggggtaaagaatgaaaaatggggtgatatgtaaagtgacatcctcccactgattaaaatagtattaaaaataagtaatttctcacctgcactaaagtatttgcatagtattgggaaaatttacttagcctctgtaaatacttttgttttttttctttttaaaagagatgttaaagcatacttcatctcactagataattttaataattaagttaatacaacgtatacaatttctagtagcgtgcttagcatacaataggcactggataatttttagtttgcttttcttacaattcatagcaacacatgttacagaagcaagtccctcagaaatctgatgttgaaaagtggtaggcaacaaataaaagagatgctgtgttttgcggtcaatcagttacaaaattttttcaaagctcaactttgctgtgatcataactctctttggagctaatagcaataataatttttgtaattcaaaaagcactaactgccatatactctgatgtttgttgaatgtgggagaaatcaataggcacttaatatgcttttaaaatttaattctcataacaatactacagcatttaagagtcttgtgaatggggagaacttttatttttaaatgtgagttttcaggctgtaatatgaaaagttaagacatttttccatttgaatagatttatgacactattatgccaagtctcagtaacaaagttaaggtaggagaaagaggacggtggaacaggtaaaggaaacctgcagtatggggacaaataggaactggtgggggcaagactcttgtttttgttttgtgcgtaaattatcattaaccatggaagagatggggttgagaaaagatggtctttagtttcataagaattggtttcttaggatattgaatatattggcatactaaaatcacgaggtcaaataacacttaactagcagttaaaaggttttcttaataaaataaatacagtttatttgatagtaatacagagtttataatttgctggagttagtcatcactttctctgttaacaaagtaaatattacaatagtgtgtttccgagggctatgcggtttggcggtggccatacggctggtggtctaacctcagctgcagttacgtttgcatttcatgtcactagctgtcatcataggctggcccaaaaaaaaaaaaaattctgcaaagaataatcaatttatctctatcgctcagtctatctgtctagcttatgtcttccattttactatttagcatttgtcttaaaattagaacaagcctaacactctatcacacgctaataccatgtgcatctgcagagctgcgcagcttaaaacccggtagagatatttggattccctctggccaacttatctggctgaaattacttggtatagcctagaagcctctgaatttccattactttatcagtgtacctcattaatgatatagcttaatttgcataccagtagtaccttttcaccccaggtaaggaattgaaatgttcaaggtcaattaactgtgaatgtttcaagttggctggtgcagctgtaactgtgagcagcgctaggaagagggagcagtcagtgagggcttcctctttctcctgatgagaattgatgatccgattttaactcactagaatcacactgattcttttcttcttgctgcattgctgtcatgtgttcgctttttaaaatactggcctgtagaggcatggaaatgcaagagaaatactgtgaaattctggattttaggaaaacatattctcaattccagctttagaccattacaattaactagaaagggcaagaaggaaactaatcagtgttttctcaaaggtattagctgacacagatgcaattccaagtgtggaatttccaggctgagagggtgacattataggggcatttcattcaccctttcctaactttttcttgtaaacaaaaaaaatgacaaaaatacagagagatatgcagttgtagcaataagagaattcaagatgcttgattagtaccagaccctagaagtctttcaatttctaaagttttgacagggcctggagggaaagaataaaattagataggacagtggagagaaaaactcatccacacgccatgtccatcatgtgcctatacttcaaagacacggtccattgtaaactacagggagggaagttgaccctactgcctggtagcttaatcctgagcttccctgatctccaggagcaccagtgagtcttttctacatccactgggaaccactgattcccacctttgcatcctgacctatgagaggcactgcggtgtcctagttaggggcatggtgcctcttgcctgctccatggatgagggcaaagtgttcaaactctttgtatctgatgcaccatctactatgtagactgcactgagaattaatttacaaggccttcaacaaagtgcctgacacaaaggactcccttgctcagcaaatgtgaagtaatacagtattagaataagtagaggaggatggatggtgtttcatcacatcctgaaaaatgaaggatggaggaagcattgattcagattttaaaataatgccccaggagcagttcccgcagagttcaagaactccccgagctatttgtgggagggtgctatttaaagtgtgcttcagatcattcaagaacacattccgtataaataacagtctgcaagggtaggaagtacccttcacggacagcagggccatgctaaacaaatgaccccaagacaccaagggaccatgtctatgcaacaagccctcttgcttaaaagatgagaatattctgctttataagcataaaggtagataatattggtgtacaacgaaactgcaccccaaatcacaggttctttaagaacaaatacagagaaaattaaaagtcaaaacgcataaacaaaacttgtagcatgtaaaaaatttctggatccacaaaagaggaagagcattgtgcttttgacacatggagtggaatacagttttgaacaatgattcacttgaagaaagatggaaatttgatgatgtatctaattctaaagacagtatagtaagaaacagggattatacctgaatgcaagcagtcattagtgtgatgccatcaagagaggagcttcttgtaatataatgtttaaaaagaatttcaacttacttattttagattaaggagtacatgtgcagtttgttgtaatgcaattttttaaaatgctgctttgacacagttttgaccccggccaggactggtcactttcctttcttagcagctgattatgtccatactccaaccacttcctttattaggttctcaccctttgcggttgttaagcatcattgctgggacaggtaccagacaactaggggtgtcctagtgcctcctagataaattgttcagattagccaattcacaggaagcccaccaagcctagctagctagccctatcctgcttgtcatacagaagctgcctcctacagctccagtttacccttatgctgtcctctggtgcatccccatgtgtggtcctgcctggcgtcttctcttgttagtagttgtaagtagcagagttctgcccttcatctatcagagtatcattatgctgtgttccaccatcaaaataatcttgaagtcttataaagtacttgtcaacactggtgtgtgccttcaggtcctacaatggcatacgccctaccataacagcaaacatttattgagcatttctttgaattaggtcttgtactcaaggtttcataaaatgggtcatgtatgccaagaataatgcttgaatcaaaactatataaattaatggtaatctgtatctaaaattccagaccttattatcagagcctcaaggtgagcagcaaaagaatgggggaagaaaatgtgctaacattcttatttggggtgctatataattgatgtggcattttaataaacattaaatgttagataatatggattcaagaatgagtcaaaccctatttcgtaacttttacaatgattatatgttacttacataatcagcaatgttaaataattcttaaaataattccccaaattattatattaaactggaagaatgaagcatcttaacacgatatacaggagtcacatctacagtattttggtgtgtgttggatcaaatataacacagtaaattatgctgtgcacattacttctttgaacatacatcacaacttgtattctttacttctgagtgatcaagcacagcttgctctatgatttccttggttctcttttcccccatcctcttacccaccaccctgctcccatataggatagaaacagtggtgtgttggtaaactggctggggtgagggcaggtgcttatttgcagagtttgcagtttccgtggtttaaatactctcatcatggccaattgcaaagatggttatgtttaataactagcttgcaaaattgaaaatttaatgattgtctctcacaaactgttgggaacaagctccaacccaccactggatagagttgtgttattttctcctgcaaacacgccatcattaatgtgtgtttcaaatgtggttttcaacatctgtccctcccaaaagactgtaaacatcttgaggccaggaactatttcttgacttttgttttcccagacttaacaatgtcctcccttctctaagtctaaacatgatcacaagtagatttttagttccaccacagctttagttccttcatagcttgaagttacttccttacatccagtcctgggcaaaggggtagcagagcacaccattacatgtgtgcagtagacatgctagtaagttcccagtgttggcaggaatgttcacctatcatattaaacattttaaatattcagcaagacccctagttctcccagttttagaaggctataaaatctagaaatgaatacaattaattaacatagacatcatataattatactaaattcttacctctatatttttctacaattataagaagtttcatattttggatatttaagttccatagaggaatacagtcgtactggcatttctttacaaacatagatttttaactaactttcctttctcaattttctcctgtttctatttttaataaaaggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctgggtatgttctttaacaaaagacatagtctctcggggaaaaagtataatcagtactgcatcttgtttaccaatctcttaaattaagtagacatacagaatctgcagacttacattgaaaacattttccaagagaaaatatggtaaataatcattttccaatacattttatggtaaatttatgagaatactaagggtaaatttatattacagggttctcaaaaattgaaaaataaaccctattagtccattaaatagtgtgggagtctaagaaataaataagacttgtataaaaaaagttttgttcaaaaacataatagtcttgcattgtcttttatttatttatttatttatttatttatttatttatttatttatttatttttgaaacagagtctcactctgtcacccaggctggttgcagtggcgcgatcttggctcactgcaacctctgcctcccgggttcaagcgattctcctacttcagcctcccaagtagcttggattatagtcgcccacaaccacacccggctaatttttgtgtttttagtagagacgggctttcaccatgttggccaggctggactcgaactcctggcctcaagcagtccacctgtctcggcgtcccaaagtgctgggattataggcatgagccactgagcccagcctgcattgtctttatttacaattagtcaaaataatttgttccttttatttcttctgataactgagatttttgaaaccctgtttctttctctggtatatggggatttatatatataatatgtggagttgtatatgtatgtatatgcatacacatgtacgcatatatatgatttatctgtaaacccttctctagtctctgtaaagtgtataaatgtgtaaattgctgtgtgttgtaaacagtggtgcagctcctataagagggagactgggaaagaggcattttgtgataaagtgggtgatatttgtagttgattgataaataaacctggatatggcatataaacacctgatggaagaagaacctaaaggatgtttgtttgataacaaaggaaagacttctttcttagtgcagaaaaatatttgtttggatcttatgtgggctaagaacaatgtactgcaatcaaagaactattctcccctctctggctgagttgctggaactagagaaaatgggttacttaatgaagcgtcattcttagcacacagataatttggaagcctatttgggcacataatgataattttctttgaccagtcagttgcctgttttttgaaacttcatagaactccgttatacattataaactcattgaagaaatggactgtgatttactcacctttgtatgtttaaagctcttggtggccattcaatccatgcttattgatgtaaattgaattgagagaagtagccctgctctttctctagagggaacaacagtgggactagaagaagttgcctataagcagttttaagaaaagctgtttaaaatccaaagcaagttgaagctgtaagaggaaaaaaaaacaaacaaaacaacaaaacaaaacacacacacacacacacacacaccccaaactccaaacactgggtattacgttcaactaattccatgaaagccactcaaactagggataaaataaacagtaattatgaaccaataacaataaaaacttaatgagatatttatttaactagatgtttggattatcttctgctcttttttgaattaagcattggaatttaacctagataagtagtggctaatgcatgctaatatttaggtatgttaattaaaatgtatttttttaaaaagtgatcaatcaggaaaattgttgtacttctgttaagcaagcttggggaaagccaaacccaggcactgccatttaccttacttgcttactcttattaaagttgaggcgctcatggtgaaatggtggcatgaatgatatccttactagtccaaaccagtaaaagtaaaaacatggcgtctatcataatcctgttaaggtaacattgctttctagactctgctgtaatttgttgatttactcagtgtcttcccttcttgagtgtgagctctgtaaatactgtaccttgcgatcttttatctcaatatccccaaagtgtaagagcacctggcatgtcacagtcaaatattaaatgtttattgaagcaatgagtgaataaaatgcactttcttgtagaatactcttctgatcactctaaaagtgactctctcttgcctccatcagctcttctttttattatattctatttaataccaatttaatataccagttagaatggcacatttttcttttccctatagatattgaacttctttatgggcgagattttctttttctagtcttagcatttctggtatccaacatccagtgtggcacatgacttttgctgcttaaataggtgaaaggaccaataaatgaatggatgtgagtatgtcagtctgctaatctgtgcctatctttgtccaaatttctggaaggtatcaaaagtttatgttaactcactgaagaaggctgggcgttttggctcacatctgtaatcccagggctttgggaggccaaggtggaaggatcacttgaggccaggagttcgagaccagcctggccaacatggtgaaacctggtcgctactaaaaatacaaaaaagttagctgggcatggtgacatgtgcctataatcccagctacttgggaggctgagatgggaggattactggaacctgggaggcagaggttgcagtgagctgagattgcaccactgcactccagcctgggtgacagagcaagactccatttcaaaaacaaaacaaacagcaacaacaaaatcactgaagagataaggcatatcagagcaaaacaaagaaagattaagcggaacatgcaaatattagatacagattcctaagcatttggaaatggacagaatatggagatcattgtaagctgaatttgtcaaagtagtaaggcttacataggtcttgaagaaagcattatagtttagattatggaaggattaaggaggctattttatgaagctggaaaggtgtgaaaaaagcatggacattggggatatccagagttatggtttcctgtgtaataactagtgagattactggtcacattggactatcaagttttggaaagactggaagataatgttggatctggcaaagaaagttgacagataactttaaatgtcaagatcaaagttaagacttagtacaatagacaccattaccacacataacatagctaagttgtagtgtagataaaacaaccccaagtctctgaaagtatacgtatgtgtgtgtatatatatatatgtatgtgtatatgtatgtgtgtgtatatatatgtatgtatgtgtatgtatttcctgttaatcctaggtagcttcaaagttttattctattccatagttactctggtcccactctaaaggaagctctctgtgaatcgctaattgctgaagcaggaaaattgaaatatggtgaattgtgccctgtctcttgacttttctgcctggaagaacacagaccacttcaatttgcattttttaagcagaagaacaatttcaaattgatgtacatcataaaaaaacttaaccctttgttacattttacaaatgtgtatttcccaactttttgttttctggctcagtttttgtaggtattataggatgtataccaattatacaaaatatgccaatttcctttaagagcttcacaatctgctccacatgatgcaaataagtctacgaaagagagttaggaaacacataaggcattatacaagtatgtgatagaaaaacaaaagacaagtgttactggtttaggaacaaaagcaataaaaacaatcaacacggattgaaatgctgcagggaaaattcttcattctctcctcatttggtctcactttgaatgccaggcagtacaatgacttctacatacctgaaataattaaaaaaatgctctgccacttcttacaaataatccctaagaggaaagacagaatattttacagtctatacagatcatttaatagaaatgcaaacttgatagatatgtgatattttaaaatattacacattggaatatttcttcagtgaaaaatttatagtgcaatgttcataaaatataatttatacaaagtattctgctgaatggcaaacaaatattttatgaaaattcagaaaatgcaagctaaactttctcctctcagattgaacacaaaattcctcaacatctataataaaaaggttctcttcagtttattgtacatgattgaaaaagtaaacataaggtataattttcactcacttaagaacaattgctgagatatcgtgaaatcaacatcttagaaattattttaaatagataacatgtgcaggaactttacaggcaaattctccaaatcctttatggtaaatgcctaagattcttttatactgcagactacaagggcaatgaatgggttggtaccaatcttataaactgagtaaatatgattgttaaacccaagaatagtttgctttatttaaaatagacttcagttgtacttgatttttcaaacaaaaacctttattgcctatatgaagttagtatctctttgttttttgttctttaactagaagtgtctagtgtcatggttctgggtttggctggtgaaagacacagagaccctgtggcatggtgtagtcagtgaggcagaagcactacctgtcacaaaatattcaggccattattatcaccgtgaatgattgaggtgtcaactctgtaagccagacagggtagaaacactacctgcaaagatttccacatgcatttgttttaagtcaaataagggcctagggatagtttaatagaaaatctgaggaggcagaagtgcaaaagagatataagctgtagggtaggtgactctcctccttgtgagtggcatttttccttccttatgttgagcccttattctcttgacctaagcctacaagcagcatttgtggtgatagaagttgtagcaatactaacgccaagtgtgtgaacatgtcaagctgtcaaacttaatgcactgcagtacttgcttagtacttggcaaatgcctagagagtgcctgcagctgcttttatctttcaagagactgatccaaaacatattttaatgaaagtctacattattagtctaaatcttcaggaagtttcctgtttatatttctatttagctccacattctctagcttttgaaaatgattaacctgctaatgcctggttaaaacatggctgcatttttttttttttttttttgagatggagtctcgctctgttgcccaggctggagtgcagtggcacgatctcggctcactgcaagctccacctcctgggttcacaccattctcctgcctcagcctccctagtagctggaactacaggcgcctgcctccacacccggctaatttttttttttttgtatttttggtagatacggggtttcaccacgttagccaggatggcctcgatttgctgacctcgtggtccgcctgcctcaacctcccaaagtgctgggattacaggcatgaggcaccgcgcccggcccattttttataattgtgttaaaaaaaaacttaacatgaaatctaacgtcttgacaaatttttaagtgcacagtacaatactgttcactataagcacagtgttgtaaggcagatctgcaggactcaatcgttttgcttaactggaacatttaatctgttgaatgacacctcctcatttcacccttttcctatcccctggcaaccatcattcaactttctgcctctatagatttgactattttagatacatgtacctcatatgaaagtggcaacatgcattatttgttcttctgtgactggcttatttcacttagcgttatgtcgtcaaagtttgtttgtgctgaaagaattttgaggcagaatgtgctttctttttttttaaggctgaggaacattccatttcatgtaaataccacaattttaaaatctattcatttgcctatggacatttaggttgttgccacttcttcgctgttgtaaataatgatgcaatgagtatgagggtgcagatgtctctttgagatcctgatttcagttcttttggataaatacctgggatcaggattgctgaatcacatggaatttcagtttttaatttttgaggaaattccatactgcatgctgttttccatggtggttgtaccattttaaatttctaccaactatgtactagggttccgatttctccaatttcttgtcactgcttgttatcttttgttttccttgtttaaatgacagatatcctaacaggtgtgaggtgatatctcactgtggttttgatttgcatttccctgatgactggaaatgttgagtatcttttcaccaacctgctggttatgtgtatatcttctttggagaactgtctgctcaatgcttttgctcatgttaaaatcaggttttttcccctttttatgctattgagttggggaagttactgatatatttttactatactattattatatatttagtttatacatactaacgataaatgatccaaaaaggaaatttaaaacatagtctcatttagaatagtatcaaaaagaataacatacttaggaataaactttaccatgggaacaaaagagctgtacactgaaaactacaaaacattgctgaaagaagtgaaagaagaaccaaataaatgaaaaaatttctgtgttcatggattagaagacttaatattgttgaaatgtctatactactcaaagcaatctatagattcaatgcaatccctatcaaaatcccagtggcattttgttacagaaatagaaaaaatatcctaagatttatataaaaccagaaatttaggtagaaccacaaacatgttttttgaatatccaaaacaatcctgagaaagaacaaagctagagacatcacacatctgatttcaaaatatattacaaagctacaatatggtgctggcataaagacagacatatagaccaataaaacagcataaagtccagaaataaacccatacatctatggtctactgatctttcacaagggtgtcaagaacaaacaaaggaacagaaaaccaaatactgcatgttctcacttataaatgggaacatagagtgcatatggagataaagaagggaagagtacacaccagaacctaattgagggtggagggtgggaggagggtgaggatcaaaaaactacctgtgaggtactatgcttattacctaggtcacaaaataatctgtacataaaaccactgtgacatacaatttgcctatataacaaacctgcacatgtatgcctgaacctaaaatagaagttaataaaataaggaaaaaagaatacacaatgggggccaggcatggcagcttatacctgtaatcccagcattttgggaggaggaggaagtatcatttgaggccaggagttcaagaccagcctgggcaatatagcaagacccatgctctattaaaaaaaaaaaaatagacaatggggaatgtatagtctcttcaacaaatgctactgggtaaactggatatccacatgcaaaacaatgaaattaaacccttatcttttttttttttttttgggagttggagtctcactcttgcacccaggctggagtgcagtggcagtggatcccggctcattgcaacttctgcctcctgggttcaagtgattctcctgcctcagcctcctgagtggcagggattacaagtgtgtgccaccatacccagctaattttttattttcagtagagactgggcttcaccatgttagccaggctgacctcaaactccctaccttaggcaatccacccaccttggcctcccaaagtgctgagattacaggcgtgagatactgcgcccagcctggacccttataccgtatgcaaaaattaactcaaaatgggttaaagacttaaatggaaaacctgaaactgtaaaactgctagaaaaaaacgtacagaaacagcttcacgacattggtcttggtaatgcataaatatttttaaatataccaaaagcacagacaacaaaatgaaaaataaacaagtggaactacgtcaacaaaaaccttctgtatagcatacaacaaagtgaacaggcatcctaaagaatgagagaaatatttggaaaccatgtatctgatagggagttagtattaaaaaagcatttgggttttaaatatgacctcaatcacaagtcaacacagttagtttgctaggcatcttcttcattaagtagtgtcggtggctctgtttcatctctttgcatctgtgcacattctatagcatgttacatcaatcccttctcataaacttctgtgaggtgcatgtatattggagctttaccttaatatataatatacaaaaaaatacatatggcctgtaatcccagcactttgggaggctggggtgggtgcatcacttgagcccaggagtttgagaccaccctagccagtatggtaaaatcctgtatctattaagaatacaaaaattagctgggcatggtggtgcacacctgtaatcccagctactctggaggttgaggcatgagaatcactagaacctgggaggtggaggttgcggtgagctgatatgccactgcattccagcctgggcaacagagcgagattccatctcaaaaaaaaaaaaaaaaaaaaaaaaaacagaaaagaaaaaatatatgaactcttatgagctgtagatacacatagcaatgtgagataaattgtgatattgcttcacagtctttaaatggatctgtttgtaagcaagcaaaaaatttatttgaagagagggactagagttaacagggaatttaatttggtgcctcttcagagtgtacacccccattccagttcattttcaaataatcaacctgagaacaacatttttaaaacacttgataacttgtatctcacattctaccatgtgacaattcaatgacaacatcactcccttttctctattccctcttaccacggctgcgatactgtgtcttagacatctgctttttggctgcttcattccccaggaggctacattttgcatttttcaatcttggaagcagttctgttcctttgaagtgtttcttcattgttccttaggacctagacaaaactaatacttcccattcactttgctaattttccatctttaatttatatactttattaagtatattttaaatagagacgagattaaaaaatatttacaactattctgtaggttgcctgttcagtctgatgatagtttcttttgctgtgcagaagctctctagtttaattagatcccatttgtctattttggtttttgttgtcattgcttttggtgttttagtcatgaagtctttgcccatgcctaggtcctgaatggtattgcctaggttttcttctagggtttttatggttataggtcttacgtttaagtctttaatccatcttgagttaatttttgcataaggtgtgaggaagggattcagtttcagctttctgcatacggctagccagttttcccaacaccatttattaaatagggaatcctttccccattgcttgtttttgtcaggtttgtcaaagatcagatggttgtagatgtgtggcgttatttctgaggcctctgttctgttcccttggtctatatatctgttttgatatcagtaccatgctgtttttgttactgtagccttgtagtatagtttgaagtcaggtactgtgatggttccagctttgttcttttgcttaggattatcttggctatgtgggctcttttttggttccatatgaaatttaaagtattttttgctaattctgtgaagaaagtcaatggagaaactaagatttgaagtggatacaattatatttcttaaaaactctggccaggcgttgtggctcacacctgtaatcccagcactttgggaggccaaggcgggtggatcacgtgagatcaggagttcaaaactagcctggccaacatggtgaaatcctgtctctactaaaaatacaaaaaattacccgggtatagtggcggacacctgtaatcccagctacttgcgaggctgaggcaggagaattgcttgaacctgggagactgaggttgcagtgagctgagatcacgccactgcactccttcctgggggacagagtgagactccgtctcaaaaaaaaaaaaaaaaaaacctaagagaatcatctgggtaattactttttataaaggtaattcagtaatgcttctaacaacaaaattaatttttaaattcttaagttctcttcctagatataaataactacatggacaatgtaaaagaaatacaaacgccatttgtaatagaatccaaactagattagattggaagttgggtttattatttattgatttgcttaatttatcttcatggaaatatatattctgaagctactcttgttgatcctgatatgcttttttgttattgttgtcttttatgttttaattttttgactttaagtttttttatctttgtgcatttacatttacctttttagtttcgtgtcaaattataaaaaatttgctgaaatttttttaaacttttaggttcagggatacatgtgcaggtttgttgtatagttaaactcatgttgtacagattattttgtcagccaggtactaagcctggtacccaatagttaatttttctgctcctctctgtcttcccaccctccattctcaagtaagccccagtgtctgttgttcccttccttgtgtttatgagttctcatcatttagctcccacttataagtaggaacatatagcatttggttttctgttcgtgcattagtttgctaatgataatggcctccagttccatccatgttcccaaaacagacataatctcattcttttcttacggctgcatagtattacatgatgcatatgtatcacattttctttatccagtctttcattgatgggcatttatgttgattccatgtctttgctattgtgactagtgctgcagtaaacatttgcgtgcatgtgtctttgtggtagaatgatttctactattctgggtatgtactcagtagtgggattgctgggtcaaatggttcttagctctttgaggaattgccatactgctttccacaatggttgaactaatttagactcccaccaacagtgtataagtaatccaaaaaatgaaaagatatcaaggaaaaaaatgtaatagaatatgtacaagaaacaaaaaaagaactatttagaatattactaaaggacatagaagaacacttgattaaatgcaaggatgtatctgcttttgagtaaaagataatattataaagctattcattctccctaaaatcatccatataaatgagatcattctgaatgtcatatagaaaaatgtatatgagaaataactaagttaattagcaaaaacaataatggtaaggagaatttacatgttacaaaaaatttattaatatatattaattaaaacttattgatactggcacattaaaatatggtataagaacacatgggacatctgttactatgtccaaatacatttagggatttgcataaaatagatacagcattgaaaagcttaatacatatttaaggaaatatgtattagtcaatatggaaatcatagccttctagaaaagtagataacttgtttatatcaaaatagatttaatataaatatttaaaagtaatacagatgcagaaaaaagtattaaaagaaaatataggacaatgtaaagatacacatgtaatattggacggggcctgtctttctaggcaaagggaaccaaacccaaatgccataaaggaaaagatgaaaaattagataatatatggaaggctgcataaaaatataacatatataacataaaagaaagggtatacattgggaaatatttttagcctatatgatagcaatgcccacatttattcagcagcagcagtggtctttggttaagactgacattctgactgactgaataggcttcattcagctacatatttacttagatttaaaaataataaagggcaggcaaccacacagcatgcacagcaacagcataatagatgttcagctatcatgaacaacttttaaatatcccaataactgtcactggcttggtgggtgttattgaacaacttttaaatatctgaataactgtcactggcttagtgggtgtcgccaccacacatcaggaaagccatcagctccaggggtccttcagctcttacattacattagtgatgtaacttctcagggatacttgccaactgttctccaatgtagctggtatcttatcagtcctaggctattcactgatttccaggttatgtctgtgatagctaaatttcactgtgcattctaattctggtacctagggagactgtctagaggtgggagcccagatttttaaattagaattttaaaaatattcccaagtgatttcaattagctgcaaagtatgagaaacattgggttgctcagtaatcttgacaaccaggtacaggtttttagttcagtacaaaacataccagcaggatatccattcatcttagattctcctgcacattctttgagttaatgttgcaagaaggatttggctaaagataaagagtaggaaaaaagctacagcttagagattaactctatattcccaataataatgacacaattttcttaatatccaaatctctgcttttacatgtggtagctactagccacacagggtcactgaaaaggattataagttattctactataaagatacatgcacacgtatgtttattgcagcactattcacaatagcaaagacttggaaccaacccaaatgcccatcaatcatagactggataaagaaaatgtggcacatatacactgtggaatactatgcagccctaaaaaatgagttcatgtcctttgcagggacatggatgaagctggaaaccatcattctcagcaaaccaacacaggaacagaaaaccaaatacagcatgttctcactcataagtgggagttgaacaatgagaacatatgggcacagggaggggaacatcacacaccggggcctgttgtggggtaaggggcaaggggagggatagcattaggagaaatacctaatgtagatgatgggttgatgggtgcagcaaaccaccatggcacatgtatacctatgtaacaaacctgcacatcctgcacgtgtatcccagaacttaagtataataaaaaaataaaattacattaattaaattaaaaataaagctcctcagtttacactcgccccatttgaagagctcaatggctgcgttagaccagtggttactggattagacagaacagttatggaacacttccatcatcacaaaaattctcaacatagtataagtatgaaactttctaaaaaacagtaaaaaataaagccttagttttttttgttttttcgttttttggttaaaaaaaaaagagccattatataaacaggcagttcatagaaaggaaaaaatgatatataaatatataaaagtatcttcaacctcattcaaaatagaaataacacatcctaaaagattggaatgaaaacatttgaaactgcaatattttagacattattttccaatgtgtgcaatataacaaaataatacgttctttcattttaagttattcatttcatataatttttctttaaaatttttaagctactgcatcacacccatggtattatggttactgctgtttaatacaagatagacagggttttccagagaaatggaaccaagtatatacatgaaatgggaactggtttatgcaattatggagaccaagaagttctaccatctgctgtcttttagcaggataaccaggaaagctggtggtctaatttagtctaagtctgaagacccaaggaccagaagctcagatgtccaaaggcagaagaacatgaatgcttcagctcaagaagagagagccaggcacagtagctcatgcctgtaatccctgccctttgggaagccaaggtgggaggattacttgagcccagaagttcaagagcaacctgagcaacatagtgaaactccatctctacagaaaacacaaaaattaaccaggtggggtggtgcatgcctgtagtcccagctactcaggaggctgaggcaggaggatcgcttcagcctgggaagcagatgttgcagtgagctgagattgtgccactgtactccagtctgggcaacagagtgagaccctgtttcaaagagagggagggagggagagagagagagagaggatttgccctttctcctccgttttgttctattttagccttcaatggattggattatatctgcctacaatggtgagggcaggtctctttactcagtctaccaattcaaatgcaatctcttctggaaacaccctcacagacatactcagaaataatattttgccagctgtctgggtacacctttacctagtcatgtggaaatatcaaatgaaccctcacataaacaatagctatctcctacttgttatacgataatatctggtaacatttactgatagaataaagcgtaccttggttgtcaatacaaagcatcacaacagattattgttcaatattttagtagtttaaatccatatatatagctgtgtgggtttcatatgtgcagcatgtcatctaatctgagtgtattctgacagaaaaaaaaaaatccttagttctggttctaaattgtcctctgcgccagtgccccatcagagaaacaagttacctcagaatgctagaacttctgcaaggactgccctatagaattatggaagcagtgggtatcttttgggggctggagccttgtaaaaggctcagccactaccaagtagcagcctgaggcagagcaaaagtgggaagaaataccctggttcctcccttcctttcacttgcagatctttttcaagttcccagctggaagctccttaatacaggagcctgggacacagtccacgtcactcagccctctaatgttttgggtcagagcagggaaagggtgacacgtggttctaagtgaaacagaacgatgaggacagcctgaagaaggtatgttactaacgacaaattgcctctatgagctgctttttctttgcttatagaagaggatgcaggcagaatccaagtacttactgagtgattcctcattccctttcagttttgaaattgcatgcttccctttcaacccataaagaaaatagatcaatattttgatactgaggaaattgagatttaagataagtttccccctaaatttatgttaactagtgccacatgtataaaatgttacatttagcgctcttctgtcctggtaatatttatgagtaggcaaagctagccaagaacagtctttcaatgtcctgaaagaagggaatccatgaaaaatgctgaaccattggtttagggtcatttttgccacataatcgacactgagtaagtagagtggtgctctccttaatcaattatcgattcaattctttatttctcaaaatatgtgttagagttcaaaacatagatttgctttctatgtgggaaaaaatagcaaacatcttacagatgatcaaacatcaaacatcttacacatgagctccagagttcactgaggaggaccagggtatatatgtaccttaatacacatctgttttcgttttttgttttgttttgttttgttttgaaatggatcttcttctgtcgcctgggctggagtgcagtggcacgatcttggttgactgcaacctccacctcccggattcaagcgactctcctgcctcagcctcctgagtagctgggattacaggtgcgtgcctcccgcctggctaatttttgtaattttagtagaaacagggtttcaccatgttatccagtctggtctcgaactcctgacctgaggtgatctgcccacgtcagcctcccaaaatgctgggattacaggcatgagccaccacacctggcctgttgtcacttctgggacaaggttacaacacacacttggtatgcaaaggaaagcacattactaagttttattgaaatgttttgcttagctggaagatcttatggctctgtccagtcctaaccttggcatatttcactgatggtttccttgtgcaacacagctccaagctcaggtgtttaattgttgctcttaagacattctccaaagtttcttgtactttcctatttctcttctgggtgatactcttcagttatctaaggcatgtctgccaaacaagctttagttcatccctttcaatcagggctttccaaacacaatcaagtcacttacctctcaggtccacttttgcccctcacttttccaatattcacttaatcatctctaagttcttacttccaatgacatctgtgatagtgttatttccagggagtctctgcattgctttgcagggtttgtataactttaatcaaccgaatttccaattcacccatctatttttgttctatttcattctacttatatgttggctgataatggttgtgttccagcccaaatttttttttttttttttttgagacggagtcccactctgttgcccaggcttgaatgcagtggcgcaatctcggttcactgcaagctccgcctcccaggtccatgccattctcctgcctcagcctcccgagtacctgggactacaggcgcccgccaccaggcccagctaatttttttttttttttgtatttttagtagagacagagtttcactgtgttagccaggatggtctcgatttcctgacctcgtgatctgcccgcctcggcctcccaaagtactgggattacaggcgtgggccaccgtgccctgctggtcccaccaaaatcttatcttgagttgtagctcgcatgatttccacgtgttgtgggagggacccaatgtgagataattgaatcacgtgggcagtttcccccatactgttctcctggtagtgagtaagtctcatgagatctgatggttttgtaaagggtttcccctttcgcttggctctcattctgtcttttctgccaccatgtaagacatgccttctgccatgattgtgaggcctccccagccacatggaactaagtccattaaacctctttttctttataaattacccagtcttggatatgtctttatcaacagcatgaaaatggactaatacattggcctggtttcgaattatacctttgacataaataattactcaagtgctactggctaaaatgcatactatgtatattatctttattgaaaagtgtacctatttcttaaggctatgaattcccagaagatagaaactccatgctttgttgctaatgtggtttcgaagagatattgataatattatttgagtataaagaaacacttttcatgattacttcgaatctgaaatacaataatctgatgtgtctgctggtttacagcacaggggtcactgtacaaactgagactatgagggtgtacatctgatattccacataaatatgtgaatatattccatataaataggtgaatatattccacataaataggtgaatatattccacataaataggtgaatatattccacataaataggtgaatatattccacataaataggtgaatatattccacataaataggtgaatatattccacatatatatgtgaaatatattccacataaatatgtgaaatatattccacataaatatgtggagtatatttcacaaaaatatgtaaaagaaacattcttagtcataaaaaccaggacttgaactacatagctttatctatccatattcccaattgcctttataagtcatacctctaaattggccttgtctaagattttttctttttattattatctgcactaaatttactcctttcagaaatgttcacaaaaaatactttgggtgacttagaagagccatggttttaggaaaagattcaaatgttaggacatttgtccagaagtagctatgagtatgaaaggaggaaactggacaggcgcagtggctcatctcatgcctgtaatctcagcactttgggaggccgaggcaggtggatcacctgagctcaggagttcaagaccagtctggccaacatggtgaaaccctatctctactaaaaatacaaaaattagccaggcatggtggcaggcgcctgtaatcccagctacttgggaggctgaggtgggggagtcacttgaactcgggaggtggaggttgcaatgagccaagatcacgccattgcactccagcctgggtgacaagagtgaaactccatctcacaaaaaaaaaaaaaaaaagaaaaggaaaggaaacaggaagccaaaatactaagacatagcctacagaattgtgtctataaatcagagagataagagatacagtccaaaatgaatcacttgttttgtgtctaacaaataaaatttgtaattggcttttgaataccattctttcattttgggttgcttcatgttaatttctcatactgaaacgttgtctcccttttgaagccatgagcattttaagtacctaataataggattctttttcagtaagtgagagaggagagaaaaattgctggagcagtgaaaagacatcctcagggggcaatcactttattacattatgttcagaataatcatgaatttgggtcgggctagagaatatcagtttcagagaaaagaatcttctatttattttagcgagtttgtggaaagttgcagaaaattatcccaagagctacaaagcgattatgttactaattccatctttgtactctaccctgaaataatgtaaaaaaattaatatatcactttgaaaatcaatttctgatccttaaatcagaataaatacatgaattaattaaactcacagggaactgtgctcaccttaaaactctttatgtgaacaatgataggtaaataatgaaatttatctggattggaaataaattggtctgtccagccttcttgttctcataaaatcaaattctttgtatttatgtacacacaaacattgaatttccgtgtacattactctcactttcttagtttgcatttttcaaaatttttagtctgtgaacatttaatccatctaagttgaataaagtatatacttgactatgacactattattattattattattattattattattattattattatttgagagaagtctcgctcttgtcccccaggcttgagtgcaatggctcaatctcggctcacagcaacctctgcctcctgggttcaaatgattctcctgcctctgcctctcaagtagctgggattaaggtgcctgccactatgcctggctaatttttgtcttttttagtagagatggggtttcaccatgttggccaggctggtctcgaactcctgacctcaggtgatctgcccgccttggcctcccaaaatgctgggattacaggcgtcagccatcacgcccggccagcagaactttttttaagagaaattttcaccaagaagaaagtactatttgtgtgatttaaaggcacgtatttactaggtgcagtggctcatgcctgtaatcccagcacttttggaggttgaggcgggtggataacttgacgtcagaagttcgagaccagcctggttaacatggtaaaaccctgtctccactaaaattacaaaaatcagccaggcgtggtggcatgtgcctgcagtcccagctactggggaggctgaggcaagagaatcacttgaacctgggagggggaggttgcagtaagctgagatcacgacactgcactccagcctaggtgacagagcaaggctgtctcagaaaaaggcataaatttatgaaatatatttattctatctcgtcctactttgaatattgcatagggctttgcactggggtcttttgtcatgtaggaaagctgtgcgacttttcacgttctagcacacagtagaacaaggttggctcttacctttgctccaggaaaagtccttgtgaatcattctcttctctcctccattgaagtccccacccccaggctcctgcatcagaagtgtagtaaatgtgagtagatctaataatctggggctagggtagcaaacatcatgaacacattgtctcattttctgcagggaagtttacattggctatatggaaatagtgagcctccttctgttgtgtgagccaagagtgacttgaatagtcggattgtcagttcaaggtcagtgctggagccacagcactaaaaagaaagatgagatggaaggcgatgaatagcagttaaggatgtcatctctgttatcagattgcatgcattcagatgcaggctccatctcatgcaagctgtgtgaccttgggcagttgcttttacctcctctgtaaaataagcgtagcaatactatacacatgaaagagtttgtgtgaaagttaaatacaaaaggagacaagaaggagcaggagaaagaggaggaggtggaggaggagagagttagggggagggagagaaagagtgaggaagagataaaggggaagggaaaaaagagggaaataaagaaaagcaagcaaggaagaaaacctttatgcaattaaatgcaaaaaaaatacaactcatgcaaaattaacatagatctgaggttatcagcaattcagctaaaaggtgagagtagatgtctcactgagtgcagcggttttcggaaaggaaatttgatgtggagtggaaaagagaaaacagcaaatactaccccaagagaaagggaaaggactgcctaacataaaggccattcgagagcgtatgtgatggagtgagaggattcaaatcacagttggcttggaagagacatgtcttcttattataaaggaagaaaaaaagtaaagacaggtttagacttcagtctatataaaggacctttcatatgcaaagagatcgtatatttactgagagcaaagagggaggtgtgagaatggtacctccttggaaaagtatccccacacagtcggagagcccagcgttggccaaagggcatgaacaggtcacctgtgcagactgtgatatggccttctgcagctgtgtgcaactgtgcatacacaggaactgagggcatagacatttaggacccagggttggaatccacagggatactgtgatggtaggacactaggacaaggacatataggggctggcaagagcatggaggaagagaagtaccatggagtcagaaccatgtagaaaaggaagtgaagtcagggagggtgaggttgataggagattgtattagttaggattctccagagaaacaaaactaacaaggtttgtgtgtgtgtgtgtgtgtgtgtgtgtgtgtgtgtgtgtgtgtgtgtacacatatacatacatgtatggaggttgggagagatgggagatttattttaaggagttggctcgtgcaatcgacaggcttggcaagtccaaaatctgcagggtaggctggcaggcttaggactcagggcagagttgcagtttaagtccaaaggcagtgtgctggcagaattccctcttattccagggaagtcagtcttttttttcatatattgagaccttcaactgattagatgaggcccacccatactatgaagataatttgctttacttagtgtctatggatttaaatattaatctcatttaaaaatacctttaaagaaacatctagaataatgtttggccaaatgtgtgggtatggtagcctagtcaaggtgatgcataactttaaccatcacaaagatggaaagtgtctaaggaagcatggagttactgaggctgaaaagcaaataaaaatggaatgatggaagagagtcggaaagattcagtggtctatggtggaagaatagaatatacacgtttataatttcaaagatggtgcaatgctaggaaatgattaagaagaaggtgtgggcagggaagtgttgaagaggagtctgtgaaagtcatttagggtgttttatgggtcaaccacaaggcttttgaagcagagagttgcaaggggtgtgaagaaatgacctgtggtttgccagaggacctcagtctggaggggcaaagtttgctatcaccagctgacactcataaaaaaggagaataaatgtgttttctctccctcatttttttcttttggcacctcatttttacaaggaagaaataaaaattctctgtaattgacagaagaactataaaaatgcttactgactccatggaaatatagcatgtgggaaaagttagcacactgcaccttaggtcccagaatgttcatttggatttcaggtgggatgaattcaccatgctagtggcattatgcaaagctttgtctgtgcattgtcccacatttcatttttctagaagaataaattaaagttttcaggagttacacacctctcacaactaccaaccagtacctgctggagtctggattagaaacccaggctgctcgaatccagagatcactctcaattctcattttataacaatattaagagagtttcttttgtttattggagattctaaaaagagggaggatgggagagggtgagggatgaaaaattacctatgggatacaatgtacactattcaggtgatggggacactaaaagcccagaactcattattgcacaatatatccatgtaacaattttcagttatactccctaaatctatcaaattaaaaaataaaaaaatataatgaggaccctggatggcagaaaaaagatcgttggaagaaagagaagacagcagtggaaaaccaggcctccacatgttctttgtagtagcctttgtagtagctaatacggaagtcagatggagttgaagaaggtgacagatatctgtgattgtcaagggaagtatactgtttctggcataggtgtataagaccaggatttgtatgtgctggtaaactccaggtctgtccatatcacaggtcatgacatggaagttctgggtttagaaatggacagacaaggggacctttctgagtagaccttggtgtaagtcttggggtatccctggcctcactgttgtgaatggtctgtgtccagtgtattcttgcagtctcagccctgaccacactccagctttctaggtgcatctcacatactttccttaagattccatatagaacacagcttttgagggatgttgtgctcctgcaaagtctgtcctccatgtcagtgagggagaaaacccggcccagctgttctcacctagggtcggccaagaggaggcctgtgcatcaagttcaggtttgcggaacaggaggaacctgagccatctttgtgtggtgaagaaactttatgtatcagagagagggcttcagttctatggccacttctacaactcacttgatttgtgactttgactcaaagtttgtgacttcagactcaaaatgtgattgagactcagtttcctcatctgtaaacttagggcctctgggttcatgtgacctttagggttaccccggactcaaagatccatgctcatgggatgccttttgctctgcaccattccttgggtgtcatagggtctaactgaatccgagtcctactttctggtacttaaaaatgactccaattcacagtgctacatgggaaatgggaggaaagaatgcgagagaatcatggttgttggctgtggctatagaagcatgtcagggaagttcatcctgaaagagaatgagattcacagaaactcttatatcttaccccacctccctacaatctggaggttaggtagttttcctctactaattctcattctatttataatttttcatttcattacaattgtaatttgtcaaatatattttctcgtttaaactttgtttggggtttagagttgatgttagttttatgttctttttcctcctttaactgagtcaattccaaaatgtactactctttctctaactgattttgtcttaatattatcattctactttgtacattgcagccggaggtcacgtcctaattaatcaaatgccattttatcattaatctgagaagcaccaattaatcaagtttttcctcccattgaaactggtgattaaccaagctgtgacactatcttttgagtgactttctatattctgcttctgatttagtagttaggtgtacacatcagtttcaatcactactgactgatcttagctggttctgaccaggacaatggtccttatcttttcttcaaattgattcatggatccgtaatattcttgcttcctgttctgttcctgggttaatgatatgtgaaggatttctctactcttaagttcagattttcaaagatatgcttaacttctagataatggtgtggatcttcatgacctcagggtgtgaagtccttgactacgagtatttttgtctatctactttaatgacatttgcataaatcttgatgtaggatgtcagaattatgtggtgaatgttgtgaatattttttgagaaattaattttttcagataaaacgcaagtctgttgtagtatttcaagatattagagttcaattatgctggaaaatgtgttcataaaggccctatgcatttagaattagtggcatacactaaagttatttcattttgaataagatataataactagaggctttgtagtagctaatatggaaatcaggtgaagttgaagaaggtgacagacatctgtgattgtcaagggaagtatactgtttctggtataggcgtataggaccaggatttgtatgtgctggtaaactccaggtctctccgtatcacataatcagtctctcagtctcattgataaaaataaattggggattaagttcccaatgctttccttcagattccaagattactttgaaatcagtattgctatactttaaagggaaattattagagcatttttgtattctctattttttttctgcatttttccccattttaaaaatgcttgtgattacttgaatagattcaagcgaagtgtaacaataagatgactaagacatggtttgaaactaaatgtgatcgggggagtggttttctttttcttgaaaacattcaccaatttttttatttgtaagtagcgatactacctttatatagctgaagggctgtgttcttaccattagacggtgcttggaacagaacaccacgtacttaaaccatccataaatatttaaaggttgtgattatgtcagcagttaccgagggtggaaccactgcgtgctcaggaagtcatatatataggatgcctcttccacaccacaagcatcaatatgtgtaccttagaatgccaagaaaaaattatgacctatcatgaactcatttactttcttttaagttagttgtctatcatcttaggattattgaacttccctggatcttagtctttcgtattctcctttgtcgccaggctctgcactttcccaagttttttctccatacctttgaaactctttcctctatttcccattaccagttacacacaattacttttgcataaaacttttttaggaagttgttaatactttcacactatcttcctctagatagattgaatcagatggactgaattttagaatctagtaactttaaagatgagaatctttctgtgtgtgtgtgtgagttggcattctccaaacctcagcagctcttgcagctcttggagacattaacacagagattgttgacatgtctttggagtgagtcccgaaacctgacattgaaccatcacacagtagcctcccagtgccccctcccaccccagtgttttcccagaagagactctgagagacacatggctctatctaggagaagtcacaatgataattctgatactgtgctagtggaaagaggatgcagatgaccaggaatacctgaggagttaagttggaaaggcctctgaaatttactgtaggatgtctaggactcagcttctacttccttcaggtgatcgtcaatttcatctagataacccttcaagggtaaaatctatttaagagaattaacatgtggtttacctctacccctcacatttgtttaatcaccttcacaaagacaaagtgaagaaactgtgtagggtatgttatttacttaaataaagggaacggagatatgcacatatatttacatattttcttatgctttttaaataaatgggaggataataattttttaaaagaaagttacctgccgggtgcggtggctcacgcctgtaatcccaggactttgggaggccaaggtggatggatcacgagatcaggagatcgagaccatcctggctaacacggtgaaaccctgtctctactaaaaatacaaaaattagctgggcgtggtggtgggtgcctgtagtcccagctactcgggaggctgaggcaggagaatggcaggtgaacccaggaggcggagcttgcagtgagctgagatcgcgccactgcgctctagcctgggggacagagcgagactccgtctcaaaaaaaaaaaaaaaaaaaaaaaaaaaagagaaagttacctttatgataaactataggggagggatagaacagagacagaagctagacttttttttaacatgccttgtttttcagattttactgtagagtaatatacacaatttaataattgtatacaaaattaaatataaagccatttctaaaaagcaaaagtaaaatggaacaaataaactatttgttgtttatttcaactattaagttgaaggcataaatacatagaaaggaattatttaaagtgactttaaaacagtaatctgtgtattttactgttttagatcccattgccaaaaaaatcttaagctactttcaatgatcacatcttgctaatgacagccatttttttacttaaaatattgtgctgtgactcagaaacttatcctgataaagcagttatgtgattatattgatattattggaaataataattttcaatttaagagaaaaaagaagcaaatctaaaatcagaaagattaagtagatatcatataaccctgtgtttgaattagatacatcaatatgaactctgaatatattttctcttaagaaaaatagaactatttcctagtttggtttatcaaaaaaccatgactatgtttatcaagaaattatcaaggaaaaatgatatctcctagcacctagactgagggcactaaataccactttcctctaaaaggatctagaattccttgcagtaaaagactggatccaaactgagccatcaaatatacaaataaattgggattactttataccagaaaacaagtatgttgtcaaagactactggagtgatgtcaaaaggactcagtggttaatttgaaaagaatttcactggccaaatgaagtaattgaaacatcaataataccagaaatggactgaaacatcaagttaaacattaatgaatgccttatagaacaaaacgtttcttatccatctttatgggaagatgccagagaatcaactcattagtctgaacattggtttgtaaaaggaaaaatcaagcatttatcccacttttttttttttaattactaaactgcatctcagggtaaccaaatatttaatgaaagaaactttcccattttggaagcactccaggtcagcatacaaaatttaagaatgttagaataactccattttgtaaactccaatgaaataatgtacctagagaacatcagtgatggctcacattgaaacagagacaacaaggtaggaggtacctggaagtagacaatgtgtgcttcgaaagattcttgccaaagttctaactaccagtttataataaatacaggaacagaaaaaaaaaaaaaaaaacgtatcatgtaacaacagaggggaacaatgagcaaggtgggaaacattatagaacaaatggggccatttttttttcaatagttgattgaaagaaaaaggaagagtgatccataaatagagatttaagagaaacagcaatcgaatgcaacacatgtaaaattttgatatcccgatttaaacaatattgcatacacttatatgcacatatacttttaagagataagcagtccacacaggatgctgataatacagaactattgtgaaattttagatgtgacaattgtgtttttgttttataaggaattctcattctttaaagatacactttgagatatttacgcatgaaataatatgatgtctgggactgaatttaaaataatcgagttgtaaagatgataaacttggaggggacatgggtgtaggcgaaataaaattggtcctgagttcgtctctgaaggtagatgtgtgtgagttttaaattctgttctctctacttggttctatgtttgaaaatgtccataataaaaatgttaatgacagataaatgttttctcctctttaaatttttagtaaagttctcagttttttgttttgttttttgtttttgtttgtttgttttgttttttgttatttatttatttatttttttgagatggagtctcgccctgttgcccaggctggagtgcagtggcactatcttggctcgctgcaacctccgcctcccaggttcaagtgattctcctgcctcagcctcctgagtagctgggattacaggcatgcaccaccatgcctggctaatttttgtatttctggtggagatgaggtttcactatgttggtcaggttggtcttgaaatcctgaccttgtgatccacccacctcggcctcccaaagtgctgggattacaggcttgagccaccgcgcccagccaagttcccagtcttatacaatacaactttacttgtaataagttaaggctggcagtaatgagcaccatgaggaccaagctgaataaaggatcaagaagaatgcgaagttggttgcctcagtaagggatgaaaggaggccacccacacccaagcgaggattcagccagctctgataaagtgccatgtagctttggttgtgactgacttgcttttcattctcccgcacttggagagtgtgggatggagaggcactgatgagttgattaatctccttggtacctaccttaggagattccgcgctcctctctcaggaacagtcatggtaggcgattggaagtggccttgttattagtcatgcttcatcatgacctcgaaatcaccagttgtcatatagccaggctttaagaattaattttacaagcatatataacacattttcaaataagcttttattttactacagttaattatccatatttatagctctgttgttttatttccccaaaatacctaatataaggtaaaattagaaagtaagaacaacagggaaatcatatttttcaatacatgagccaaatgtgaagtatttaaattttttaaaaaatcaatgagttaatttacagtcagcattcaaccggttgcaacattttttgaaggaaaatagcctaaggtataaatatagtgaagatatacatatgaattattctgacacctgacaggtgcaacttataaagtatgaaacagtttacatgacaggagcataattataaatatttaaagatcctttttttaaacaatataacgcattttgttgatttgccttgatgcttactccagatttttcccagatttatttagagcagcaagagctatgtgataagtacagctgattctcactttccctgacagttatgttttataaagtttccatggacaatgaattatcaaatactgaaccattgctatgctatgtcatctcacagggactgccttaggagggactagagattgtttttaagataggataaaaataccttgtttttttattttagcaattttgattataaattcaaacctgaaaaatacagagaaaatataaaaatagaaacaactgtaatttttcttcatgcaaaaattatttatatatagcaatgtttcctttcagtcttttctcatatttatacaaaaattaacactttaattagaagtgtgtgtgtgtgtgtgtgtgtgtgtgtgtagagagagtgagttgattctcattatgcgtggaaattatgttctataaagttcctgtgaacactgaattagagagtagtgggtaaatacacaattagagtcccgtgagcctctgactgcaatatttttgtccacccatcaatacgtaaccttgttttacgtatgtttctgtttaaagacaccttatatagtctgtagtgctgatttattaatattgagctcatggccaacagcactataactcatgactgaatgaagcttccctaacacatattttctccgtaaggtgcatggcagctttcttgtacttaggaacataaggcagtatttcagctctacgtttggggcccattttaaacagggaaatcaccaaaaaatgcacaaaaatgtgaaaaatgaatagataatgaaaaaaaacacttgtttacagtattgtagctgaaacaggaaggcagagtgccaccttgtttgaactcagttggaagcaggtacgttgggcagcccagagtcttcactgctgtgggcacattcacaaatgaccactgaagcacataaagctttgatttggggttaaaaataaatcttagctagtaggcaaattcacaatacagtatctatgaataatgagaaagaactgtaatttactatttgcctaaaaaataccatatgggtatagtatagctctattatattcttgccacgtcttttataatctgtttataaaaactagcctcgggcaaaatagtaaaatgagcaattttttaaaattggaaactgccctttgccttctcagtggtacacattttttaaaaaaatttgatttgcttgctctcagtttggggttaataagaccaaaatttaaaatgcaagcttccaaagataagaatcatgcattttgttgaattgcctttatgcttactccagactttcccagatttatttagagcagtgagagctgtgtgataagtacagctgattactgtcttatttacgttaattttccagagcctaacctggtgctagaaacatagtaggtactcaggagatacttaggcacaataagtgaattcatgtcatcagtaatatatatcccaccatggtgagtagaatggccttccaaagatgttcactaccttaacgttgggacctataggtatgatatctctataaaaaaggcatattgggattgtagatggattttaggttgttaatcagatgatcatagtaagattaccctggattacacaggtgggcccagtgtaatcaccaagggccttaaaagtcaaaggaggcctaaaaggagattcagagggagaggaggctgtggaaggagaatagagttatgcaatctgtgaatgactcaacttgcttttgttggctttgaagatagaggaagggagccataagccaaggaatttgtgcaacctctgcaagctggaaaggacaaggaaatgaattgtctcataaagcctccaaaaaaagcatgcatcctgctgacatcttgatttcagcccagtgaaacctgtgtcagatttttggaccacagaactgtaagataataagtttgtgttgtttttacccacaaatttttggcaatttggtacactccatgcctgagaaaattgatacacctaccacatgacatttatagtccgataagtgatatcacaaatttgaaaatccattaggacacacagcaatgaatatttatatgttaatgtcaaacattatggtgaggactggaactgatattttgagagaagctcattctcagttctcaaatctcattatataatttggcagctattcataaaactgattgactgattttgtaaatcttttgcaaccaatagtctctcttgctttagggctaaaataattgattttctctcattattttgtcatttttgagtgcaagataaattagtgctttatatattttaaatcatgtactaagtaatagcttggtatttataaaatgtttataatcaggctttgtgataaaatatggtaagatcaatattacagtactccaaaaaagcaattgccctctgaaacttcagaattaatgctcatgaaataatcagcaaagaagaaatgaaaattaatgttgttttaaaaaccattgaacatggacaaaatattaattgcatattgtcagtcaacatgatttaatagtggtttaaataagggtggttatgttgtcataagaaataagatgatatagaatacttattttacttcctagtatataggctgtgctcaataaatgtaaagtgattgccgttatttttgaggatgccattgttattataatgcaaacacagaagggatctattcccctcttttgttttctagactggttgaaaatattttattttttaaaaagtattaatgtctgctgaaacccaatactatgtaaatatttgtcattaacgggtgcttgccagtctattttgccccatactcaagggttttgtattttaccatcagtcactgacttgagagaatacatgaaaatcacccttaagtgtgggtgggttgtgattactttacaagttcctactttgtggatttagccagatcagcatcttgtggtgtcagagacattactgggacatttacccaaagagttcattacagcactgctgttcatttcatccatcctcagaaaggcagcagcatcgtggagtgccaggaattcactctcagaggaagtcagtgtttttcaaacattggtaccataatcaaaatgaaaaacaaacaaataaaaaacaacttttctccacacagcaaaataccattctttcttacttgaggcagtaatgaagtggttttgaaacctttgaaaatgagcattgtgtagaatattgagtaaatggatttgaaacaaatgaaggaaacattgatatggatttctagtgttttctttaatgtatcagtcaattcacacaaggtaaaatgcacacaaagtaaacaaacaaaacttaagctatctaaaagtcatctcctgtaatactgtgatttgtaataatattttatgcataatgtctgatatataatagtaattcctgttataaacacatatacatctattgatttattgcctgtctatgctaggaaatgttctagacattttagatgcatctagatatttcttatgtaaatctaaatgatggaaatgttatttattgatattttacatacaaggaaatgggaatcagagacttttgtaggtcatataattaaggcagtacctgactccaaagtacaagtctgtcccaacatgctctgcttccattgtagaattgttctttgtgtgctttaaattataatatttaacaaggagttctatgtccttatagtaattctagagaaaaggaaagtaattctttaaaaaaggagaaaaacttacatgtacatttataattaatgttatatatgactaagccaaaaccttatgtcattataatataaagaacactgtctagtatataatagagtataagtatgtgtaaatatattgtcactgtaggaaataaggaaaatgaatattgctatatgttagagaaactcaaatgttaggaaattagtccccagcatgatgagcagaacaagctttctgtatgtgtgctcaggcaatgcaaatggttccatttgtctcatatagatgttaagtacgtgtcctgactcatacacaggcatgtatacacgtatcaactaaggcatcttagtctgttttgtatctgcctctgaaactaatgtcaaatcaatgtcatggaattctttctgacagcatttctggcaacgttgcttgtggctcttcttccactcagcgctttgacagtgctgtttagttttttttgtttttgcgttttttgttttgtttttgtttgagacagtatctccctcttttgcctaggctggagtgcagtgacgtgatctcagctcactgcaacatcctcatcccgagttcaagcaattctcatgcctcggcacctggagtagcagggattacaggaatgtgccaccaagcccaactatttttttttcttttttctttttagtagaaacagggtttcgccatgttgtccaggctggtcttgaactcccggtgctgaattcctcatctgcctgactcagcctcccaaagtgctgggattacgggcgtgagccaccacatccagccaacagtggtgtttatgggaacccgatctcagaatagtggcctattctgtcctcagatattctaattcttctttctaatatgctaccaaaacccacatgttttagtttgggttcctctagaagcagaacctgagacaagaatttgagtgcaagttatttatttggaaggcaatttcaagaaataacagtaggaggggagggaagtgagacagagaagggaaagtagttaataaggtttgcaatttgagcaactggagcttagccccactggggaattctaggagccagtatacttcgccatgtctcaatgtatccatcagaggagcaagggagctggggtatttatccatcatctccaggcagtcactggatgaggacttagccttcctccctgggagatggacaaagccgtcaggtaaacttgtgcactactggatgctggacttcagcaagatgtttctgaaaatggcaaaaccttcaggtatatggtgaagagtgggcatctcttactacagtaacttatctattgtaactaattgtaacttatctattgtagctaatctggtgaagtcttcagttcttttctttatccttgccttagaggcctgtgtgagctgggctatacatagaagattggggtctggactatatccttttgccaggacacttgtctcctcctaaaaaccccacatgtaattgtttcctctgagaaaagctggtgtttcttgtctcatcaggcgttcacagccagggaatctgttcatgaactgcaacttaatgctatctcttctggccccataaataacaggtaaaaaaaaaaaaagccctgcttgttttaagcaggcattattccttctcatcattgcattactgattcaaattgaaagcctggaatgtggcttcacaggtagcttactcaccaaggttgtccctgcccttattattatgaaacaattctaggatttttatttcatccttagtcctctttggctctcttagctaacttgaatctttcaagcacttctgggtttgcactataggactttaccctcctcaagtcttgaatttcttttaattctcattaactgttttttttcttttttaaaaaattttttgtgggtacataattggtgtatatatttatggggtacatgagatgttttgatatgggcatgcaatgggaaataagcacatcatagagaatggggtatccattcactcaagcacttatcctttgagtcacagaccagccaattacaatctttaagttactttaatatatacagttattattgactatagtcaccctattgtgctatcaaatagtaggtcgtattctttctaactatggttttgtacacattaactatccctacctagccccccactacccttcccaatcttttatctattgatgttgacagcaaatcacactgactgctggccaaagtgtaaagatttctcccgctcctttgcatatgatgaggagccaaatgtggtaaacacttcctccatatgaactcaaatgttcgcatttgacgtttcacatctcttattattttctgggggaaaagtcaacccacctccaatgttctttcccaccagccacagtctttctaatttgtaactgacttgtagaaattgctaacgtttctttttttggaatgttccaaagcatgctaacatttatttatctaaaatatcctgttatgcaaaactttgtgcttggcctagtaaataaagatctggctggcattttatgctcaaccaggttgtcttgtatgctattcaacatctaatcaactcacgtgcagtatcagactcacttaagagcttgtgtaaagtgcagactccaagatcccacttcggatctacccaatcagaacctctgagtgtggggtccaggaacagtgttgtaaggagccctccatgtgatgtttgatgttcacatgaagcttgagtaacacaattctatagctttgctactcaatgtgtggttctagcatcagcatcatcagagagacaaaacttgttagaaatacaggatctcagtcactgcttcagacgtcttgagtcagaatctgcattttaatacgatccctgggtaattcacgtgcacacccaagtttgaattgctctgttccacaggacttagcttgtattttcagtgtcaataaataatacgatgtatcaaattattcaatataattagcattagataagtatcctaatgtgtttgtttttgagacagagtctccctctgtcgcccaggctggagtgaagtggcacaatctcggctcactgcaacgagttctgcctcccgggttcaagggattctcctgcctcagcctcccaagaagctgggattacaggcttgtgccaccacacccagctaatttttgtatttttagtagagatggggtttcatcttgttagccaggcttgtcgtgaactcctgacctcaagtgatctgcctgccttggcctcccaaactgctgggattacaggcatgagccactgtgcctgggtcttcctaatgtgttttaaatggagagttacgttaggaaaatgttcctaaacataacacaccccaaagaaaaaccaatatgaactcccaaatcattggaaagccacaaacctggatattaagtatctagcatgagtcctaagaaagaaaaatagctactagagaaataaggatacagaattccgcaaatctacttcttacttcattatatatatttttttcaagaagacaatgtaagactactctgaatgattggaacacgttcttgaggaaatggagggaaatatgtcccctcaccacatgtagtgcagagatttattttctagtgaacactagcaggtctgctcaagtacatactgtcattcgggaaatgtgcctcagtcaaacacaaagaaaacataattttttcttggagtgttgagtctttagggaggagctcttttttgaaataacaaagggacatggaatttggatttttaaagcttgaacatgtcctcattacctgggcacagattcatttcttgtgcaaagatgtcccgagtctcacagcttgaagatgcctgtcaatgaatgaaaggtcgctgcagctgcaggagggaagtcaaagtgcttacaccagagtccctgctttataccttgccatgctttacgcctttgcatcttgcctcacctgagaggtaggttcttagcataatgggcttatcatttttatcgtaagtattttaatgactttaacaagcacaattgtctaaattgtattctgacattgagctagtctttcctctgtttttctgaacatgactcttacagattctccaccaaattcaccaactacattacaactttttccattaggaaaccaacaaacccctatctagccttatcttatggttgctatggttattctcagccatcgatgatgattttactacccactgaaaagctccggcctatgtcctatataggaaatgtgatgaattgattagtgaaattcagatgtggcattaatcatatcccaagatgggaatggtgggggtcaacaaatcctccctactttatatgctgtcatttactttacacttgtatttaccccagtgacaatgatagcaacccacattgcttaagactatcattttggaatttatatattcattcagtcagtctgtactgaacactgggcatttatgatgtgttgctgagtgtacagagatgaatgagacacagtcctgggccccaaagtgctcacagcctcttggggcttagaggcctgcaaatgaatggagatccttgtgacccagcacagagagtgccctaactgcctgtgggatgaagcaggcatcagcaaggacttcatggggggtgggtgagaggaggaggatgaagacattcctggcagaaaaaaaaaaaattgaaagactcccattgtggggcagagggtatcctgggctgtgttccccactttcctaagaagagacttcagcctgcggtgctatgagaacatgcactaaaatctagaggtcctcgatgtctcttcagagaactgttggatctaccaagaagctataaaatagcttaaacattaggggcttcaatgaattcagagaaaaatatagtcaacacaattgctttatttcattttcgccaacagaaactctattagactgtgaacgcttttgtgtgtctaatattttccctgctggtttttcctttggatatgtgtcttcatggggatgaacaagcatgccaaagaaaatcaaatagaacagggagaaaagttatgcctacttattatggcaagctctggcttctacaacatctgaaaattcatgaggaaatgtgtatctttaaaaattcaacttatcatttggcattcatcgtgagagactctgatctgggtggtagaatagagttggtcaggaatgtttatttattttggaagttggccttgagcaagttacttagtgtgtttaaatggggtttattctgtaaatcacagatgctctgtcctttactttgattgatattggaaaggttggatttggaagtacactcacacgtacacacttcatagtgtgaaaagtctaaaaaaagcaaatatgtcctctaaatgctaattaactgtgataaaaatggaaaatcttgcatttactggtattgaattataattacaaaatgatttaatagatgggaatataactttaaatacatgacacagaaaataatttcctaattttcactaattcctagagtgatgggattatgagtaggcttttttcccccttctcctttcccccaaaattctataacgtatttaagtgaggtttataatgaaagttttcacttatttaaacataaattacaatttgaaagaaaatagttttattgaaattcaacttaaatattttgatacctacttaaatgtttaattcaattaaaatgttaatcattaccaaagaagccctaggcaatgtcagtaaatgaacgtgtagaacttagaaggactctgatttctgtgatgagtgatacatcattcccatcttcctttcttgaaaagtgctcaagttgaaatcatccttttatgtcttctcccccagtctaaactaacaggtcataggtcctgtttacttagggctctgtgactcctcttttaccaccgtgataccaggatgaatacctttctcctgatggagaattaatagaacaactaggcaattcggtgggaccagagcccttaaacattcctctttttcagacaaaattgtatgtttgaaacggtttacttctgatggcaaaacgtgactctcccaatgaccatcatgacaatcaatggaagccaattgggaggcactgcagccaggcttcagagagatcacgaccttttgaagctgcttaaatcagacttgaagctgcttagagggcatcagcagatttgatattattaattttttttaactttaccacttatcaggccaaagattctttttttttttttgagatgcagtctctgtctgctgcccaggctggaatgcaatggcgcaatcttggctcattgcaacctctgcctccagggttcaagcaattctcctgcctcagcctcctgagtagctgggattacaggcacgtgccaccacactgggctaattttttgtatttttagtagagatggggtttcaccatgttggcaggctggtcttgaactcctgaccttgtgatccacctgcctcagcctcccaaagtgctggtattacaggcgtgagccaccgcgcccggccaaagattcttaaaatagggtgtaataaattattttattggaaaaaataatattttataagtatcttcagtaaaaatcaatgtatataaacaccattaggcagttctattttggtcacacaaatcggtaacagtcaccagcatcactgtgtcccctgaaaagatctctggatggtttttttttttcgacaaggtcttgctctgtcgctcaggctggagtgcggtggagtgatctcagctcactgtaacttccacttcccgagttcaagtgatcctcctgcctcagcctccctagtagctaggactacaggtgtgtcccacaatggccggttaatttttgtatttttagtagagatggggtttcaccatgtttggcaggctggtctcaaactcctgacctcaggtgatctgctggcctcagcctcccaaaatgcgaggattacaggcatgagccactgtgtctagcctggatggtttttattaacctgaacagtggtgaaaaataaaataatctggaccataaataaggaaagacctcaacatcaactaaaacacagatatttataaatgactttgggatgtggcattcatttccaaattttgctttgttagaccttaggcgtttatatagctaaaaaagtcaaggggatgacttcacttgaattgtgcatattcatttgccatttaattcaataaagaacagcaaatgtattgattgcagtaacagttactgctgctgctcacaagccagacaccaccagaaacacacctataggcacactaagttggccatactacccggtgcaagggacaggatgcaccctatgtgagtatcctaatttttatcaaggaggtaggaagaatggggcaaaactaaagctgtaagtggtgaagagagagctgttactcatgctaaccaaagaggtggatgtccagtcactttgctggtttagacattactttagttttgatcttcactcagacatgattacagagtggttttgtttttgttttgttccattacagtggaagaatgaccttgtgtggtgctggtgtcctgtgaaattgcttatattcaatagtaaaacatcatcctcactcacagctgacagtggtcaggagctgctcccatctttgtcagcatccttcacctcatgcctactgtgtatcagccagtgctaccaggcctgcacacacatcgctgactgttcaacacttcctgcaaagataggaggcatccttcttcccaatgtgcacatcaaacatccacatctctcagaagtctggtagcttgcctatggccacacagaaaagaactaaagctatttatcacaagaataattaggtaaataagtaaatacacaagaaacaacaagaagctttaaaggaagcagacacataaatggttgagggaaaccagagagacttatggaactcgatcacttgggacttaagcaatggagaggaattcataaagaggtctcatgggtgggtggcatcagggaaggattccagcttctatttgggtaaacatgtgcacaaagacccaggggcctacaagagaaagaacaacaaacctttcacggacataagggaaggctttatgtcgtaggtgatacctgaaccaagagtccaaagggcagagaacagtttccaagcagagaatccatggattatgctggggtgggggttggttggtagaagacaaaaaatgaacaatgagaactgagaaaagttgtggggtatgacagtcagaagaatgctagtgatccccgagctaccaatgtcaggagaattatgaggaaagggattaaatcataaagggttaaatttcagtgagaatgggacaagcagaaacagtaaccattttctccttttcaaggagttagagggctgaaggcatgcgacagagggaaaagaagctttggagtgtggagacagcacacatcagatacgcagtgggtgggtttgttttcattattatgcatttctaggaacagaatatatagcaactgttacatacctaatggtagcagtaaatatttaacaattaacatttaacaagcctctggatgattctgatgcatactaaataaagagaacctctgtatgctagaaataataaggcctggaccataaagtactagtgctacagtcaattcataaatctgtcatttcatgaataaaatttcatggttgtaattgtagcattataagctttatgtgtgcatgtgtttgtgtgtgtgtgtgtgtgtgtagagcgaaggaaagagatttcatgctaaaggaaaccttagaattcatggactgcctaggttctctaactttgtttagcatacatatattagggttctctagagggacagaactaatagattatatacatatatatatatatatatatatatatatatatatatatatatatatatatatatatggagtttattaaggagtattgactcacacaatcataaggtgaggtctgcaagctgaggagcaaggaagccagcccgagtcccaaagctgaagaacctggagtccaatgtttgagagtaggaagcatccagcgtggcagaaagagataggccagagactaaaccagtctagtctttccatgttcttctgcctgcttttattctggccatgctggtagctgattagatggtgcccaccctggttgaggatggttctgtctttcccagtccactgactcaaatgttaatctcctttggcaacaccctctcagacacacccaaaggcaatactttgcatccttcagtcaatcaagttgacactcaatattaaccatcacaatacatgagaatcatccaaaggcttgttaagtgttgcgtgatactgcattctgtgcacctaccgtgtcttccctacccacttttccagccatggacactgaggttgctttcaattctcagccaccgcactgcaaagagcagctacatgcacgtcccttttacacatgtgtcagaactactttgagataggtaactggagacacattcactaggtagtagggtatacaaatactaaaaattttactacataacatgaggggtgccgtcaaagagttataacagtgtacactcccaccatcaatacgtgagttcctatatccccacatttgtgccaacacatgatactatccaactttctgattttgacagctttttaagtacaaagcgatatattttttatctttttaaataatattgggtgcatatatatttgtatatatacatagacacatatatttgtacatatatatacttatatatttatctcaccttgtgatatggtttggctgtgtcctcacccaaatctcaccttgaattgtaataatcccccctgtgtcaagggggggtccaggtggagataattgaattatggggcagttttccccatactgttcttgtggtagtgaataagtctcaccggatctgatagttttataaattggaattcccctgcgcaagctctcttgcctgccaccatgtaagatatgcctttgcttctcctttgcctgctgccatgattgtgaggcctccccagccatgtggaactgtgagtcccttaaactgctttcctttataaattacccattctctagtgtggctctattagcagcatgaaaatagactaatacactttgctaactgtgtagtcttggataattcacttctttctgagtttcagttctctcatcagtaaaatgaagaaaaattaagtacctctgatagaaaagccatgaaatgagatgatgtgtgaaaagtaattcacatgagctctgcaaagcaataagctaccaaaatagttatttgtttttattctgggatttgattaaaaatattgtttctcaaaaggcaaatttttctaaagtacttagggaactgaattataagaaaattgtcaattatcagaattcagtttggggatattcttatgagatttttggaacccacagggagagatcaagaatacctacacagttgacaatgtccaggttaagggaattttggtaaaggaaagagactaatagtagattaaaaaagagtatcttttgcatttcctttttcgtttatagtttctggtgtatatgtaacatatcattaaaaactggtaatagaagttaaaaagaaatctataatcttatcacttaaaagcactgctgtattaaaactttgatgcatcttttgttatgcttaactgaataatttataagtatgctgatcacattagtcatgtatcacacttaactaatgaagagagcatgctaatttttcaatagtctctgcataagtcattttaattgcttcataatattccatcaagtacatgttgctggggtaattatattttagtgctctggactagaaagtaattcagtatctataaaaatgtaaaagattaattattaatacaaactattttaatcaaatggatttagacaggttagcatatcttagtgtatagcaatgtgcttaataataccttatatttgtacagccccatagagagtaaacactttcaagcagccttgtgatctggaccgtctgggtattactgttatgttatagatgaaggagccagtcaaggctatgtgtttaagaatttgcctttagatctgacctttgcaagagccaatactggggtgcaatgtgatgttttgatacttatatacattgtggaatgatgaaacatatccatcacctcacatattttttgtggtgggaacatttaaaatccactcatttagcaaatttgaaatatataatatattgcattccataaatatatacaattatttgtcaattaaaaataaaaattcttgtaaatttaaattccttacagatgctggatattaggcttctgtctgatgcatagtttgcacatattttcttctattctgtaagttgtctgtttattgatgatttcttttgctgtgcaaaagctcttaattttaactagatcccatttgtcaatatttgattttgtcgtgattgctttcaatgtctttgtcatgaaatctttgcccattgtatgtccaggatggtgttacctaggttgtcttcaagggcttttttagttttggattttacatttaaatatttaacgcatattgagttaacttttgtatatggtgtaaggaaggggtccagtttcggttttctacttatggctagctggctatctcagcactatttattgaataaggggtcctttccacgttgcttgtttttgtaagctttgtcaaagatcaggtggttgtaggtatgcagccttatttctgggtactctgttctgttccactggtctatgtgtctgtttgataccattaccatggtgttttggttactgtagcactgtagtacagtttgaagtcagataacatgacgtctccagcattgttcctttggattaggattgcctcggctatttgggctcttttttggttccttatgaatcttaaaatagttttttctacttctgtgaagaatgtcattggtagtttgataacaatagtattgaatctgtacattgctttgggcagtacggccattttaatgatagtgagtcttcctatctatgagcatggaatgtttttccatttgtgcatgtcatttctgatttctttgagcagtgttttgttactctcattgtagagatcttttgcctccctggttagctgtattcctaggtattttattctttttgaggtaattgcaaatgggattgcgtttctgatttggctcttggcttggttcttggctgttattggtgtataggaatgctagtgatttttggacattgattttgtatcctaagagtttgctgaagttgtttaccagctgaaggagcttttgggctgagatgatgggggtttctagatatagaatcatgtcatctgcaaacagggatagtttgacttcctctcttcctatttggataccttttatttctttctcttgcctgattgctctggcagacttctgatactatgttgaacgagagtggtgagagggggcatccttgtcttgtggtggttttcaaggggaatgtttccagctatggcccattcactgtaatgttgtctgtgggtttgccatagatagcttttattttgaagtatgttccttcaatacctagtttattgaggattttttaacttgaaaggatgttgaattttattaaaagccttttccacatctattgagataatcatgtgatttttgtctttagttctgtttatgcgatgaatcacacttattgatttgcatatgttgaaccaaccttgcatcccagagatgaagcctacttgattgtaatggatttgctttttgaagtgcttctggattcagcttgcaagtattttgttgaggatttttgtatcagtgttcatcaaaaatattgtcctgaagttttctatttttgttgtatctctgccaggttttggtatcaggatgatatttacctcatagaataggttggagagaagtccttcctcctcagttttttggaaatcatatcattgggaatggtaccagctcttctttgtacatctggtagaattgagctgtgaatccgtctggccctttttggtcggtaggctgtttattactgattcaattttggagctcattattggtctgttcagggaatcaatttcttccgggtttagtcttgtgaggctgtatatgtccaggaatttagccatctcaggttttctagtttgcgtatgtagaggtgttcagagtagtttctgatgtttctgatgtttggtgttttttttttctgtgaggtcagtggaagtatctcctttgtcacttctaattgtgtttatttggatcttctcttttttcttctttattaatctagctagcaacctatcttatcaatttttattatcttactaattaaaaaacaacctcctgaatttgttgaacttttgaatggcttttcgtttcttgatttccttcagtttagctctgattttggttatttcttgtcttctgttagctttggggttgatttactcttgcttctctaattatttcagttgtgatgttaggttgttaattttagatctttataacttcttgatggggcattgagtgccatgaatttttgccttagctgcgtcccagagattctggtaggtcgtatctttgttctcattagtttcaaagaacttcttgatttcagccttaatttcattatttatgcaaaaatcattcaggagaatggtgtttaatttccatgtaattgcatggttttgagcgatttttgtcagtcttctgtttttattgtgcgtggtctgagagtgtgttttgtataagttaggttcttttgcatttgctgaagattgttttatgtgcaattaagcaatcaattttagagtatgtaccatgtagcaatgataacaacatatattctgtagtttttgggtgaagaaaaaaacaactccattaaaacgcgggaaaaggacatgaacactgttgttgttgttgggttttattttttttttttttttgagacgaagtctcgctctgtctccggggctggagtgcagtggcgcgatctcgactcactgcaagctccaccttccaggttcacaccattctcctgcctcagcctcctgagtagctgggactacaggcacctgccaccacacctggcaaatttttttgtatttttagtagagatggggtttcattgtgttagccaggatggtctcgatctcctgacctcgtgatccacccacctcggcctcccaaagggctgggattacaggcttgagccactgcgcccagccgtgaacacttttctaaagaagtcgtatatatggctaacaagcatatgaagaaaatcccaatatcactgatcattagagaaatacaaatcaaagccacaatgagatatcatctcacacaagtcagaatggctattattaaaaagttaaaaagtaacagatgatgatgaggttgcagagaaaagggaacacttatacactgttggtaggagtctaaattaattcaaccattgtggaaaacagtatggcaattcctcaaagagctaagaacagaaccaccatttggcccaacaatcccattactgggtatgtacccagaagaatataaatcattctaccacaaagacacatgcacgcaaatgtttattgcagcactagtcacaatagcaaagacatggaatcaacataaatgcccataagtgacagactggataaagaaaatatggtacatatacatcacagaatactatgcagccataagaaaagaatgagatcatgtcttttatgggaacatggatggagctggaggccattatcattagcaaactaatgtaggaacagaaaaccaaataccatatgttcttataagtggaagctaaatgatgagaactcataaatacaaggaaaggaacaacggacactggggcttacttgagagtggagggtgggaagatggagacgagcagaaaaattaactattgggtaccaggcgtaatacgtgggtaacaaaataatctgtacaacatgagtttatataacaaacctacacatgcacccttgaacttaaaagttaaaaaaattcagtaaagtaaatgttgtataataatttgacatgaaattaaaaaggtaaatgtaaatgcacaaagaaaaaaactaaagtcaaaaaaattaaaaaataaaagacataacaataacaaaaaagcatatcaggatcaccgagagtagtttcagaatatacacttccctgaagataaatataaataataaatcccagtctactctagtttggtgacctcttacagagaacaataaagcaatgctatcacacacacacagacacacacacacacaaagaggtcaatattgggacttctttctccactgaactttcttaatacaacatcattctacttcttaagttaaacaacttaaagtagggctaaccaagggtctgaattagaatctctcagcataagtgagtgttttgaaaatttgataaattgctcttaagtttcttaatacatatagaatctttatataagattctgtaaacaactttgtgagcatgcaatgaataatacatgaaattgcttataaaattaatagacatagtaaagatttaatacaaaaattgtgaatgtaagcactcacattttgagatcttcaaaatttatgataatggctttctgctaatgaatttaatagtgaccacagttaataataatgtactgtatatttcaaaattgctaaaataatatatttttaatattttcataacataaaaatggtaactaatgaggtgatgggtgtattcattagcttgattaactctttctacaatgtatgcaaaaatcaaaacatcacattgtaccccataaatatgcacaattatttgttgtaaccttaaaatagataaattcaaaaaacttatgacaaatgtatgataaatgcatgtatttcaaatgaggaaaatcatttaatttcttgaactctgaatagaaaatgacacagaattaagattgctgtaatgtagttgttaaagagtttctcattgatagacttgttttcactatgacacttataaacacttaacccttgctatgaaacataacattaggttacattattctagagaccatcttaaaaccatgcgagtattgtaattgttttttcccagtagctatttagatctgatcactataattgctaagtaaaataaaacagggaattgcaactttccaaatcatcaatttctaaataaattttagttgacttttggataacacagggaggaggggaaacccatgcaatggaaaattcatgtataacctttgataccccaaaaaggtaactgctaatagcttactgttgactggaagctattttgtattttgtatatgagttatatactgtattcttacaacaaagcaagctagagaaaagaaaactgtaagaaaatcataaggaagagaaaaaatacttactcttcattaactagaagtgagtcatcatagaatcttcatcctcattgtcttcgtgttgagtagtctgaggaggaggagggagaggaggggttggtcttgctgttcacgggtggcagaggcagaagaaaacctgcatatatgtggaccctcagagttcaaaaccatgaggttcaggggtcaactgtattttggaaacatatgcatagcatgtaaattgtctccttttttttttacatagctaaagaatatgacttatagaaactgataattttatgaaacataatcaatctcaattactaaatgaaatacgtttttgtgctgcattagaagccattaagttgggccaggtgcagtggctcacacctataatccaccactttgggaggcagaagcaggcagatcgcttgagctcaggagtttgagaccatcctgagcaacatggtgaaactatgtctgtacaaaaaatacaaagaaaaaaaaattaggcgggtgtggtggcttacgcctgtagtcctagttactgttagtgctattttacaacagcatgtgctcactttgtgtctctgtgtcacattttggtaattcttgcaatatttcaagcttttaaattattattatatgttacggtgatctgcaatcagtgatgtttgatgttactattgtaatatcacgccacaaaccatgttcatattcagcagcaaacttaatggataaatgtgtgtgttctgactcctccaccaactggctgttcccgcatctctctctctctccttggacctccctatttcctgagagacaacaatattgaaattagaccaattaataaccttacaatggcctctaagtattcaagtgaaaggaagagtcatgtgtctttcattttaagtcaaaaactagaaatgactgcacttaggaagacattgtccaccaagataagcagaaagctaggcttcttgcagcaaacatttagccaagttgtgaatgcaaagaaaaagtttgtgaagagaataaaaagtgctacttcagtgaacacatgaatgataagaaagtgaaataaccctattgctgatacgaagacagttttagtggtctggatagaagatcaaatcagccactacattcccttaagccaaagcctgatcaaggccctaagttcttttcaattctatgaaggctgagagaggtgaggaagctgtagcagaaagctggaagctagcagaggttggttcatgaggttcaagaaaagaggctgtctccataacatagaagtacaaggtgaagcagcaaatccttaggatgaagctgcagtaagttatccagaagatgtagctaagatcataggtaaaggtggctacactaaacaacagattttcagcatagatgaaacagccttctattggaagatgccatctagaactttcatagctagagaggagaagtcaatgtgtgacttcaaaggacaggctgactctcttgtcagagactaatgcagttggtgactttaagctgaagacagtgctcatttaccattctgaaaatcctaggacacgtaagaattatgctaaattcttctctgtaaagcacaggcagatgacagcacatctgtttgcaacatggtttactgaatatttgaaacccactattgaagcctaccgggctcaaatagtctgcctgccttggcctcccaaagtgctgggattacaggcaagagccactgtgtctagcccttgtttttgaagaaatacattttgtaaggctatagctcttattgatactgattcctccaattaatctgggcaaagtaaatttaaaaccttctggaaagcagtcaccatcctagatgctattaagaacatttgtaactcatgagagaaggtaaaaatatcagcattaatgggcatttggaagaagctgattccaacccttagggatgactttgaggggttcaagacttcagtggaggaaggaactgcggatgtggtgaaaatagcaagagaactagaattagaattggagcctaaagatgtgactgaattgctgcaatcttataataaaacattaatggatgaggagttgcttcttatgaatgagagaagaaagtggtttcttgagatggaatctactcctggtgaagatgctatgaacatagttgaaatgacaacaaaggatttagaatattacatgaacttagttgataaagcagtggcagggtttgagaggattgactttaattttcaagtttggctatgggtgaaatatcaaatggcatcacatgctacagagaagtctttcatgaaaggaagaattaatgtggcaaacttcattgtttttttaaaaattcactccacagtcaccccaaccttcagcaaccaccaccctgatcagtcagcagcgatcaatatcgaggcaagaacctctaccaggaaaaagattaaaatttactgaagactgagattatgattagtattttttttagcaatcaagtattttaaaattaaggcatatacatttttaaggcatatagctattatacacttactaaaatataaagatactatttatatgcactaggaaacaaaaaacttgatgtgatgaaatttattgcaaaatattcactttattgtggtagtctggaaccgaatccacagtacctctgaagtgtctgtacctatgataagtaaagaaatgttataaaggaatatattagcttgtaaattactaagcttcttacatagaactaatttaattaagctattgcttaacaattaacagttgttaatctattaacaattaacagttgttaatctattaacaattaacaaccaccacccacattcactagatacacacaagtaaacagagtagcaaaaccaaccctcttgtacccattccgaggtcccaagcatcaaccccatggccttttctcccccgtgcaactctttcatacgttgcccatgatctgtattattttgaagcaaatttaaaacttcctagctttatatccttaaatatttgtgtgcaaattcctgaaatttaagattctattttcttaaaatagaatctaaagaagtgaacaataatttatttgcaccatcaaataatcagttgtttttcaaattttcaatagttaactggaaaacagcattttattattactatttttttaacaacaactttccaaagacctcaatatgatacaaaagagaatttcttagtaaggactattgatttcagagtccattctctgaacatgttctctgtgtagttttacctcatccactatctgccactcaatcaagatttgagtccctgaggaattgctgaaggtacatatattcagagaagatgcttattcctattcttacagagccatggttttcaaacctgcgggaacaaagccacaatgagtcattatgtctgttattctttttttcattactatacatttgtggcctaagattttgtgactgtcctggaagaattcaaaggaaaatttgaatgtatggcacaataggctttacactacatgtggcattaagataaatatcatttaagtgtaaaataagccctaatactgtgtcatcagaatactaaagaattccccctcagatacatttattttaatttttttaatctttagggagcagcaaggcgttttatctggttccttacagaaacacttatggttattctatatattatgaataatgtagtttcttaaaattaaaataagcagagtttaaagtacgtatacagcatcattaaaataacatgcaatatgttttataaagtgacttcagaggatgcatacaaatatctataaaagttatgtatgcacctttaaaataatttgaaaatgttgatcaaccaatctaaactgcgttgaaatagaaacaatatggatatttaggaacttctggttgctgcatggtactataattacactggctgaagtataatttccaaaaattatatgcaaaggcaaactagttaaaaagaaaataaaactctacagtaaagaaattaaaactatttttgttgaagtaactttcctaggaagtattctattggtatcttttgtcttgaggttaaaaatattgtctactatgtttaaataattatttggctttatttcccaaatggaattgtcactttgatcaaagcatatagagaggcgttgctatttctccttttactctctagtggggtgacttggatgttaaactcaagtaatgagattcagagattaataaactgtctgtaacactgtgccatctgtgaagacttaatcactatacaacacaacaatcacaactgcatgttattgaggcttgttatgaaggaggcagatgttaatctcttcatcttacttaatttggatatcagactttggaagtaagtattcttatctccaatttatagataaagaaactgaggtttaggaatctgattcaagattttccagctgttaagtgatggatccccatcttttaagagccaggattgtcttattattttttttccaggtcatactaaggtctccagtacaaaagtttggatgagcatacttaatttctctttatggaaagggcttgaagggagtattaatatttcacttgttgctggaataatgattgttgatgtttgaaaaaaatgttgtctacaaagattgagaagattttttgtgaacatgaaataaatgagattttgtcatctgtgttgagtagaagaaatatttcccaaatttcagacatcctagcattaaaaatggagaacatgtattaaagccttcaagctttctctgttcttgtttcatttatctatatcaagatacccatgggtatgtgagccatttactggttggttttgtagttttgttacatctggcagtgtttcaaaaggtaatgcaagtgggcaggtgttattattgattgaaataagcagtttacaccagtctaaaacagtgtccgctgcatgcatttattcaccctctgctcccaaatgacagatgagtttgtctttgtgaagaataggttaagccctgattacattattactaaataaaatactctctcttttgactttctctataatgaaactttaattatgtgactaaattgtacagaatctgaaggtcagaaaacccaaaataacacaccatcatacatttctctgtgtgtcctaaaaacatttggtaaaatttaaagttggtggcaacttaaaaaataatactgtagagataattaatttttgtattcactaaatcttaatattacaattgggcatgtctcagaggttaccgagtttctcccagtgtctagcttctatgaaagtataggttaagatctacataaagatacagtggtactcaggtaaataagacatatagtgtctaatgtacatcacaatatacattataatatgaagtatacattaatgtacatccatacatacactagtatcattattaatatacattaaataatatatggcttcagaggccgtgatgagggtcatcagttctgaactctatgaaacagtaagggctgattcaactctatccaaactttttaaacattctaatttttcaaattaaatataataaactggatatttattttaatctgcttagaaatgttggttgattgcgagtctctttctaaagcacatatttaagtttccatttgggaaaacaattagcaatttaataaataaatgacattttgaagtagactgaaggctaatcaatatattagaatgactgtataaaaacaatagaatatacaggtaaatgaggaataatttactttaaattttataatgtctgtagtggggaattcagtagttttctttcagcactgaacaatagtgattttgatggtaatggtcataagaatgccattattcttagtaatattaatggtaaaatgagagatgctaattgagctctttatggtataatgcatgataaattatgtgatatctaaaatatgaagttgaaaggtatttctcatagtgttcttaatgatctataaaaaagcacaaaagtgaaaaatagaattttaatgaggtattcttaaaaaaatcttctatttttgcttttggataaatacatgcaaaatttaaatcttgattgtctttgctgaactattttttaaagtgccaaggacctatttctttttcatagttagcatgcttattttcatgtaactttttataatgaaagacaatacacattcagaaaaagacaaaaagcataaatgtatatacaactcattggactatcaaaaagtgaaaatgctatgtaaatgttacgtaggccaaacatattattgtaactttcatgcccttactgttgactcttacctccctcttcccaccaaataatcatgaccatgaattctattgccatagattagttttgcttattttgaattatatacagaaggaatcatactatatgaacttttaaatatctggctccttgggttaacatcatgcttatgaaaaacacccatgttgtgtctacataggtataactgatttatttttatataatgaaatgtcctacagtaatgaaaataagtaaaagtataaacaatacaattaaaaatataatttaaaaatatagcagtatttaaaaatccattctataattggacatatgaattatactttgggtcaattatgaataatgcttcaaaaatattcacgtacatacatgtcttttgctagctggaaaactgcctgattttgcgctgggtacatcattcttcagagtggaattgccaactcataaaaaatgtatatatttaattttagtagaaaatgcaaactaattttaatggaaattataccaatttatattctcaacagcagtgtattaaaattccatttgttccacattcttgaaaacacttggtattaattttcttttgttttagatgtttattgttaccctcatttttagccattctagttggtgtgcataactctcacactttggttctaattggcattgtccaatgtctaataagattagcaaatatttcgtagatttgttaggcatttaaatacttttttctctttttttctctcattgctttgtagttcactatgtattctggatactaatatactgaaaaataggttctaccattctgtggtttctttctattataacatttttaaatgaacaaagttcttaatgtattctgacatcagtttcctttcatggttaagaaaatcgttgaactccttaaaatcgtgaaaatattcagctatgttatcttcctataacattactgttttgcctttcacatttatgtctacagtcttcctggaattcacttctgcatacggtttgaggtagtgatcaatccttctttaaaaatttctttctttttaattttttatgggtatgtgaaatgttttgatacatgcatgcagtgtgaactaagcacatcatggatggggttatccattccctcaagtgtttatcctttgagttacaaacaatccgagtatactttttaagttactttaaaatgtacagttattattgactatagtcaccctgttgtgctatcaaataataggtcttagtcattctttctgtttgtttgtacccgttaaccatccccacctccctgcaagccccccactacacttctcagcctctagtaaccatctgtctactctctatgtccatgaactcaacttttttgatttttagatttttctttttaaattgttttccaatgtggatatccaatttatacagcaccatgtatttaaaagaattatttttctccccactgctctgcatggcaaacattgttaataatccactctccatacatgctgaatctgtttctggattctctgatctgttccagtgatctgtttgaagaacctgccaataagacattctcttattttctataacattataagacttaatatccagtaaaaaaaaaaccctccaactttgtttttcttgaggagtatcttggtgatttccattttgttacatttccacataaaacttgtaactatcttgtaatttgtgcacacacacaaacattggtttgaatttggtagaatctatatattaatttaggagtattgacatcttttcaatatgtattttctactataaacctttaaaatttttctcaatattttataattttcatgtaaaggcattaaatatattttattagttttttacagttaaataatatagtttgatactaatgtaaatgtcattcaaaaatttcactttctgttgcttttgtataaatgtttaattcatttttatatatagacttttatctaacagacttgctaaactaattctatagatttttcaaatttcctacatttgcactcatacacctataaataaaggcagttttatttcttcctttccaatcctactacctgttaaatatttttcttgccttattacactaactagaagttcattacatatttaatgaaagggtctatacagaacatacttgtcacattctcaaacacaaagcagctctcagcatttcctataatgtatgatacttgctgtatgatttttacagatactctttgcagagttagacattgcctgctgggctaagaattttaatcctgtgtgaatattacattttatgaaatgctttttctgtatttggtgagaaaaccatatgttacttaatgtgataaattacattgaatgacttttaaatattaagcaattcttgcattcctggaattaactcgattgagatatgatttattattttttctatatttttatattgtagaatcatttttaaactatttttaaggagttttggattggcattcatgggtaagatcgacttttattttccttcttgcaagttccttgtcagattttaatatcagggttatgctggcctcacaaaacaagctgggaagcattctctgtttttctgctctttgaaggtacttgtttaatactggtgtgattttgtccttaaatgtttagaagaattcactaggaaagacatcgaggcctgcaattttctgtgtgaatatgtttacaattatgcatgtaatctaacagatgtgggcagttcaggttttcctgttctcatctgttttggtaagtggcgattggtttggaatttatttcatttaaatttgtaaaattagtggcataattcgaaatatcattatcactctaatgtgtataggatcatcgtaagatgctcttttgcattactgatattgtttattcatgtctcctatttttttctttcccagatcaatcctaactagggttttgttaacttaaacgttcttttcaaaaaccaacttgtgttttttttccctaattttggtaatttttcatatgtattttaatcatgaggaataatacctcttgtagaaagaagaatatacagaagtcaaaatgaaaaataattacaatagtctgaatttccaaaattcgggataaacacaattcctccaaattttgtgtatattctttcagatttataacacaaatgtatttatgaagtatgttttctaaacacacacagatgaaatatagaattatactgaatgctatttgatacatatgaccactgtttcctcatttatacatcttcttactacttccctgcttagattattttaaaacatatttaatattgcatgaccttcttcaaagattctacaaaatatatttataatcaataaggagtttgtttttaaatagaacttaaaatgagcatatctaacataatttataagttctgcaatatcataaaataatcataggctatttgacttctgcttgtagtgtaaaaatatctttttagaatttattatttgaattagaattcaaagtctaataatacgttgaattaatacatgttttatagtacaatactatttattacctttgaaatcatttttattgagaaagtatttagttgccataaaatgcacccaaataaagtgcagaaattgatgagttctgataaatgtaaacacctgtttaaccccacaaagaggaatcagaatgtatccatcacccaacagttccttcatgctcctttgtagacaatgctcatcacaccctgaccctggaaataatcagctttctgtcactgtagagtatttttactattctagaattttatataaatgaaatcatcttgtgttcacttttatatctggcatttttcattctacaaaatatttttttaattgttttatgttgttgagtacatcatcagtttatgtcttttattgagtaatttcccattgtatagatatactgtttgttttttttttttaactctgtcttatttttgtcaattattcattcttttctaaaatatttcttaatttttggctttaatttgctttatttttccccctaatgtcttaacttctatccttaactcatttatcttctgcctttcttcttctgatatccatgggctcaatattggtgactttgctttcatttgtgatattgataatttgggtcttttctttcccttttttcccccatagatagcaaactagaggtttatcaatcttagcaaacttttgaaagaaccaccttttagtttgttgattttctcgaatgttttcctgtttccaattttattctttgtgctctaatttttaaaatttctttccttctgcattctttaggcttcaattctaaattctctaataacctaggatgaaaacttgcattatttatttagatctttgtttgttttctaatatatgcatttaatgctacaaattttcctcgaacactgcttttgctctatcctgcgtattttgatgttatattttcattttcatacagatttaaacattctagataatttcacatgaaacttctatttttaacttgaatttttttcagatgtttaggaactttctagttatttttctgttattaatttatagtttaattcctttatgacctgagagcatacattgtatgatttctatttttataaatttgcaagagtgtgttttatgaccgataatacatggtgaatgttccatgtgagcttaagatgagtgtgtctgctgttgttgggtgaaatgttctcaaaatgttaattaaatctagttgaataatagtgatgttcaggtcttctatattcttactgctttcctgcttccttgatacatcaattattccaactataataatggacttctctgtttttaacttgccattctatcagtatttgcctcatctaacgactctgttgttagttgtctacacagttaggattattttaccatcttggaaaattgatcactttgtctttaggaaatgtttcttgctatcccaagtaatcttccttgttcttcaggtttctttgtctgaaattaatgtagctccttcggcttttattttttattagtgttaacgtgtgatatatctttcttcatccatttacttttaatgtacgttagtctatatttaatgtggatttcttgtagacaacatagctgggcctactctttctatatactctgacaatctctttaattggtatatttagattgctcacttttcaagtgattattgatatatttgaattaatatgtatcatgcttttaactgttttctatttgttgcagttgtttttaattttttgccccattttaagttccttatctgattttaattgaaaatttttttatgattctattttatctgctcttttactgtatcagtcatactttaaaaattgtcagtggctgccttaaactaaaccaaagtctattttcaaatattaataatactattctacttattatatagtgcaggtcccttaaaacagagtattcctaacttctcccttacgtacctgacaacattcatttgtaatttaggtgaatgtaatattaatttgcaataaaaattaaattcatttaatttatccatgtgctataagcacccaatgcatgattattattgtaaatgtttgtcttttaactaatgatttcattaactaagaataagaaaaataaatgatcttacttcttttatttcttctttaatgatcttcctttctcaatgtagatccagatttctgagctatataactttccttttgtctgaataacttcttcaaacatttcttatagggaaggaatgctctcgatgcattccctcagtttttgtttgcctgagagtctttatttctccttcactttggaaggataatttctctggatatagagttgtagttttatttttacttctttcaatgctttacatattttactcctctctttgcttgcttgcttgttttctgatgaaaagtccaatgtaagttttatctttctttctctatcagtaatatagctacctttcgatgccctctgcttcttccaaaattttgtttttgtctttggtttactgtaatttgcatctgatatgactcagaatagtttttattttggtttttaatcttcatgtttattctctgagtttcctggatctacagttcagtgtctgtcattaatattgaaaagttattggccattattacttcaagtatttctttgatctattatcttttccttctggtattccacttacgcatatgttacaacgtttataattgcccacaattcttgatactatcttatgcttttcttttttctttttctattacaggtttttttctttttctttttctattacagctttttttttctttgtctattacagcttgagaaatttgtatcttcttttcttttatatatatatatttttattatactttaagttctagggtacatgtgcacaatcttctgatcttttgttggttgtattgaatctgttgttgggcccatcaaaggcattcttcacttctgttccagcatttttaatttgtagcatttctctttgattcttttgcagagttttcatctctcgattacattacccatctgtttttgcatgttttgagctttttccattagaccccttagcatatcaatcatagttgttttaagcccttgtctgattttcaacatctgtggcatatttgagtcttgttctgataattgttttgtctctgcagagtgtggggtttttttttttcttactttttgccattccttgtaatattttgttgaaaccaaaatgcgctatatctgatgacaatagaaactaagacaaataggttgttagtatgaagatttacattactctggctaagaaatgggttacagtttaggtttgctataggtactataggtaccagatgcttccggttcatctaatgcacttatttctattcctccttttgacttaaattctcttcagaggcggtctttgttttttaagtctttcaactgttatccagtattattgcactggactcctgttgtgtggtggttcgatgtgtaagaggagcaatgttctgtaatattccaactcaatttaagtgtttcagtgggttgttgtctcagaactgtgaccttcacaagcatatctctggtggtatagcttttttccctcctgccagctactgtctttcctggctactaggtttccaatctatttctgtgacgctctgactcctgttgcttttttttccttaggtaagacaggaaaggtacggaggctggaatgggagaagtactgccccccagttgggagaggttctggcaaagtcttttcttcaggagaatagccctttgttatgaagaaaaccctgagcatacttcacagtcattccctttcccacttcctgacagagccagaagggagtctttttctaatcttcatagaatgcatggatgggttcttggaggtaaagcccacagaaatgtggagccctctaagactgtggtcaggaacttctcactctcatgctagtctacactcagtttccagagattcaccaaaattatcatagaagttttcctgtcagtttctggtgccagtggcttttgttccaggtggatggatctcagctctgactctttggatggtcccgtccctctagatttcagcatggtggtgtgtcatgtgtactagcttgtgctgctataaccaataccatagactgggtgacttaaacaacagacatttattacttatagttcttgaggttgaaaagtccgagaacaaggtgctacccaattcacttcttggttagggtcctatttgtggtttgcagatggctatctctctgctgtgtctgcacctggtgaagaaaaagaagtctgagctctcttcgtattcttataagggcactaatttcctcatgaaggccccacctcatgaccttatcaaaatttgaatacctcccaaagacctcatttccaaatacagtcacattgtgggttagggcttcaacatagaattttgagagggtgcaatttattctatagcaccatgaaagcacagttctctgatgagtctaagaaaagtgattgatttctagtttgtttgtcttttttcttgtggtgcagtgtagagcagtgtttcactctgagatgggtactgtgtgtgtgtgtataaatattctaatatattctaacagaataatatgtatattctgtagaatatatattagaataatgtatattctgtagaatatatattagaataatgtatattctataggagataaatattaatttccctttaagaacagtttttgctgctattttattattttttattgtacgtaggacactacataagaaaaaaatgaatagacaattttaggcctagaaggctatctttctgcaaagtgtaatttcattcacttttacaggcaaccagaagcactgaacctctctgacatcctcactataattccccacagattggaaagatgggaagtttacctttaatctccgtgcggggctgtcccatctctggctttccctttatcctaaaaagtagatcctctaaattcttacaaaaagcctatggaagcctgtaaaatattctcttctttgagggctctagaactaaaattttgtccctaaccccatgaaagctgctcataaaaccatgaccaaaaacaacaacaacaacaacaacgaaactacccagctattgtttctcctcttcagaaatcctttagttatccctaaagagaaagcctcaaatgctgggctcacctctttgggttttcttcttctagatcttggacatttaatattttattatatttttatctcttcaactttttttttattccaaaaggagggttcagaatttccagtctagcagtaccataatgtgaatttttatagttattgtccatctcaataaaaatttagtcttccacaaaatcgtacatatcatatcctaatataaatgtaagctttatgacttgtccacatatctctcataaaacaatttattgctgtgtttcaacaatagttacagattacagccaagtttgcatctttcctgtgctttttctcttctggctatttgatctgtcttgggaattcaaacccttttatgcaaaaggtactaaacagtatattttataacttgtatctccatagattctaatataatgatttgcacaaggggtctcatcaagttatcattaataattgtgttccttcaaataaatattttaataatattcagtatttttggaaggtggtagagtttgttaaataaaattccattccctttaattttgcaaattgagatgtattatacgtgcagctcaaaacttaacattctaatttgattagtggattctcattgctatttctttattataataaatgaattttacattcataatcaagactgaatcaactttgtaagatacagtcctgatgtcttgttcaacatatgtttaaaagttactctcatctgggtttatgttagcaaattttccacttttcagtagttcttatttctgtttgcttttattatatacttttctagactagataaccttttgggaggcacatttagtaaagatttatacctgacatcataaaattaaaaagtgatttctatttgacagcatgttgctatgatttatttagcatctgaatgtcagctgactatgtcaaaatgaattgtacttgaaaataggtcatgtgtaggacacatgtaggtcacaagaattctcacaacaagggaggttattaatgacaaggggattttcatgtttccctgtttctttgttgaacttctactggtgctgctctttatttggatggagctggactgatttctatataattgcagagtctgctgtgcaactatgtgtaacgggtcccatgtttctgatttataacagtgacgttttagagcttcttacaaattgccatatgggcatctccctttatacttcttggcttttatacgtgagttgctcaattaatatttgaaaaagaaattagtgctattatgcctcttcataaactttagaatcactttggaaatactcaaaatcctgtgagaaactttaattcattaactccataaattttcttggttaaaatacattcctaaattgtctatgaacacctcattgagtttggaaatcaccaagtctaaaagaaaagaaaaatacaatgaaggctttttggtttttatcatgtaagacatataaagttcattttacttctagatattttatgtacttaatgatataacatatattctgtgtctattaggaggttactatttatatgcaagagtcttattgattattcaatgtttatcatttatttttgactccaataattttgggaagatataaagtttaatagaaaagttctttgtctataaaagtcagctggtggagctgagtcccagttcaacaataacctaagttgcattattctaaaatgtgtaaaaggttttaaacataaattatgaggaaaaatgaaaaaagcttcagataaaatattaaatttcctctagggtaagttgtttgctttcatgttctgttgaagtgatgccttttgatggcttagctaaattatgggctttggagtcagaaaagcctggaattaaatccttgctctgccactttctagctgtgtgactttaggcacataacctctataattttcattttcctcagttgtaaagtgggtacaaaaataactacttcacagagttgatgcaaatattaaagctagctaatacatttctgctatgtctgatgctgagcccctaactttcatgttgaaaacatttaaattggtaacatagaacgcaatcactagttgttatggtccaaatatttgtgtctccccaaacttcatatattgaaatcttaaccctcaacaagatggtattaggtggggccttttgggagttgattaggtcaagagtcctgttatggaaatgtaattagtttccttataaaagagacccaaaggagctcattcaccgttccacgatgtgagactacagctagaaagtggcattctatgaaacatgaagtaggccttcaccagacaccgaatctgctggtgccttcattttggactttccagcctccagaactgtgaaaaataaatttttgttgtttataagatactcagtttatgacttttgaagtgagaccttctaaaatattttttctctctgaaaagttgtgagataatatagggaacataaaagaataggatttatacacaaaccagaggagtactttaagagtgaaacaaagatccaaagcacaaaattagcttggcatgcattcaaaatgcaaatttcaggaccctccccacaaatttagtacacaggtgcaagattcgtttctaaagaaacacctcaagtaatgctgacatatactaaagttctgaatctttaaaggaagacataaatgtccctgtaataaaattattatttttgaaaaaagataaagagatacttaaatccatgcattcctttgtgaattgttatggcaacaattcttcatagcaaattgaggaaagtttcctaggcaaaggaatacatttgaaactcaatagcatgcactgaacttttcatttataaagtaatatagcatcatatgcatcattcacaaacattctgaaaatttccatcaaatattaaaatccaaagcagaatcttggttatgtatgaaaaaatttcaacaagtggagcaaaaattgcaaatttattgatcagttaataaatataataaatagtaactgcatatttttccaagtgacactggcattagaaagttatttaaagtatccagagtgctactaagtaatgcttttgcctgctgtatggctatacactcttcctatgtgtgtctccattattttattattataaaattaatacatgcccattaaaaaatctagatttgactggaatgtgctgtaagtcccatatccccaacctcacaattttccttaccctccataagagataattgctaaaagttttgaatatgacaatgatatttttattattaatataaactgtatcttatatttattcttaacgttttcaaaatttaaatagctcataaattgatcaagtgaaaagtgaaaggctgtcatttgcagatgtcttattccatttacctgttggctgtctctgccactgtgcatcttttctcccagtcccttaagaccccaaaatcattgaactcacattaattttgaaacaaatgtgagatcttttggagggtaatttaattaatcatccagctgttcactctgcaagaaattataattagggattgtgttagtctgccagtggcacctaggaaatagaatcaaaagtataagaagatctaagatcctcaaccaaagctgcacattactctaatttggaaagcttgtaaagacataagcatacaggctgggtgcggtggttcacgcctgtaatcctaacaccttgagaggccgaggcgggcagatcatttgaggtcaggagtttgagaccagcctggccaacatggtaaaatcccatctctagtaaaaatgcagaaaaaaaattagccagccatggtgtctggggcccgtaatcccagctacttgggaggctgaggcaggagaattgcttgagcccgggaggtggaggttgcggtgagctgagattgtgccactgcactccagcctgggtgacagagtgagactcggtctaaaaaaacaaaaacaaaaacaaaaagacgtaagcttacacatacacacacccaaagagaaagagagaacaaaatcaatgctcaggctatgagcgctgagagttttaatgtgcagtctaagttcgggaaacattgccctatatcagccatcctaaaagaaattgaaataatcgattttttaggtgaatcatcgggattgccatagaaattgagactgtagtgctctagaggttgggtgggaataagatttggttagtgcaatatagaaaacagctaacctttcttaccaaacctcagtaaaaaattttgaccagtggaacagaatggaaccttctcaggggtctggttatcagagtccaaatatccatggaattaaacaatgttctcctatttatgttctgggaaacactagtctggaaatttgttctgcaaaacaacagcagcaacaatagcaaaaacagaggggagcagttttctggccttatatgtttgagatgcgctaggtaagtgtccctgccatgggttgatacattgcaatttgcacattagcacatgacatgctctgagaggccctgtaattgagacatccgttgaacttttgttttgtttttaagctcagtctttctcaaacatacacattcaacatatattttattgagaaccactttgagctgaacaatgttctaggtgttacggatggaacacaataaacctccctgctttagtagagtttgttttctaggaggataagataaacaggcagataatgatcaaataagagaaatccctcttaaaataaagagaaatacagagaaaatagcaagatatttatggggagtgtcaggtacacaggtactttagagactgtgatcaaaaagggcctgtcttgggggtaatattttagtcaaagcttaaaaggacaagagaggcagggcatgcaaagatctggggaaagaactttcagagcagaatggactgctggtgcgaatccctgagagaactgaacctggcttgttcaaggaggtccagtgtggatagagcataatggaagtggttgctaaagactgtgtttgaataaggagtttagattttgttctaagtggcaaagaaagtgttggggatggcatagtttaatttacctctacaagtgttactgtgtgctcagaggggaagacattgggggtgatggcaaagaacaaaataataataaagaccaggaagaggctgtcagggaagttctggtgaggtgatgctttgttgaactgagtggtcatattgaaataaagagatgccccgattttggatataatttggagatgccatcacagctgtgcctgtgttatgtgagcttgaacatttagtgtatggggtactggtggagtgggggcagaaggtaggggattgattgacaaggagaatcaaattaatttaactataaaacacccaatcttttaaaaatgtactagaaaatgttttggtaaatgatagtaagggaatatttgtgaattagaaagaaaaacaggcagatgatcagataccctgggtattggtgtttctaatgtatttatctttgccttgtgcagtctacatgaggttgatcttatttgttgacccagtcataggcaagggacttatcatgaacctgcaaatgtagttgcatgtccccttattatgaaagaaagaggtggaggagaggagaaggaggaccatgacaaggaaggtgagaaataaaaatgaaatgtaaattattgagaacaacttctgcttcatgctgacttctccacctgtagtcttaacagtgtgctgtgtggaagaaaacaaaagttgcataaatgttgggggctgcagtatgtgggttttacaggtaagctacctattatgtcgatgcatcctgattttatggaagaaacatagctcctggccctaccatgtaatggttgcaatggttgcaaacactggagggatttttttttctttcctttctgacctctaatttccttgtctgcaatttgactgtgctagcttagcatcaattcccaagatttctctagctttcaaattctaaagtccgtaagtttaattacaggtctttccaaattattattgcttccaatttcccttcacaatttgaatgtgtgtatctggcattgtgctgctgaggtttaacaacctgttagctgagtgtagctccaacttgaatgttgcgtggtacttttctttatgttaatgagtaagatgagaaagtgaaagaaccaaaagacatcatagcttaattcattcatcaatgatgtaagcaacttctttgttgactcgaatgattgtttttcaacccttggagaatattttctcaatttttttggtgctattcacaatgttaagtgctacagacatggcacatttttacgtttaatctacactttacagaagcaatttttgttacaggtatcgtggttgaaaactagtttaatggggtggtagaatttaaactctcttaagaaaaaagaaaagttgaagcgacagtaatttctctggatgcagagacatcatgacataactgttaatgtgattttcttatagaaggtagcaccattcatagtaaaatgcagatcacacattgctaatagacattataggtgacaagctgaaatggatgttctccagatacattgatgtgcttctttcccttttcttttagggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagtaagtgtttgtttatccaatacactgacatagatatcaaaagagatgttttaaaagccaaactacaaactgaaatggactttttagctacataaagaggtataaaaaataggaataatttttgtggaaagcttttttgtgcatgcctgtacatgccaatattgactttcatgttcaactttaacattttaattcagagatggaagcacttgatagatggatagatacatatttactgatacatgggaatgtatttcttcaaatagaatattattgactatgttgtaactttcaaatattagaagtttccttcatgagttatatttgatgatatttcatttaggtatcctgagtctaataaaagggacagtgttccatttagtttaaccgtcatgttatgaaaccaaaaaatattttttctttagcctaaaaacaatatcatgcaattcacctttaaatgtgctatgctgtcagtataaattaatagaaaaagagaagacttctgcctgaatataacatgtgtttaaaatactttcacataaaaaagatagaaaccacagatttcacttagtctcctcttaatgaagcattttattatatatattttttgtgaggaagggacctaagagttattgatagtgcacctcaagccacattatcctgttagatacacttttattatagaacagtgggttagttaatatgatttacaattagcagactaacagtgtgaggtttgaagagattcactaatttgctcagagcctcacatatgaaataatctggaagagaacccaggactgctcaattcacgacatcgttttttttttttctctagtaaacatttatttttagctactaaagcttttttcatacatacgctgtcactttgtgatgtaagccaagttaagttctgattcactttctttacataaaagaaaagcaggtgataaagagatcaagtgacttgttgaagttgtctaaactctatccgacagagagatcacattgcatggtttgcgtgggtactctcctgtattttgtgatgttttcagtgtccatctctaccatcaaacatatttgacagacctgattcctccagggcctacagaataatactaataaaagtattaatataatattaatagcaataatagcagtaacactaatagtaatattaatagcattcctttctataactgtagaaatagcaccgtttccttagtgcttattatatgcactattccaagcagtttacgattcctcaaaatagccccgataaatattactgggtaactactccatttacctcttttgaaaatgagaaagctaaagcttagagaggttgacttgctcaagccacacagaaaggaagtggcagagctgggtttgcagccaagtttgccaaactccagaaagcaagcttatattgacatttcctctagttgttgaataacagagatgagtcagtggccaactaacctctcactatctgtccgccttaattgcaggctttcgtggcttcaacaatccagcttagctacaccatgttagttcctcacgtcacaattagtatacctgaataaaatcacgcattaaaaaaatcctacccccaattatgatcctgcaaactagaagttggacagtagtcttatttgtctttggatcgtagagcttagcaaagctcatgccacatgatggacaactagtaaaaccaatttcaaagtgcttcctgtttacagttatattctccacttattcagaacatccaccttgcaaaatacttgtctatcacagtataaaaatagctaacagttattgtgcatgtattttttgtagacattctactaataatttaatcctcaaaaccacccatttattagagagaaaactgggtcttagaaacattaagcaatttgttcagtaccacacccttagtatgcattaaacctaggatataaactcaatattaacaaatttaacattaagagcaacagtttagtgggactgtttatgctgttttgctggctctaaagcaccaggtataatgtccacatggtggtgatagctaaggtacaggttcttttgagttatctgctgctctgtggctaatgataactcaaacctccccctcacctgtcttgatctgcagctctctggaatgttctttttgttgcaacttcatttgctatatttggggtgagcatactgtccatgtatttggtcaatattcttttcacattgacccatggttgaagtagtagtactggaagccagcaggattttaaactcaaacttaaacacatatagtgaaatagtgtggcaggagttaatgacaaatgatggttgtgtaactttaaaccattattaaaggagaaaaagtaataaacttaatggataaacattcttgtagataatcagaaaataaccaaagaatgggttgggcatgagtaccttatgggaatgtatttgatcaaattggcttttatacctcaattacaccatagtcatgctcacattttccacctgttcatagcattggcattgcaatatatttattaaaatgtgatattatatagccatcatttattaaagttaatatgtgtcagagactgtaaagaataagcatcttctgatttgttcctagtaatgtagggaagcaggcacatgaatattgccatttcatgcaggagtcagaggagaaaagcagaattatctactgaataagacatacagcttgctctgggtggcatggcaaagaaatagctaggactactggctttccctgccctcagaaggaagggctgtagttgctatcatcacaagtatcctgttgcaagagtttgtctgcaactcccttaagtagcacagacccaagatcagattggattttccccagacacaaaagactgttctcccgaaatccctattaaaaggaaaagtggtgttggggagtgggtagggtttctttactgaatcacagccacaggacattcatccatgcccaacaaagtaggtttcccctgagcttgaggaaggcctgaaggattgcatgcaactggccatcctcccctgtctgtgcctcctcatctgcaccaaattaacgtgactcaggtgcgcttcgcctgagccattcactcaagtgtagcacacctcgcagactgcttcatctcttctgacatagaagaaggtgaacttaagagaaattggtaacttctgcagaactacacaacccgtgttagatctaggatttaaaatcagctgtctcattttcctaagccagtgcccttgataactatgtgaatcatacatgtattgagcctttaaccatttattggtacttgccaaaaagaactaggtatggggtatagggagatattctaaagtcataaatattttcttaataaagacaggcatgtgcaatgttagaaaaattatatgaactaagtataaaatattgtagaaggagtatagggtgtgagggataaagtgattgataaattgtggttagtataagaaagtttatagcagtagattttgaaacaaagttgcagatattttcacatgggagactgaaaggatggtccaaataggaaaagtgctgtaccccagtcaagcacaggaaagaggattgctggaatgattatttgagtacagtcattcagactgaaattagggctatgggttagagggtgaaatctggaggcagcaactcattagaaggctttcactcttgtttggacaagtgatggtagaaccccaagctagaggaacagcaatcagtaaagggggaggaagggcaaggcgcggtggctcatgcctgtaattccaggactttggaaggtggaggtggggggttacctgaggtcaggagttcgagaccagcctggccaacatggcaaaaccctgtctctacttaaaatacaaaaattagccgggcgtggcagcgcacgcctgtaatcctagctacttgggaggctgagacaggagaatcacttgaacccaggaagtggaggttgcagtgaaccgaaatcatcccactgcacttcagcctgggcagcagagtgagactctgtctcaaaagtaaagggggaggtaagcagattcaaaatattcttaggatattgaatcaagatatcttggtcattgtatgtgagggaacactgagttatcaaatttgctttttttctttcctccgttgatcctttttttttccttcaaatttgaacaactgtctggaaggggctgtcatttactaagatgggaaatgagacaataaatagattgtggaaggaaacaagagataattaatcctgtttttgacacattgagttcaagggcctttgatatatggaagattggaactccaagccctctgagttgaagacgtagaattaaaacctatataaatatcattattgttagtaaatcataaagtattctacttattgtactacagttaataacaaatgcgtgaagtgctatgtttgatcgactactcatgtcttgaaaaatgggaatgcatttccgtcataataaaagcagctcctttgtactattttttaggtggaataaatatttttatgccaggctccccttgtgcctaatacatgtttgctgaagtcatagatgcaagcctatcctgtgattattacaggaaaatggctattgtgaaaaccacacataaattgccgtttaccccaacaagttagggcagtaacttgttatgaaggaacatcaagtgaatggaaaatccatatcaaagagcatgttctacttttatgtcagtaaacttgaagttgtttcctgagtaatgagagaagtagaggctaaattttatgggatcaaagagaaactataaatttccaatatcttggccatagcagcagtgatcctgtttgcagatctggagaagaaatgtatagaagtaaattactggtgggagaaagaaagaaaaagaaaagaaaatgtttgatgctacagaaacaatactacatgtctgaaagagaagtaaacaatggtgaacaaaggaaaataaatgggtgaaagtgaatatatctgcaatgtccttaggaagcagcaattaaaccataggagataatgttctttaattgtggatgaattgctgaggcagttgtccttagtgtaaattctaatttccttttctctagttactgtataaacatcctcattttgcagcctatgatcatctcttcctcatccccaacagaataagaacatccaactgtcaagccatactcaactaatttgtttctttggctagccatgattttatgatttttctagccttagggtttctgcatgatgcctagggcaatcaccacgtacccaccagccttcatttctctatttggataactctcttactcattcttcttttctcagcatagaaatctctgcttctgacaacttctctaataccccacattcaaatctgggaatgtttccacccacttgtagaacagcttttcttctcccaatcatgacatgcccacgttatactgggttgcaaccagacattctttttttgttattagtcttctggataaagactaataacaacaatgaagaatgaatgaatgggggcaagcttagtaagcctcaggaatgctttctccatcattctagtgttcaacttgttaaagatcaggaataaaggttagcctaccaggagaactgagggagaagattggacatgatgagcaaatgtacagatgtgttaaaccattgtgtttaattgcttcaatgcagacagttgaagagaaaattatggatcatatttaataaattaaacatcaatcattttaaaacatattaacttgcacataataggaatgtatactttattatttaaaaaaattccaatttttttacataataaactataaagttggaattataaccatcagcagatttaagtttagaaaacatataaagaggacaatttaaaaagtactgtaaaagcacagacatttacctgggtgaggaaaacaaaacattgaaagacagctagataatagtctctgtctattcaggatgctaatctctcataccacctgtctggttagggggaagaatgaaaagcaataaattggttagatttattaaaatgatagttataattgagttcaatacctatttattgagcaactcccacatgctaactgctaaaagctggagtaaggtgaattagatagttcttacactcagattatctatcagctaatatagtagctgagaaatactgttttatgtcaaagtttgaaaagaagatagactctgattggcctaaaatcaaagagtataaattctctaattctttgcaaaatttataattttaagtttgatgacaagtggagtgtattagggttctctagaaagacagaactaatatatatatgtgtgtgtgtgttctgtatatatatgcacacacacatatatagaaatttatatatacaaagggatatatatctaataagatacatttgtataattaaaatatatatatttataaatatatatactagaaatattgaaatatcgaatatatataaaggggagtttattaagtattattaagtagtttactgagtattaagtattatcgttaagtagttattaaggtctctccaaataagattatgacacaaagccacaaagctggagagtttgatatacccctgaggtaggacagtaaaggtatattgctggcattgccagctgaaagcaaattgtttctggtgagccttatggacaggaatggagaaaaaggcatttgccaagtcaatggctgcacaccaggtaccaggagatgtgttaattggagcaggcaatgaaaccacatctagtacaacagctgcaattgcaatcaccacttgattaagcttacaataatccgctgtcattttccaagatccatctgtcttctgcagaggccaaatgggagagttgaatggggatgtggtgggaatcaccacccctgcatctttcaagtctttgatgttggcactaatctctgcagcccctccagggatgtgatattgtttttcatttactatttttcttggtagaggcagctctaagggcttccatttggcctttcccaccataatagccctcaacctcccagccaggaagccaatgtggaggttccgccagctgctaagtatgtctgtgccaattatgcatcctggcactggggaaatgaccacaggatgagtctggggacgcactggacctactataagtcacacttgagctagaactccattaatcacctgacctccataagcccctactttaactggagcaccacaatgatgttttaggtcccctaaaatcagcgtcaactcagagacagtgtccagtggtccctgaagtgcctgattattttcctttccccagtgcacagttaccctggtaaaaggctgaatgtctcctcggggaaggataggagaaagattaacagcatacattgtcagtagggtagtagggtccttcctcaaagggacctggcctccccttcattcaaggggttctgggtctgtaaactggctcaagtctggaagttgactgaagggctgtgattctctgtttttataattcaaatgagtcttttgtcaattcaacctagaagttttctacttatataaattaagcaggagtgcagtaggcttcctatcagttttacttctaggaacactgtgattaattagccaatgccagagctctatacaagtcagactattgtgattgctgttttgcctctgctgtccattacagtagctacgcctgccttgcctttgatgtttgagtgccaccacttggttcctgccacctcaggatccagttattcccattttatttaaattttgtcgttgagtgactgtggttcccactgttagatctgacatacagggaagagcaattgtagggctcttcaaagatgcagatgctgccctcacaaatctgttttgcaaggtgttggtcaagggtatatcttctggaccctcccagctgggatgagtaggtctaaagtgactaatctactccaccatccccatctccctaagcctttggattcctttctctacattaacccaagggacatcaggcttccagctcgctcacagtgggccatcttttaatccttatttcagctaactaagcaaataagctgttagaaccttttttaaaactccctaagctgcaacgttaaatgcagaatacctacttagtgggctgaaatcaataaattcagcctgatctaattctatgtttcttccaccattatcccacacccttaatatccattcccatccctgttctccagatttctcttcatataaattagaaaactcaagaagttcttttcaagtgtagtgcacctcctcatgggtcacactctgaatgtcacctctaggggcccgccaggactttagtctagttataggtatagaacaaacaggggtgttggggttggttcctcaggagaatcaacattatctctcctggcaactgcctcaggggaggccatcactgttgtctcaggcagcgcagggtttatctcctcagacaaaggtggaaagaatgatggcagtgtgggtcagggaggggatgatgccgctactggggatgggaaagctgtttcttctggcaagaaaggttcatcagagtttacaaggtcagtgtccccagcttcatcagggtcctcccgcacatccccattccaagttgcaaggttccattcttttccaatcaatgccttcattttaacagtagacatggcaaggctgtgcatccacctttccttgcagttcagccactcacatgataagagctcatgtctgattttccacaatttcagctttctctaaaggagataagactctgactcgggtcagtcttagaagatttgagacccactatctgcttctgaagccaggagacagaatccctgagttcatcattttctttcatcactttgtccagtgaactgaggagcaaccaaccagcttcattatgttccttggttctccacatatggtcaaaggtattatgtatagagtcactaaactccttacctctcacaagtggtaaatcaggagtgtccaatgcattaattttgcctaactctctaaacagttcatgccaaggactatcagtgttctccatactattagaagtagagtccttagcatttttgggtctaatcatattaagcagccaactccagaaaccccaaaacagctaaagaactccatccttaatattctgttcctgtagaaccactcctggtaccaaaatctgtattagtcagtattaatctgactaatacagaatatctatctatctatctatctatctgtctatctaggagtttattaaggagtattaattcacatgatcacaaggtcctacaataggccatctgcaagctgaggagcaaggaagctagtccacgtttcaaagctgaagaacttggagtctgatgtttgagggcaggaagcatccagcatgggaggaagatgtaggcggggaggctaagccagtccagcgttttcgtgtttttctgcctgctttatatttgctggcagctgattagttggtgcccacccagattaagggtgggtctgccttccccagcccactgactgaaatgttaatctcctttggcaacaccctcacagacacacccaggatcaatactttgcatacttcagtccaatcaagttgagactcagtattaatcattacatggagttatattaaaattaaaataagattagctattaagatactagaaaataaggaaactatgaaaacctatcagggtcatggcaaaagaattcagcatcagttgaagaggctctcactgaccaaaagtgaaaatgttttagtatcaaaaaggatagtaactgctaagttttgcaacaaattaagtatgtttgaatgaatgggttcatgataataataattgaaaaagccccattgatcacctatgagagacataaagacccaactccttattttgaaaactaatgaacgaatagaggaaacacgaaccatatcttaattttcctatgtaacttgaacctccaggtaaccagatagaagagaggagtatctctttaattaaatattttaggtaataaataaaaatgaataatagaattagaaaatgtctatttggcagcactaaataaatgactggttcaagctaactatgacggttcacaacaagggagaagatcagtttttcagtatcagtcatggcgttgtagcttttattggactaagctgctgtccataaaattataagtgttaaataaaatatattttaaaagcctgcttcagagttctgaagtttaaggtattaataaaatgaaagaaactggagcagaattgattcttggaataagggaagtaaactttgggaaatccacatttatcttgcttttaccaaaggaccagcagaaaatagctagattttactaggaagtggggacagaggtcagatttcaagttgccagagaggctagaaattgagtagggaatatttagaagaagatcagagagcaagggtccgtgctcctgcagacacatttccctcagatccttggccaattcttgtaactcacatgctcaaggtgaaatgccaagcagccctagagaaagcacgagaaagaggtttaaaagtctaaagatttcagtatctacgtagggctggaaggggaccacctttggagttcaagtcctgccaatttagaggaatttgttaaacaccttggagttttactgaaatgccacaaggtaatctgtcacaggaatagagatgttttttaaaaagggaagaaagaaatcccacaagagtattgccttgggagtaaagactgtacctgaggacatattgttatatcctagagctaaggacaaaaccaaaatagacttatccaacaaaacttgaaactaaggcttcacagggtctaggtgatcagccagtaattcacctccctgtggaccactgccatttacttcccgccagtgccatccagctcgccactgtctctcctacactcctaacaggcctcatccctcccatacccacactctcccttttcccacttcctccttctttcctggccgctgctgacacatagggttacctactcagcttaaatagcacttccttagagatattgtttctgaacaccaaacaaatttaaatctccgtgttcaaaactctcctgtaaccctgtcctttcattccatgctttggaacttgtacatttgtctgtacatgtgtacatttgtacaattacaacttgtaaatatgtacaattacatatctttactactttactatatttttaaatagaccaattgtaattgtacatatttaccaacttgtaaatgtacatatttacattataatgtgtaatatgtctgtacacacaggaggatttgcctgctctcttccttcgggatggagcatccttgaggccaggtgtgttcactgtagcaacagcagctcccaccgtagcacttgacacagcattcaataactattggttaaatggctgaattaaaaaaaatctgattatccatgatgtaaattgtatcataaatacataaaaatcacaaatgtattacattcatacagcagtagttgatcaaaagagagataactttgagataaacgtgatttcaagtgttgttattattaaaatcataacagtatacaaaataatgttgaggcattttgatatttccatttgatccctctagcatctttgtgtagtatgagaggctggaatttttcagtacatagccaaataaggaaactgagaatcaacatttaggtgacttctgtgacattgcaaaagttgcaaatgaatattagagccaaaaatgcaacttacatcctccggtgatgcattcaagtgtccttgacatagtggatattactaatttcaaatctgtttaaaagattaatttacattgacaaaaattaagtgagaatgatcatgttttttcccataacctgctggtgtgttgttactgaccttaacttggtctatttaaaaagataataagggcaccttttccctgtggttatatatagcacttgatctctgtgccttcttcctttttattgtattaattttagttgttttaaacttaagagtccttaaatcattctgtgttctgttatgctaccatgcaaaaatagtataatctatttcctgttgatttcttgagtacttggtctctcttctccattgctttaaaaaaccagttcagtaatgcaggtctcaagtgcctatctatcatgctgctactttaatatttcactatataatagttaaacagcgactcagtctgatttgtgtttcttagaagtcaaaattggacctctgtttgtttagtaattcatgggcaataactttcaaataaataaacagtatgatcagtgtttaaggctgacttcatttttaactaagaagagtttggtctatacccctttccagttgatgaaatagctatatattttttttctctgatctttgacaggaacattctagttctatttacattttggggagattcctaaagaattaataaaagactctagtgtctttttcaatcactctttcatgaccttcaaatacagttaattttctattatttaaaaattgattttctaatttacacattttctattccaatttttctcttttaagtttttagtcatctgacctcagcaaaaattccatgattcatagtttcactcacagaatcaatttatcccgaaaacatcttcaagggacaaatctctaccacctccacaattatcggcaagtaccacccacagtataaataaataaaacattcatttccatggtacaattcatttccaggtacaattcaatatgcaatggggttatttattttcagagaataggtttatggaacctacttgttcttcctatcaaacaaccctcatgctgccatctgcctcagaatcatttagggacctgtattcctgttccaggttagaattccagagattctaatttggtgaacattaggccaagcccaggaagtagaatgttgaatgtttatggagatcccaagggattcttttccattggttccaatataactggaccatagagctcagttcatggtcttgaatatttttcttagtaattcacttgggggtgaggaggacattgctttttcaagtgacaacccctcaaaatttgagaagcctcaaacttctggagaagggctaggatgcaggggtggggagaagataccaggaaaactggaatatattgccatgaggggtgtgtgtgtatgtgaaatatgcagtggtagaaaaagtttgctgctcaagaaggtaaagcgtttttacaatttagttgagacccttcttagaggctacagcggatcaactccctctcctgcatgtcttagaaatcattcaatacccagccgtgatacaaaagcggaactctgaagacaggcatgaataattgcatctcagggttgtgtgtcttccccaattgactataagctctttcaaaaaaacaaaaagtgttctttgtttttatgcatcactgtgtcttccacggtattcacagaaagctctccataaatacatgctgcaggaaaaaaggcagaagacacatttcaagaatactacatctgacacaactccctgaaagatatttgaatattttctattgcaaagctcttaattccatggcagattgtatttctgaattgtgtaaataaagcaagctatacctacgggcacagggagaattgatatgagagtagggcgtacaatctttttgagtctcttctttcctcgattcttgctgtaaatgtgaagatttgagatggaggtattcactgagggggaatcaggtcaccagcaattgctgtggtaagtcagcttgggtaggagctgacagacacagaaaaagccacagaacccacagatggcttgaaatcatccttgctgcataacctggcaatgacattgataattaagggtttcttatgtacttcagcaattcattattatttaaagagtcacaaatacaccaaatgtacttattaaactattttttgctatgcaccttttcctgcccaatattctaacaataaatcctagtgctagcattagtagttaatattcatttattgctaattgtgtgtcagcttctaaaaactaggcagataagcatgcatacaacaatcctaagaagactatactattattctcattttacaaatgagacaacagggacaaagaggttaagtaactcactgtgataaagaggataatacctccctaatatcttagtccctgaaacctgtaaatatgttgtgttaccatggcaaaagcgctttgcagatgtcattaacttagggatcttacaatggggagattattttggtttatccaggcggacctgatgtaatcacaagggtccttataaaagggaagtaggaggcagggagggagagagggaaagaaaggaagatttgaagatgctgtgacactggtcacatgaaggaagaggccacgagccaagtggtctctaaaaggtagaaaagacaaagaaatgaattattttttagagactttagaaggaaaaagctcctgccaacaccttgattttaggacttctgaattccagaattgtaagataataaatttgtgatatattaagagactatgtttgtggttatttgttttacaacaataataggaagctgtctgaatccttttatgttgctataacagaatatctgaggctgggtaatttattaaaaatagaggtttatttagcttatggttctgcaggctgggaagttcaagaagcatggtgctaacatctgctgggcttctggtgagggcttttgcagggtcaaaacagtggagaaggtcaaaagggatgtggaaaagtgcaaaaaggcaaaacctgaggggtgtcttgctttatagcaacacactcttgcaagaacaaatccattctcatgagaactaatcagtctcatgagagaagggattcactcactaccctgagaacagccacaaaccattcataagggatctgcctcatggttcaaaccctttccactgggccacaactcccagcactgccacactggggaacaaatttcaatatgagttttggtggagacaaaccacatccataccatggcagaaaataatatacttgctcaagtttgagtgagtattcaaaccagcacagactagttgccttaactactatgccaacatgaaatatatattattagaaatggctgaaaagggggctagactaaaaagcggggaatttgtcagaacaatttgcaactgtggtcagagaactagagttcataccctgcccatagtgagccagtgtatgacagagccacattattaatctcgataataacccaatcatttaaaatatagaatgtaaaatatgtataatatatacttaaatatataaaacctcagttaataagcatactaatgaacaaattcacagttagaaaaataattcttattcttcctttcagttaagcaaaaagtctcctcttacatctttagactgtaggccttttactgttacaaattttgttaacttcagatttcacatttttcctatggtcaattttataatacttctacttttcctatttatacaattcaactatgtacaaaagattgtcttcccagcctgggcaacatggagaaactccatttctgccaaaaatacaaaaaattagctggacatggtggcaaattcctgtagtctcaactacttggaaggctgaggctgaggttggaggttcacttgagcctcggaggtcagggctgcagtgagctgagattatgccattgcactccagcctaggtgacagagggagaccctgtccaaaaaaaatattttcccaaaggtatttacaaaagataggagtaagtatgatattgactgttaatttaaatattaattttattttggatgcttaatttagtgtttctaaaataaatattgatttgtactaattttagcaattctatttactcatatctttcatagattagtacaatacaaagacatattgctatgaatcaccctgaaattttttatttttgtatctgtttgcattgctgttgcttttttaagagctcaaatatctgagaatctttgtggaatagtgaaaataaattctggtgatggctaagatttgatatgttgctttcttggtcattgatgtgaaatccaaacgtatgttttcagttcgcaatgttaaagtaaattttcaaaacataaaaacataacttccattcaaatacagaatatacatgtatcaaagaagtatttgattcattaatgaaggaatcagaaggatggtaaaactagtttcaaagaaaattcaagagattgagtgtatatataggaatccaggaaagcatgttagaataatattactaggtagatacgcaagaagttaatattcaacaggacaataaacccataacctttggagatatagtttctaccagacagaagcaatttgcatctctactgagcaaaaatctacagattatgtttaactttatagaatctggccttaattattattcattcagtaataaatagtaaaatcagaatttattaattcacctagaattaaataatctttacctgttagaagatgttctacaatgacattgagaagatgtgaagttatttctttgctttatttatttccacttttttttctaatttttcttaacagtggtaagatcactttcaagagaatctatactcctgtctctgtcaccagcatttttggacagctgagtactgtccaaaatatatagaattgaaatgctccttctctctctcaaaagattaattttttcaggtttttatatgattaactttatgccacataactcagaattttgtaattgtttaagatgatttttaaagtatatcaaatgggtgcaaataactttttataaaaattgcttataaaaagtgacctacaatgagtgttatatctaaaataatactgttaaaaatcatccagaattttttttcatttcctgagagtctgtttctatatattaaatgtgtatcctttgaagttttcctgtactgataatgtactcgcattgtgaattatactgaactttttttctctgaagggtattgtttacctgcatgggaaatctgtgatgcgactgtagccagtttgttgatttccgtctttctgtactttgttcctttcaggtcccctttttcaaggtgagccaacctcactcctactctgagtactaaattatttcctgtcactgtagtttctcagcaatcctcagagctctctcttatgacagtgaatgggacagtgctgggaaaatgtctaggcctcttgaaattaagtgttccaagagtaatcctagtttatggggacaagttataggacttgaagactgtagagggtggcaagattactgattaagatctccctttgcctcctgtttctagacctgagaactgagagagccctttatcaactaccttaagtgactccagccttctgttactcttgatcagaatgcctgttacaacctgtaatgcttttatgaacttagttgtttacttgctaaatattgtctgtcttcactaaatggaaacaccatgaggacaggggccatatttatgttgaattttttttaaatcccagaatctggcacactgattcaaacgtgatgggtcaaataaagttttattgaatgaattcatagaattgcattgtcgtgtacctgtgaagcaaggagacagtaagaatgacagaaaatgacaagtggccttggtttaagagtatgcaattgctttaggcattaatggttttatatgtttttctctatgccattttgctgattgaaatattccaggcacaaaagctttaggtgccacagaagatacatatcatcattataatgtaataataacagcagcgaaaaagaaaaaaaaagtactagtagctaaagtaacacaagctaaacctttaatgggaaaaattctcttggtagctaatttcaaaaatagtctttacctaaaatgaaatcattactgtcatagttgcctttaagtgatacattaactcggagataactgcattgctccaaatgtgtcagcatttaaagtctgtcttactggaatttttcttaatttattgtaatctaataatcataggatgcattatttgtatttgacacagttgtatttttcccatgcgcattcattcagctatgtaacgaggaaggattgttaggctaacattattctttctacagaatgcagtatttattcatgtgcacttggtgaatgaattctctataagcacattagcaaaatgtgaaaaaaataaaacctctgagtcttcaaaagatggctgcataaaatagttgaaaaaaatttgcagggtggtgtgtatagacatttcacataaaatatgatggataatctgaatcaaatgcatatttgggcttacaagtagctataataactttgtcacatcaaacaagatgagtaaactggaatgtcatttcgttgactggaagaagccagcttaccagttgaaaaatcgcttcatattttattgtattttttgagcctcttcatttattacataagtgcactctcaagggtaattgccttaaaaaaatctttgacttgtgaaatgtagacaataccgtcaggatttccaagtgttatgagttctttttaatgtctcttgttcaggtgcaactgattttgacagatgtattgttaggttactggtataacatgacatcttttttcagatgaaatgagtaagagtgattttgacaataagtagataagacagtcagaaagttgaaaaaaacatgtcaatgtcacagttatgccacaaatactacagaacagaccttacaatatcattaagtcagggtctttccaacaatgtccttgagaagacagaaaatagtattgcccttaaatactaccacttagccacagacggaaaataagacaaaacacaaagatcagtttaatgtgtactcaaggcggcatttgatgagtctatgctatgtgtgtatatttgtgtatagacctcgttaacatactgtatggatgaaagaattttgagatatcaaaaccactttttctggagccaaaaaagcatttaactttagaattccaagaactccattaaaaaacattgattgtgaaatatgcaaagtgatttaatgtatattaattataactttgttgaatggaataagaagaaatagcctttaataatatgagaaaaaggccaggcacagtggctcacgcctttaatcgcagcactttgggtggctgaggtaggcagatcgcctaaacccaggaattcgagaccagcctgggcaacataatgaggacttcatctccataaaaaataaacaaaattagctgagcatggtagtgcacccttgtggttccacttactcaggaggttgaggtgggagggtcgcttgagcctcagaggtcaaggctgcagtgagccaagatagtgtgagtaccactgcattccagcctgggtgacaaagaagaccctgcctgaaaaattatatatatgaaattatgtatatatatatatgaaattatatatatatatgagaaatttaggaatacatttaaaaatgtatttctagatcatgaattttgtaaacaggttagtaaagactaaaatgaaatcaaccccatgtgtcaatagggaattagatgtttggtggtcatattttcccttactattgactggtcagaagctggactacacagacagtccctgacttacagagattcaacttacagttttttgactttacagtggtgtagagacaatatgcattcagtagaaaccatgcctcaagtacctatccagccatgctgtctttcactttcagtgcagtattcaataaattacatgagatattcaacactttattataaaatggtttttgtgttagatgattttgttcaacaataagctaatgtaagtgttctgagcatgtttaaggtaggctaggctaaactatgaggtttggtgggttacatgtattagatgcattttcaactaacaatatttttaacttaagatgggtttatcaggatataactccatcattagttgaggagcatctgtatatgcatgtgtatgagtacgtatactgccttttctcaatatataatgcatttaaaatgatttaatggaaaagatatttatccttagaatgccttctactatctttgtttctaggatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtaaaactattcggtgaagtgctcaaaaatctgattatttagatatcacctaagtcactttatgcttttatagcttatcttttagcagtcagagtgccttattttcagattcaagggcttgtacatatgtcaatattgctctttcatgtaaaaatggttcatattttgcaaattgcacaaaatcttcagtgtttttttacatagtgctgatagaaccatatagctattttctaacatcataaaggaagggatgggtcattgaaaaatgttgaggtagtaaaaataatgaggttgtggcaaagataaaatttacatagaaaatgagcgtgcaatcagtaataatgacaaaaagaattaacaacggaggaaattacaacaaggttgagatattattatattgaaacttcggggaaatgcatcctagtatttgaaacggaatgcgtagaaggagattgcaattattatgaaagatggtggtccacagaagggaaccttttttttttttctttagactggcaataatggtgctgttatttttctcctcttctaaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgaggtgtgatggttatgtttcaattaatgctgattttattatgtatatgtggtttaatctcccagaggaaaatacactataaagagcccaccttttcagtaaatcatagaacaggtgaagcatttcccaaggcagtctaactcacagtggcagctttcggtgtatagtacttgaaccttcatctttctcacagtatgtaaatttattgttatagagggagatgatcttttttacctaaaatatgtagtcacagaacatcatatgcaggaaatcttctgcaccaaaaaaatcttattaccacaagcaaatataggatgtttgctatgacttctttgtgttctagggtatttgtgagcagtatagatttataaggagaatgtaccaacaaattgattaattaattcattagcaatggattcaaatgctcaaatatcaatatgtgctagaagcgtatctaaaataaaatattataattggttatagtattaaacagatcaagttttaccatgttataaagatgtatttttcatcgaccagtgaatatcaaagccagatgtgatcagcaacttgtaaaaataaagttctagtgtaaataaaagctaaatgcacataaatttgttttaaatctatatcttaatttttgtgtgtgtagggttatgaaaaattgatctgtgtgtgatgattatagctatacttgctaatcataattaagcagatttttagaaaatcactaaacaatattattgatgccatttttctttctaagatcagctttggagggattccagcacctggaaaatcagtgtcattcccacatagaaattttcatggatgtttagaaaatctctattataatggagtggatatcattgatttggccaagcagcaaaaaccacagatcattgctatggtgagagtctttatgcgaagacattagtaaaactatatttcttttttccacacagtaaaattcctccattttaggttcccatttgacatggggttttagaggtactcttatttaaatatttttctttgattggcaatatgcatataaaagattggttctatctgaaggaattataattttgggggcataattattttatttttatatgaagtaaagcagtgtttttatggttgatattttaattttattgtgatgtcattactcacaggagcctaatttcttttaatctgtattttttttttcttttttgagatgaagtctcactctgtcacccaggctggggtgcagtggcataatctcggctcactgcagcctccgcctcccagattcaagcgattctcctacctcagcctcctgagtagctgggacttgtagtcctgccaacacacctggctaattttttgtatattttgtagagacaaggttttgccatgttagccaggctgatcttgaactcctgaccttgggtgatccgcctgcctcagcctcccaaagtgctgggattacaggcatgagccactatgcccagcctgctctgtgattttttaaataagatattccctgacaaacttaccagatgagcataaagagtttctggaatcagataacaaccatgtatattagggagacatttgaaaaacttgtattttgccatagtcattcatgataaataaaagagacgaacagacaacagcatgtaagaaacatcacatgtaggaaatctgcaccaagagatcttactaccgcaagcaaatacaggttgtgttacaatattgcatcggccaatctgtccaaatggcaatgttggtcagactgcattacattctaattctgtggaaacggggacaatttaaatatagctgtcttggttaggtttcagttagggaagcagcaccaatgctaggtattgtgaacagtggatctatattaggacttggacctcagcaattttcagaggaactaaaaaatgaatggcctggcaggggaagtgcgaggatcagagaagtcattaattctgcccaaagcagtgatgtgtggaggcatgttggaacttacagacattttcagcctaggagggttgaagagaactttggcagttgttgcctgtgggtagccaccacccctgtgtgtccccagccatgcatccagcgatgggcctgggcttgctgtcggtcggttgggccagctgtcaggaagaagagatgggccatagtgcaggagagcaaggacagactggaacaaaccagccgctgtgtgaccacccctcatcgcacatgattagaaaaacaaccttaggggcaaaatgtgttgctggtgttttaattctaactatcaagtatcacccaagctctcttttttggcttttactcagaagcagacaagtaaggggatcctgggaaacatggtttctagctttaccagtttgataataaaatacaggcacatattgatttgaataaatttctttcattgcttaaaatccaaagtgggtaaatttaagctcatgtgtcagcaaatcccaaagcacatcacaagtgtatttattgtttaaacagcattttatttctaattatgtgaattggtggtatttatatgaccacaacagccagcaagattttaaaatagtatttttaataaaagcaaaattatttaaaataaaaataaaaatattttagatagatgtgtgtgtgtgtgtgtgtgtgtgtgtgtgtgtgtattttatccataaaatgagtttctagaaactgcaaggaccattcactcttcattggcaagaggatttgctgctggtaagctatcatgcagctatccaaatgatgcataagatcaagctgcaggttaatgggtacaaaaatatgattagaaagaagaggggcaataaattctagttttcaatagcacagtagggcgactatagttaataaggatttatagtatatttcaaaatagctacaagataagttttgtaatgttctcaacacaaagaaaagataaatgtttgaaatgatggacatcccaattatcccgatttgctcattacgtattatatatatgtatcaaaatatcacatgtgcctcataaatatatacaactattatgtatcactaagaaaaaagaccaagctgcagctggtaaaaatgtttttttttttttccctaggtttgatagtcttaaaattgcctttacacatatgggttagtgtagtttgctgttcagcttttgttatttcattcattggaacaatgtatttgtttataataaaagtgaattcacttttcacagattcataatagagccaaatgttttcgtttgaccaagaccaaatgttttattccaatgtgtattcttctaaataagcttgacttcattgacttttaaatttatattaaagttgagaaatggagagaagagcagagcaaagggttgaagaacctttaagaaatatggcagtggtttggactgtcatgttgatagcaggcagttgttttaaatcgcggataatgtgagattgaaaagcagccttcaaattctgttactaatgtgatgtgaataacattctgaaagctttttcttttactttattctcagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtaataaatgtattccctggggcaaagcatatggatttgaaagatttcattatctctgtggccaaattttatgcataaccaaaaatgtaatatttgcttaataaatgaatactcaggttaataagattataagtactcttccttagaggaacttgattccaattttcttttaaatatggttccaacactagcagttcttattaaccaaaatgatagttttggggaactgaagtttcctttcacgaccctgtctcccactccagacaaagaacatatcctaaggtgatgtgttttggggaaaacatgaagaccttgaaataggccaacaagttaactaagtgttcttcaatggaaaactagactcttcctaacacacttgttagtcttatctggtctgtgagaaaaagggagaggtctttctgggatctatatctatatctctgtatgagtgtacagtgtgaatggtaactttatttgctgatgtcttatgtaaagagttgaatacattttgaggggatgcaaagatttatgcaagattcctcagttgtcaccaaatgaaattctctctacttctaggcaatacggtattgttttaatgattagaagtaatgtacttgaggtgactatatgagtatctggataatgaatgtctaatttaggccagtgcgttgagtgagggatgtttttgtctcttcattaaaattataaagttcttgacaaaagctctacatcacatttttacgtatgtacaatggcatccaagccaagcaactagaggttgccttggggtaaattactacattaatttaataaataatctttaaaaacaacttaaagattccattgtactactcctctatattaagtatgaccaaaaaatagtggaatgtaacttggagaggagaaaaaaatgagaagttaaaatacagttgaaaattaaatacgagaaaacaagtatacaaatggatatacaaatgcctattatttatatgtctttttgttgctgtactactattgtagtttaaatacggaaccgagaattcgatattagttataatttttaaagagatactatgctgtgactttttatttagtgttcaaaatgtggtagatttgctggctagacaaaaagaaataaattaatgagtctcatattaataattaataggccctgaaaatgaaggtctaaaaatgtaagcttgccattagtgtgtcatttattgtgatgtatctgacatcttctgaagtggttatattcataccctaattttcagcatcttaaagaaaccgcttcagtgcaacgttactttggggagctccatgaagtcagcctatttctttcttttttttttttttttttctgagatggagttttgctcttgttgcccaggctggagtgttatggtgcaatctcagctcaccgcaacctccgcctcccgggttcaagtgattctcctgcctcagcctcccaagtaactgggattacaggcatgtgccaccacacccagctaatttggtattttttagttgagacagggtttctccatgttgatcaggctgaagccagtccatttctaaccgctttacaagcatgtatagttaatatattactaggtataagtctcatagaataccctgagggatttaaaaatttctaaatgaatgtttaaattcatgtataatataatctgttatgacatcatctgacttggtatgattattttcatactaatcataaggatactagactaaatatgaatgtcagtacactgaggataacacaagtaggattttatttaaaaactctctctactcttttttttccgtttctttcacaatattattttttgctagttcccgtgaagcaagtacattttgcatttgaaaatagactatttaaatggtagttgggtgggaggtcagcttgttctcccaaggggaagactttccatttatgttttatgtatgcgacacttgataattaaaccagttgtcaggatgtattataatgactttcaagagaaccatgtctttattgatggattgctatcacattgtactaaatcttttcattatataaggatggattaatttttctcagctactggagatatattttacaaatcttatatgtttgaaaaactcaacattttaatatattttataatgaaattaagattaaattgtattgagaaagaactgaattgtgcaaatgcttgaattatcagactaaatttttaatatgatgtacagttttgcaaattgtcatttggaattattcaaaaatattatgtcagcttaaatcatttttgaaatattcaacacattatattagtataaatcatgaaacatattagcatcactataaaatcccttatgacacaaaatatttttagtcgttgccacctttataaatgtcaaagcaaaaatcaatgagcagtacagttttatgttcccatttaaaacaaagtttttgatatcaaatttgagatttctgctatgattttagcatttctgctgctgtttttgcgtaacagtgaaaatcaggcttataaccatgcctcttgtccccatgggcagggcctggcagaggcaggcttgcagtatttgagatgtttctgcatttttctattactaagcattctcaattcttgtgcctctgacaatggagcagcccccttgatttgctgcacccaggagagccatttttgtcaatccaccttcctccctttcactgttgaaatattcctaactttcgggctgtaaacctgtcaccctttaaacttctgctctccaccaaagtgatgggtaccaaccacctccatattttcatcttgacaagagctatctggtaatctgaatccttaattctggttagtgactacggttagtggatataagaatgtctggcacttcagtgcgctgaaatacgcttggaaagaggcaacaccctttggtttttccctgaggaatggcctaggtataattgccttttgcacctttgctgaactcctaccctatatggcaggctaattttttttcttatacattgtgcactacagatatgtgttgtagtcttatgagagggtgatgacaactaagctctcatgtttctgatgcaatttaggactggaactagaagacgatctgtagaatggaagtagacgtaaatcttttttctcctgctgtattttgtatgtttatgtggtttaggctggaagacagaacaaagagagcaacagaaagggaaagagagagagaacgttctaggccataatctcatggtctccaacgtgtaattgcaaacacttccatctactattccatccttccattattccaattggcattgtcaatgttttccatccaaagactgcaattaacatatctggagttaaacaagttgaatttattgcttattgcaacacagagaacacaccctggaaaccaacggttgtctgaagacaaagttgttagaatggcataggatttggggttgtgttagctgatttgagggaggtttcaaggaagtgaaaaattgctgtagactaaatgctgtcacgaagtgagggtaattctatgattaaatatctttgtaaaccttatctagaaggatgaaataacgaagtaaggctaaagttgtaattggtaaatacagaacaaaacagttggtcattcataagtatcaggagagaaagaagtttgtgtttttgaggtttgtacaatagccttgcttctgtctgtgtttagacaagtttataagtagtcatgatttttccccaccttcatttcattatagtcacagaatggccttgtctgatgttggtgttctgtgttattgttgatgttcaacagaagaacaccaaagcccagccctcagtgccagccagattcttacaacaccaaggtctcactggtggtaccaggctgtgtcctagctgttgcggcctatttttcttagagttaattgtttaatatgagcaaaaaataaataaaataaaataaagtaaggcagacacctgtcttgcagacagggaagagtgtaggttttggagtcagtcttggttttctgttttccttcagctatccagcagctggatgtgacctcggtagtttcttttcctctctgagcctcattttctccgtatttaaggtgagaatgataagttatagtgaagattaaatgatactatgcatagaaagctcccagtatttgttataagtaatacctcaataaaattactattttattattatgacaacatgttcctccccagacttaaaagttatgagtggtgggactgggtgcatagaattttcatttacttacacaatatcagaaacaagaaaacaaattcaaattctatgatttctccttctccttcctgtttcacagtggtgcggcccttgaaaagggccaacctattatcagacctagtaacggaaaggagttgtatagctacaaaacaattagaatctaatttaaaattaggtagagttagttgaaatgagttaaagggacattttgtgatttgagtaataaattccaattgacaggtattaagtctcctcatcataggcaaataatgtttgttacaaaggaggcttgggaaaagctttctgaaggttcccccacaaacatggcacaacttcattctattcacaacctgtaacctgctagcttgttagatgaatgtgtttaaatgtgtgccaaattacagagtgggttactctggcagtcttttgttcctgatctattttttgcttctgtatggacagtaggcctccccaagccttttagttaatcctgctgcatgcctaaccaatgactgcccagagccctgctactcaaagtatgggtcctggaccagcactggctcagtgaaatacttttaactgatctatgatgagatgaatgttaaaattgagattaaactcctagaaactggtaaaaagagatcactgcaacatctaagcacatggttagtgggcttgtattttatgtcttatttatttgttattttactttttatttttttttaattttagatttgggggtacaagtgcaggttgttacatgggtatattgcatggtgctgagatttgggtttcaattgaacccattacccaaataatgaacatggtacctgataggtagtttttaaattcttgccccatgccctctccccttttgaagttcccagtgcctgtttttcccatctgtatgaccatgtgtacccagtgattagctcccacttacaagtgagaacatgctgtatttggttttctgtttttgtgttaattcacttaggataatagtctccagctgcatctgtgttgctgcaaacaatgttattccattcttttttatcgctacataatattctgtgatgtatatgtgccacattttctttatccaacccatcattgatgggcacctaggttgattccatgtctctgctattgtaaataatactacaataaatacgtgaatgcaggcatcttttttggtcagtggtcctcaacctttttggcaccagggactgttttcatgaaagacaatttttctagggactgtaatgttgggggatggtttcaggatcattcgagcaaattaaatttattatgtactttatttctattattattgtaatatatagtgaaataattatacaactcatcataatgtggaatcagtgggagtcttgagcttgttttcctgcaactagattgacccatctgggggtgatttgagacagtgaccatcaagcattagattctcattaggagtgtgcaacctagatccctcgcatgtgcagttcacaatagggttcgaactcctaggaaaatctaatgctgccagtgatctgataggaggcagagctcaggtggtaatgcaagtgataggagcagctgtaaatacagcttcacttgcctgccagccactcaccttctgctgtgtgatccagttcctaacaggccacagacctggtatcggtccatggccctggggattggggacgcctatttttggtagaatgacttattttcctctgggtatagacccagtaatgggattgctgggtcgaatagtaattctacttttagttctttgagaaatctccaaactgctttccacagaagctgaactaatttacagttccccctttttttttctgtagccttgccaaaatctatttttttagtaatttattttcatcatattttataaaagtatcaatttgcaatagatcagataataaaatgttcatccccacagatagtttgagaagaactgttggacaccagtggaaagtctaaaatgaaataagagaagtagagtcttgcacacagggctttgagaatgagatgtcggagaaatgccaggggcaggtgggtagaatatacacgtgacacagagagtgtataagaaatttctctctaaatgagtgaaatctatcttaaaggaagcactggatgacaaatctaggacatctgatttattttaatccagtcctgtaccatcaaggattacataactctattcagctgtctatttcagagtccactcttagaaaatgtgtctaaatgtatctaacctacattcttcccattccagttttcaggcctttcctattatcttacacaaaccaaaccagagttgggtcttcagtaatctttttttgcttcatggatgtgatgtaaaagtgagcttctgtgccctggctaaaatttgtgttagaccatatatgtccagggcaaagacatgtaatcacctaagggagttttgatgcatttttgatccaaatgtatgtggtagaaattcttcgggaaaataaaagaaatcacatatatcacatatttatgtaaacttcttttacataaaatcagtaaagaaatcacatgcaatatcagaaaaaaggctgtttggttttgatagattgcttatttttttgtttcttaatttgatctgcagaatcacacagagttgactattcaaatggatgtaaacctgactggtaaattcacgacaaagactcttagatttcacctctgctcaacatttagctacacagctccttgtagaatcgattgtctgtaagaggaaaagtctatgcattctgatggattcatgacactggggcttccttaggagggactagagattgctttttagaggtgataagaatacctcgatttttgattttagcaacttttgactttatacatgtctacatatatataaacttggaaaatatgtaagtaaatagaaacaatcatatttttcctttattaaaaaaactttttatttgtttctttttatttttgttttttttgtttgtttgttttgttctgagatggagtttcactcttgttgcccaggctggagtgcaatggtgcaatctcggctcaccgcaacctttgcctcccaggttcgagcagttctcctgcctcagcctccccagtagctgggatcacaggcatgtgccatcacgcctggctaattttttgtatttttggtagagatagggtttctccatgttggccaggctggtctcgaactcccgacctcaggtgatccgcctgcctcagcctcccaaagtactgggattacaggcatgagccaccacacctggccaaaaactactatttctatgtaagaacatttctgttcagtcccttcccatacttacataagaatatagttagggccaggcgcggtggctcacgcctgtaatcccagcactttgggaagccgaggcgggtggatcacgaggtcaggagatcgagaccatcctggctaacacggtgaaaccccgtctctactaaaaatacaaaaaaaattagccaggcgtggtggcaagcgcctgtagtcccagctacattgaaggagagtggcttgaacctgggaggcagagcttgcagtgagccgagatcgcgccattgcactccagcctgggcgacagagccagactcatgtctcaaaaaaaaaaaaaaaaaaaaatatatatatatatatatatatttagaattgtatataaatatatagagagtttattcacattgtttactatagttatgttctaaaaagtctgtgaacactgaattagggaatactgaacctttgctcctgggggaaatacagagttaggttcctgggagcgtctgtcacaacattttctcaatcagtcaatacataatcttgttttatgtgtgtttctgtttaaggacgtctgctttagtataatgttgtcaattcattaacattggacttatggccaacagcaccctaactcatgcgtgaatgaaacttatctaacacatgtattttctccaaaagacacatcacagccttcttgctcttaggaatgctagacaacagttcagcattatgtttgggggccactttaaacagtgaaatcacaaacaaacttacaaaaatttaaagaaaacattatttacagtatgagagctacagcaatgagggagagcattgccctgtttgacctcagcaggaaatgtggacagggccgcttaaggtctttactgctctgtacatgtcctgaaatgactgaaaacaccccttcaaatattgatttgagagttacaagtaagttctaataaggaggcaaattctcaaatatcaaatctacaaactacgaggatcaattgcatatacatggcttttcacggtgctttatatttaactttatacctgtaaactttcactatttattaatagtttattccaatattgttgtaatgattgatggtatagtttgctaaatactctattatcctaccataaaaaggtggttataaaacagtgcaaagtagcaggtaaaccattttattgggtatatcttggaattttgggaattcctaaacccttcctccctaagaaggaaattacatagatggaagctgaaatcaatctatgacaaattattgaaatattgtaaccatccaggattgtccagggttgggaatttggaatgccccattttccacatagaggatgctcatttccaatttgtctccctttccttgttgatgtcattgtttttaattaataatagagttaagtactgtagccaattgagtgatgtgtatattgctgtttctaaccaactccttatagtgttcactattgagagcgatctctaactgatttcatctccctaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggtaagaataggtgccaggctctatgagcaactgaaccatatttgcattagtgcccccgtgtcttggcgaagtcatcatgttttaactaatatgaatactaaggaataatttttcactgtctttgatcacggacattttgggtggatcaagtcgaaaaattctgacctgaaatgcatttctgcaaggtggacttacttctgtttacagtttcttgatgagattgattttaagtaggctgtcctcttcagttctcaccttcaaaccttgctatattttcctaatgttaaatgatccttatatgtcttcttctgattttatgggctgatttaattgcagtagtttcttgattatgcccttagctccttcagagcatccttattgcttccctactgtccagtacagaaggacaatattatgccaaaggacaaataatttaacttaatcagccccagcaacctcttctccttgttaagcataatgcactgatacatttgatgaaatcagggcatcagccttcgacaccagctcatctcccttagagaacaaaagcaaatgaagcatccacccgcccagtggatgtttgtttgaactaaaagcctggaaaagaaaacctaaaaaatggaaatgaattttttatcactggcaaattaaaacaaatgttcttttccgttagaaatccaatgttttaaaactgccagcagtaagactcacttctaatcatgttgaggtgttgcttatattagcgttgttttgtcatcgttatgttacattttactaattgcttgtatctggaatcatttttgcatttgatagaggtagctgagtctctattattcactaataaaatacaaattattttctaagtattgacggtgagcacacagtccatgaatcagtttataggattctaaaagcaaaagaacaaacaaacaaaaaaactgctacataatccattactgtgaaaggctgcttagggccaacaatctgaaaatatatacttgtttcctttactgagatgtttaaaccgggctgcttataaaaccttttggaatatatgattgattttatggcaatccatagtaacacattcttttaataaatagtaagatatatagaacaacttaacccagagcttttacttcaaaggaaaagatttagaagcagtaaaagagataaggaaataaataggcatattgttaaatgatgcaaaataaaagactggataaaattgtttgtaaatcatgaaaatagaatcatcattcttcacatattttatgtccttcatgttcaggtttaacaatgcctagctagttgatataaatttttactctagtgattgcttttagtcatactgtaatgtaattttatagtaaaatatatcacacatgtactctgtaattttgcttgtttttattatgatacatatgatatacatcatctttttaaaaagtatttttggatagttttagatttacagaaaagttgcaaaaatatagagagttcctgcacacccgacatccagtttcctctattgttcacaccttacataatatacacattttaaagataactaacaatttttcttaagtatacacctacccatgtgtctctctgctaaagaaagatgatcaatgcatgtctgtcccttgtatcatatcttttgatctcctatgtaaatgctctcctgaatttgggttttatgcttgcttcatgtgtattataattttacatctattaaggtgtttctaaataatatattgtaagaacttccacagtaaaattccaacttcagggctttcttaaaaaaaattacgaatctcaagtttacttaggtatctctgtttattcaatcattttttcaattgatgttctttcacatcagaatatgcttgaccttggcatgagattctattggtcattaaatacaagccctgcaaaatccaggccaccctaacagttccagggctggaagcaaggagccggatgatagcagaagacctgctgccaaactctgccctgcacttcccagccttgtacttccagaaccaggttaaggcgatccatcttccaagaagcccacttaggggttttgggctgaaaattctggatcctgggagtgaactagaggggaaagggttctaagtggacacatcatcttttcttgtgaggccttttggtaccatgggcaagagcatgactggaggagggctaaagtagggtccctaaaatgcaagactgccacagggacctggctggtacaggcagtggggtgatcaactcttgccaactttagctgaacgaccttcatcctgggaacaacctccttcccccagtcctggggaactgtgacagtcgttccccctggaaagttctatgtagataaggctgctctctatcactaggatctgtgttgtctaggtggaaagtgttttttagataattcttcagccagtttatgttcaagtaaaaagttactccgtgttgtgagacacgtctcatcagttctccttctctctaaatttaactgcaagtttccagttattttatctgggctgttccaacagcccgggttatacctccactctttaccagtcttgacagtggctgtcatattgggagagtgggctgctcctgaactagcagcactgtgtatatgccacaccagacttctcttatccatccatcactttttactctgtagctttttttccaccctcaaacaggtgcttttcacaaagtcggactgtattgtggtggtacattctgctcagcttttatcatttataaattatacattttaaatttagattctctagattgagaatggctgggtgtctaatttctgtacattcccctatggaatcttttgcaatgcctaacacaacatgcagcacaatctggggatactgtgtgcaaaattctcacatccccctcccttgtgtaaagcaaacattctccatccaatgaactgactacagcactgtgaagtctaacctgacatctcacttctgctgcagtgacatatagcgataatttatctgttatcctcggaggtgcttaacatgctgactgcctccagtaatggatccatccattaattcagcactaagtattcttcagaaatcttcctattttaggactttcatctcaaattgggctcagtgctgagcttctctctggtattgcattatattaacttgttgctgcctcttatcatagactaatgaggctaacctgggttgaacccctctttgttcatagaatctcttgcttattgaacattgtagctaggaatatgaattgcctcatgataggatagtatgctttctgtaaaattccatgatctttcctggtgactctgggtttgcttagctttgttccctacaggcatattgcacaatttattttattctgagttagtttgagatgtgtcaggaaacgccacctggagaaaagaagattagcagagttatttatatgcctggcatattatagttgcttcaaaatattattgaactattatcctttcagtttttaccctaacattcttaattggctaataagtcattcagaatacatactgagattatggtaaccatatcttacactacagaagaaatttaagcgctggaaatgtgtgtagtaccatgtacaataaattaacactcaaaaagctttgatgaatttttcttgatatattaaatttgaaacttcaaagtctccattaggttaaaataaaatgtttcggtgtgtctgataatagttttaaatttgaatgctgtcctttacttgccatgtaaatgtattttgtcagcaaaacaaagcattaaggaaaaatattatcagtcaaacaatttaattacagtggaaattcacaagtagaaaactagtgtggattatacaggaattaagaagttgctgactcacttcttattctttgaaattgtgttagtggttgatgactatcatggcaaataaagattaattaaaaaaataataaccacccatctagtctccgttccgtgggttcaattgttttgatttttaggtcccacaaataaatgagaacacataatgtttgtctttctgtgcctggcttatttcacttaacataatgatctccagttccatccatgttgttgcaagaggctgggaagggtagtggagtttggggagaagtaggagattgttaatgggtacaaaatacagttagaatgaataagacctactataggatagcacaagagggtaactatagtcattaataattgtacattttaaaataactaaaatagtttaaatggattgtttgtaaaatgaaggataaatgctttagaagatgaataccccattcttcatggtgtgattatttcactttgcatgcctgtttcaaaatatctcatatacccacatatacacctaccatgtatccatacaaattaaaaattgaaaaaatgtaatatatgtattcatactcgataaacttatttattccacttggatagagaaacatttagaatgtcattagaccacagacaataatggttaatattatatttattatttaaataattataaaccagccttatataaatgttagaaaaaaatcaatatagatgaaacatccttttatgaggcaaagaataaaatcaaactgtgaaatatttttgatattaagccatcaagacttactaaaatccttgtgtatgtggttcctttatgtataggaaaatacaataattaattagataaacagttggtaattttattccaagccaagagaacccattttccaaatagttagctttataaatacaaagatatttcatcattattaatgtatcttttcttatacatagtacatgttttcatcttttatgttcttaattttgcaattcaaaatactaagttcccatctgtaagttatatatagtttaatattgctggctggcatgtttaggattctggagccaatgtttatatttttcaaatctagatcaagttaatatccttgcacattattataatactagtgacttcctgggaatgctatgtaaataaaaaattctttgtatgaatttcagtttgtaatttagatcaaactaataatgactgcagtcattattccctcctttaatacagaaaataatcatatgcctctttcttttattttttaaatgaagttatctatgatcctgaattctgattcattgtgatgcgtactggatttatttcgtttttatcaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtaagggcaatctcacttcattttgacctgctttcaaactttggcatcagattaaaatttatgtataagatgaacaattattctttcctcttccccattcttatctgttccacaggaaatgaattatatttacattagaaataagaaaaaatgcaccctttgtttaaatgtcatattttaaatgacaacatttggaagacttggccatgttatgtatggccacgtatgtacacatgctaccagttcgccaaagataatgttgatgctgctataattttagacaagtatagatgtattaaaaatatgtcattaaactcaatatattaaggcacttgaacagtaaaattgatcatcaggtaccaataaatttgagactatgtagtcagttatcaaactggcatttgctaccctgacagcagaatattttccaaggcaggggaattcagctggttgcacttctcctaatgtgcctttttaacaacccattaccatcttctctggagggaaaatgaaaatgaacttctctagagaagcttggggttgtggtattgatcaaggtataaggatgatcaaagagtttcaacaagagcatcagtacaggacatgacaaggcaggacttgagagttaattgtggaggacaaataaccttaaaaataatatatatttttggctggcgcagtggctcatgcctgtaatcccagcacttagggaggccaaggcaggtgcatcacctgaaatcaggagttcgagaccaacctggccaacctagtgaaaccccatctctactaaaaatacaaaaattagctgggcatggtggcggatgcctgtaatcccagctactcgggaggctgaggcaggagaatcacttgaatcagggaggcggaggttgcagtgagccaagatcacgccattgcactccagcctgggcgacagagcgagactctggctcaaaataaataaataaataaataatatttttttgagacaaggtctggctctgtcgcccaagctagagtgcagtggtgcgatcgtagctcactgcaccctccacctccttagctcaagccatcctatctcagcctcctgagtcactgggactgcaggcacacaacaccaggcctagctaatttttgtatttttttgtagagacagggttttgccatgttcaggttgttatgcccacttcagcctcccaaagtgctggaattacaggcatgagtcactgtgcccagccaaaaataataattaatagtaataattgaaacctgtggttaggcatgagcaactatagctaagtcatcttgccagtcatgctttaatatcaaggctgttaattttaattattgagtttaatggaatgccataaccattacagattaaacaatttttaaaacagtgtgaccaaattagcctctaccctgtagtaatgttcaatatgtattttgaataaatacataaattatgagaatcaaaagtaactttttacttttataagacattttgtcaacaaaaagactcttctatttatatccaatggaccactcagtaatatttgtcaatcctattttgaacactaataaatacttcattatgtctagaaaacagtaataataaccatattcagcaataagagtggcaggacataatttcctccccacaaatactcatttatttgtttaaaacaatttgcagagaaaacaattctttatataatgaaagatgatatgaaaagagagaatttagacgttaaacctcaactggctagatttggggattgaatgacttttgggtccgtttgttgtgaacttgtccatagttacaaccttaacagctctggaacctaaaacctgatttaggagagggcacgcagagaggcttcctgggcctggcttctcaataggagacttgcttacagagcagggactccccaacccctgatggggagcagccatcagggaaactggcagggagaggctcagtcacgcacactctgagtggtagtgcatgttgattatctcagattgctgaacattcatttggtacaagtatatctacccttcgtcctgtgtggacatgttctggagctgccatgtcacacaaggactcccggttgcctactttctgaaggtacatactttctgtaaaatagaggaccatcagcacatttggagaacacatcactttagtgccataccttaaaaatgcttttcagaaatagttagcaaattatggatagatcttgactatacatgtttctttttaaaagatgctttaggctaacagtaatcctaacaatcttaaaaatatagcaaaaatcaaagtaacatttgcatactttttaaatttccaagcgtatctgtaaacctgttgtcttatactcagaagaagatgtatatttagtttggtcttatatactatacctactgacatggcatcccaagatggatggcatcccaagaattaaatggagccttaaaaaaaaaatctgtgtaccaggccttatgctaagcacttaagatgaatgagcatttaaatcaagcctcacaaaatctcttagaacctgttcttcatagtgtttgtttcctataagtatggaaacagatgcacagagagaataagttggctaaaatgacatggctaagaaaaggcagagcccagcctctaaccccagcactctggatccagggaagtctccctgaaatgtttgcctgccatgccatgcagcccctctgggtgcaagttaacatttggggtggttagtatttaatccatgcgtaataaatgtatcatttgatggttcaataaactataattaaaaacaagcattaacagccagccagacacggtgactcacacctgtaatcccagcactttgggaggccaagacgggtggatcacctgaggtcaggagttcaagaccagcctggctaacatagcaaaaccacgtctctactaataatatatatatatataaaattagtcgggcatggtggcacatgcctataatcccagcttctcgggaggctgaggcaggagaatcgcttgaacccgggagacgaaggttgcagtgagccaagattgtgccattgcactccagcctgggcaacaagagtgaaacgccgtctcgaaaaacaaaaacaaacaaacaaaaaaccaggaagtaacattaaaaacattaacaatctgacgggaacttaaaataatgcaggtttttaaaaaaaaactgtaatactttaagttggctcaaacctacagataaaggtgtaaatacaaatacacacacatgctcacattcataccacatggctattcacacacactctacacacatgcaccaatgtggcctttgcacactgtttctctcatgtggacacattcatatgctcattcacatagtccaaagctccttacactttcacacaccatcctcacacacgtttacacaactcacatattaatccttactcatgcacactcacacacaaccatccttttacacttctacactcataagtccttcccagacttcttatattcacatcttccttacacagagtcactccctacgcaaacacacacaaacacacacatacacacacacacacactcttagaagccctccccttgtcctctgtggacatgcagtggggtggccctcagtccagggacttcggagaggggtggcgaaggggtgagtacagaactgaaaaggcagctgctatccaagtcctcacatctggggctgaaatgtgagtggggctggggcaggagtgatggctactaagacaacaattcttacaaagttgcttggacgtaaaacacttattaaaggaaattgtttagtatatcatttggtatcaaagcacactggggctgcagagacccctgacaggaactaagaggctgttgagtgacaacgtcaaccttgtgaccttagcaagcacagcacccacctcctggcttccttgcctccagcctctgcacctccgtcacctgtccttccaatccacccctactatccagccctcaggttctggcctccagcctccatggcaccgtcctccatccaggcccgttgttttcctcttcctttctggtggagtttctacctgcctaccttccctcccctcttctccatggagccccaagcctgccctttgttccttatactcacacacagggtttattccagttgatttgaagatcgtggtgttattccgcctcctgtaatactgaaggcatggcccttttggaggcgagggctagggatatgaggaggttgattcttgtcaatatcaaagttttgcggaagaatgtaagatttgaattgtggtggtgaccattatcctagcgctcattggcacttaagtttatttccctaaatgtgataatgttgtatagagtttacttcaatattaattccagcaaacctttacattgtatgaaagtttttgaaatttacattgtaatggacagggaatcatgagaaatcaaaatcttactatcactttaggtttgggtatgttgatgtaagcatttgttcaagttcacaagcaatggaaaggatggcaatgtccaaggaaaagctttcgtggctagagaaaatgggttaatcaattgtcttatcttgtattggagtgagtagggaggagaaaagtgtaaaatacaatggtttagaacatttggtgagaatgagtactatagaacctaaattgccataggttactagtagtaaacattatgataatataatgactttaaataaaattcacaatttaatctttcacatttgaattaaaaataggaaaaatctagtctaacaagaatcaagaaaaattgactcagttggtctttttgaagcagatcaaatagaaataacatatgtatcacaaccatttaagagtcattcttttggattttaggcaaagccacttatgttgaactctttttaaaacatggtttgaggtttgctatagaatagcctttggttttacgttcctgcattagtttgctaaggaagtggcctccagctccatctatgttcctgcaaaggacgtgatgtcattcttttttatggctgcatagtattccatggtgtataggtaccacattttctttatttggtttatcattgatgggcattttaggttgattccatctctttgccattgtgaatactaatgcaatgaatacgacatgttcttacttataagtgggagctaaatgatgagaactcatagacacaaaaaggggaacaacacttactgggacttactggaggttggagggtgggaggagggagaggatcaggaaaaataactaatgggtactaagctttatacctgggtgatgaaacaatctgtacaacaaaccctcatgacacaagtttacctggtaacaaacctgctcataagttacccctgaacttaaaataagagttaaaaaataaaaagacataagtatactccgtgaggggggcagaggggggaagccttctctgaataatgtcctttctggtttgattaccaactagaatttttattgttttaatatttttaaatctccctgtttttacacattgtcattgatttgaaatgcttaaaattaaataaatcctgacacatttttaatgaattcctgtgaatctataaaaaagctaaatatgtataaacttaatggatatgaagagatgcccattattaatttttggtttcttaaaaagcagattgtaaagtagcatttctttatgattatatttatggatatacacacatatctatatgtttgtagtggtcattcatacacagtgagattgtcagtgacatttcttttttattttttcctggattgtttaatttctctacagtgaacatctctttttttataatcaggaaaaatacataatattgtttttagttaaaattggaaaaaattctgtaagcaaaatgtaaagtttccatcctttgttttaataaaggagatggcagacctgtaatcccagcactttgggaggccgaggcgggcagatcacgaggtcaggagatcgagaccatcctggctaacatggtgaagccccgtctctactaaaaaatacaaaaaattagccaagcgtggtggcaggcacctgtagttccagctactcgggaggctgaggcaggagaatggcatgaacctgggaggcggagcttgcagtgagccaagatcgcgccactgcactacagcctgggcaacagagtgagactccatcccaaacaaataaaaataaaggagattgcggaaaccctattatgtatatattcttggcaggttttgtaggttttttttttgttttgttttgttttgttttgttttttaatctgggatgaatgagggcacttaaaacctttgtctcttggtgtgtttcattctgaatcctaacaggtatcaataatttgatcacggctatttgatcaagttcccaagctgttggtgcatggtgctctgcctgtctcagtaactgtttgctgcacctgtaagccaaaagatagacctaacactttgattttataaggggcttagctacaaataacttaataagtgtttatttccttacaactggctaacagtgagatgaggccatctgtgtttgcttcttggtgcttaaagaagttaggctcctacctccccagagactgggagacaggggctgtatctttcttaatgcttacatttcaaaggggtgactcccaggtccttgaaagacatacctgggttgtaaaagtggcaagtggctgggagaagatttacatctgaaggggacaaagaaagaattgatcactgaaagttttctaaagtaaacgctctaagataaggcaggtcaagggcctgtagtccgcaagaaacctatctaaattgtggttaaggagaggggaatgttagtaccattttagtccttataataaggaaaaaaaatccataatatctctttcagataaaattggaaaaattttataagcaaaacgggaagttctcatccttagttttaataaaggagacggtagaaaccccatcacaaatgtgttcttgcaggttttgtagtttatttagtcgttaatctgtaatgaatgagggcatttaaagtcttgatctcagtgtatctttcattctaaatcctaaaaggcatcaaaaatctgattagggctatttgagtcaataacaaaactttccaaactttttcatctatggtgccctatgtgtctcagtaattttgactgtgctgctaacccaaaagactttcgtaacactagcaatgtatccctaaccttaaaaagtggtttaggtccaaaaaacttaacaatgccataacaacttaggagccttttgaaaaaaataatatacatgatttggaaaaaattatttttaattaaacacagttacttagtatttggacatgtgtacctgttgaacacggcaccgtttctcaagacttgaaaccagatcagactccagagccaggcgtggtggcacaagcctgtaatcccagctactccagaggctaaggcaggagaatacaggaggcagaacccctgcttgaacccaggaggcggaggttgcagtgagctgagattgtgccactgcacaccaactggggcaacagagtgagcagctgtctcaaaaaaaaaaatgagactccagtagcctcatatttttgttcaatattgatttcacatggtacttgctttttaaaaaatcagttactaaaactctgctccccaaagataggatgtgattaaagggaatatataatgatctaatgttgaaactaaactacctcaagctagttagtcacacggtgtttgatagatgttgagtatgacagatatttctcttgaagacttaaattatcctgggagtccctatgagttctgttttgcaccttagagcaccccaacacactgcttgaaatttgtgagcctatactgtgtattctcctacattcctagaagtatacctcaagtgaagaaaggtattcctctgtcttccttttttcttttcttcttttatctgtattccttctttcagtgttcaaacaatgtagcaattcaatgtgataaaatgttatttcatgtatgctgttgatatttctgccaacatattgaattcgtgttatgtcactgagggaaaatgaagggctctgatgtagtgggacatgttgaaaattaagcagtcacaactatctgagaattggctgaaatctgatgaatttattgatctaaggtttagttctgtgattaaagtgattaacaacagactgaagcatcattagtcattatgttatagttgacatctgtctttctcatgaccaagtataaatggtcaatactttaagatatctaaaaatggaaactggtgattgtatctgcaccttcttttaggtgtttgcccaactattgtgaacacggtggggagtgttcccagtcctggagcacctttcattgtaactgtaccaacactggttacagaggagctacttgccataactgtaagcggaacacatctgctttttcttgcccctgtgatggtttctttgtcccatttcccttttcattgctgtgtgtatatatgtctgttctgtgcaaactcagcatccagtggttaatccacatctcatttcataaagtcgtcaagatagcctataaaagtacataatatgaaacaaacttggcaaagggaaaatacatatagaagatgaaaggtagctaagggttgaaaactaagaaaatgcagaacgtgaattttgttatcttgttctgttactcaaattgggccagcattttgacactaaactttctagaaggcgcagtacaagtggaaacatgctcagttaccaaattcttactattcatacaattaaacaaagagattctcagaaacagccctggttggagtgggttggggtggtttgtggtatgaagattcagatatccagtagagactagatgccatagtctgtttggatagctgtaacataatgccatagcctaggtgacttacaaactgcagaaatgtatttctcaccattctggaggctgagaagttcaagatcaagatgccagcagattaggtgagggtgtgcttcctggttcatagacttccatcttctcactgtgtcctcacatggtgaaaggggtgagggatttctctgggaaatcttttacaagggcactaaatcccactcatgagggcttcactctcatggcctaatcacttcactaaggccccacctcccaataccaccatattggggactaggtttcaacatacacgttttgaggggacacaaaccttcagtctattgcgctagataattcttatgttatcttgcaaccctatttaatgagggtgataaggaaaagggtggtagataatgattaaattatgatggtagataaatagttaattttattcaatactttctaaatgtcagctactgatctagtattttctatgtcctaactcgtttaattctgatgctcaccctagtaggtgaatactattatatgcaacttacttataaagaaatagatattaatctatttgttcaaggctacttaaaatagttgaggcagagtgaggatgtgaacatgtgacaacatcttctagagcctgggataacaaccaatatccctttttcctgtattacaaatcatgaatttgtttttctgatgaaatggattgcatgtgttgtaaggcccatgttatttcattgtccagttgttctggcgcacaaatgggaagaccaaaatgcccatttcccccccattttttccgattattactgacatttctgagcaactgaactcttagtattacctcctatatccttgatttaaggtaagagtataaggtacaaagccatcagtctcaccacccttggtctattacactatacactgcattgtgctcctgccagtgtttggaatcctgggctcccagctctgggggcctgcacagaggaccctcagaagccctgattcggtgctggggaagacatcatcaagagaatctctcagctctaccactgttgttggagtcatttctgggcatgaattgtgtatactgaggtgcctcataagatttttatgaagaatattggctggtaataaagccacacctcacctgtacttgcatgccacgttatttgacccaggacacccagctagtggaaggacagtatattttaattttttacatcctccattatccccatgtagtaactaactcaaaacagaaagctattcagtgttttcatcgactattcattttaattgttatcagtgactgaatctaaatataaaccaaacaactctgaagacaaaaattaggtaataaataaagttactttcatctgtgacccacaatttgatacaataattgagtttcatttattaggttcttgaaaagacagctgtaatagaactgaagggtttttgcccataactattccgagaaatgaagccagaatgacagtcttggttatagtggagggcaggagatggagtttgttaaaaagccttattaggaaataatcattaaacagtcatgttttaaaaagtcaagccatacacataaatcaacagtcatgttataaaaagtcaagccatacacataaatcagaagtccttccgagtagtctcatccaatccttttccacaaccagtcccaccacaaagttatgatattctgccaagctctttcaaggactttatgaacatatgcatatgtacatagaaatgtataaactagtcatttttacgtactctcttcagtgcacaaaatgcaaatgtgactggaagatgaaccatgcttatatctctatcagcatgatatattataggaacaaaataaaactgtcacactgtggagaagtgcggaagtaaatttacatgattacttgaaattttggtaacattgaacaaattagccatagtatttcacgttgtttaaacactcattaacataattttcaaaagtaaaatagattcagggacaaatattcaggggattatttctcatttcacagaataaaatgcttaacagaagttatcagtatatttggccaagtgttcaatgagaggtgtgcattatacacaagtgtattaatatgaaaccttgtacatggcaaatttaggattacataattaaaaacatccaaacatccgattatggatctaaacacactgaaaccacttgaaggcatagttcatacaagtatgtcttctgctttgaattttaattatcttgagttctcattatggagcattggtgggagtttcttttgtaaattacttaaaattattgatgagctttgtgaatcccatttgttttatgaaaaaaatattttatagttaattttctgtgagaatatagttgtaacatgatttaaagtgtttctgttgtataattattggctaacagcagattttttaaggaagttacactgttgtgcttcagaccttaggttattacaaggtgctactaggatttccaaaatgtgtgccacaagataagttatgacattatacttataaggctccaacatttaaacacctaccttctctttccttgttcttcataatgtcaaagtagctaaattttgattttgaccaagtaatttcattttcctttagtgattaaaaaaagtcataaaatcaacttctttttttgctatcaaatcactttcatccatattaattttaaaaaagaatgagttttgttttaaagtaagttttgccttttctcctggtcagtaatgtacattttaaatttcaagatttgcggtatttcatgtccaaattaaaagttaagagattcatttcatgctattccattaatgatgattttttttcttaaagctatctatgagcagtcatgtgaagcctataagcacagaggaaatacttcagggttttactatatagattcagatggaagtggtcccctggaaccatttcttctatattgcaatatgaccggtgagttaatcagcttttattttacagttaaatttgcatgcatgttttaaataggcaaaattaaaatgaaataagcagaatgttgacgtaatttgcaacttgattaaaatatgtattgttccttagaaaaactgaacataaatcttaaaaaaataattaaatggtaatgattttaaatgtcttttttaatgcatgtggcatctgtgtaaaacatctaataataaatgtttccaattatgtccccaaacaaaaaggatagactatttatgagagaagattgatacatgtaaaagctttgaagaatatttactttttaaatgtatgtaaacataaagtttacgtcttcttgtattcttacataaatttacatagaaattaataaacatggaaatatgtttgattaaattcaacattcatccataatttaaaacactcaacaaattaccaatagaaggaagttaccttgtttcgataaagaccagaaaactttacagcctatattagtttatagtggaatttgaaagcttttcccattaccggctttaataccattctcgtcaccattgtattggaggtcctagacagtgcaataaaacaagagaaagaaatgaaaaatataaatattggggaaaaaaaagaccaagattctcactattcatagataatcaggttatgtattaaaatactctaaacaatttacagataaactattaggattgtcattgaacaacaaacataaaattaattttatttttgtatatcagcaataaaaattagaaaataaacttttaggagatcatattttcaatagcataaaaacctcaaacacatggtagtaaatgtaatgaaagatgtacaaggtttctacaccgataattagaaaacaccctttcaatgaactaatatcctaaataaatggagaaatataaaatgttcattgatcacgcctgtaatcccagcactttgggaggtgggcagatcatgaagttaagagattgagaccatcctggccaacatggtgaaatctcgtctctcctaaaaatacaaaaattagctgggcatggtggcatgcgcttgcagtcccagctactcaggaggctgaggcaagaaaactgcttgaacctgggaggtggaggttgcattgagccaagattgtgccactgcacttcagcctggtgacagagtgagactctgtctcaaaaaaagaaaaaaatatgttcgttgattagaagactcaatattgtataatatcagttcttccaaactagatattgattccgtgcaaacctaaattaaaactcaagcagggtgtttgtttgtaggttggtgtgattattttggtgaaaatcaacaagcatattctaaaattatgagtaaatacacagaggcaagaagaaccaagtcagtgagtcttgaagaacaaatttgaaggattcagctctactggatataggcattatactgattggctacgtaaagccgtatatagctgtcacaaagataaacaaataaaccaataaaaacaaaatagagaatttataaacagactcactcatatatggataattgatttattgccaaggtggcattgatatgtaatgaaggaaagatggtcttttcaaccagtagtgctggtggaatttgtacttaaatgtcagtaaaaggagtattgatctcctcctcatcaaacacacacacacaaaatagattctagatgaactgtgctgtccaacatggtagccactagcaagtgcctatttgaattctaatttaattaaaattaattacaaaacaaaatgactgcattttaaaaatttaaacttaaatttaaaaatttaactaaaataggattaaataacagccgggtgcagtggctcacacctgtaatcccagcactttgggaagccagggcgggggcataatttgagcccaggagttcgagaccaggctgggcaacatagtgagaccccatctctatttttctttttttaagtttactttgtcagtctccctggctgcattttaactgcttaatagcctcccggggctagtatggagtgtatcattgtagatgtagaaccttgtcatttgctgaaagttacaatgaacagtgttagaagtcaatattttatggagcaaaaccaaaggaaaagggcaaaattattatacattgaggcagagggtgttgcaaggggagatttggtacttaaaattgaagaacatatctttcgggcagaggaaacagaaagtaccaagttctgagacagatgatcttacttaccaggtgtgttcagaaaacagcaacaaacctaggatagcgggagtatggtgagtaagtggggcgtaggaagagaggagagaggcaagttgggtggggaggggaagagtatgggcttcatgacaatgttgtaagacctttggttttttactctgaaatgagatgagaagacactgaggagtttatttttttatttttttttttaatttttattatactgtagttttaagaaacggtgggatgcaatctgacttcctttagttggattgcaactgctcctgggttagggaatgcttcttcaggagcatgggtggaaaagagtgatgagactatgcatattgtactttataagatacaatttcagtatcttaattgtattgggagaccatttcaagtaatgcaaaaatccaggactgattgtacaagataatagcactgtagatggaggaaaggtgttagatttttctctttgcatagctatgaggtgtgagaaaacaaaaagccaaaaataacgacacagtttttgccctgagtaattgagtgtttgaattgtcattatttaagatgtgatcagaaaaggtttaaggtgaaagatcataagctctgttttacacaatttttttttttttttagtttgagatgtctgtttttccatgttcaaacaagattctgaggaggcatttgaatatgggagcaaccgcttctttatactaatgaatgtttagttctaaaaactgcaggtggtggcaaactctgtgccaacacatattttggcagaaattgctataaattagtatcttcaaaggtttttcatttaacacaacttggtagcttctatctgtctcacaaccattgaggacattgcctcatacaccaaaacagcccaaacaaatggtgttcctgcatatgtgtcttctcaatgaagctctcccgcctgtgcagtacaaatgcccagacagcactgcaggtgcttctcatccagtgcaaccactgagttgggccaatggaaataatatcatcatggatcttcccaaatgattcttatgtgtacttaggtttgggaatcactgttttagacttcatggttctcaaacttcagtatgcactggcaactctggtatgcgagaattaaacataacaaatgtgagaggactttacagagaaaaaaagagagaagactttacaagtgtaagatatgaattccagtgccaaaatgttttattattttttttccagcttggataggttggattgtgagtgagatttatgtaacaatccaccactgcaaacctgtaaattctatgttcccataaatgcatccggatctatacacatacacatgttataggaagtttcattctgaaattagacagcgataggttgataaatatctctagtctttgaagttttaagaaacacacacacacacacacacacacacacacacacacacacacacacatccattctcattgtttgcagtcgttatgttccgtaaagtaaccaagaacactggattggaaaacactgaacaaattactcctgggggaatcacagtacaattagtttcttgcaagcctctggtcacaacggtctcattcaccaatcaatacataatcttgttttatgtgtgtttcaggttaaagacaccttatttaatacatactgttgattcattaacattgagctcatggccaagagcactgtagctcacgcctgagcaaagcttatctaacatacgtgttttctttctagggctcagtgcgtgcaaccttctgtgcttaggagcactcgacaacatttctgggagtagggggcgttttaaacagcaaaatcaccaatgagtagcacaaaaatgcaaaaaaatgtggcacttaatagactacaaatgagacatttgttcatagtatgagagctgaaacaggaaaacaatgtttccttgttcagctctaacggggtatgtgaatgtcaggcaggccaaatttttgcagctctgtttgtgttcacaaatgactgtgaaagcattggggttacaaataaattttagcaagtaggcaaattcacaagtaatgagaatctgtgtgtgatgaatatcgactatatatcttatgtttattatgggcaataatttagtaatttataggccatatgtattttttattaactaaatgataatgaaattatcaattttattttattgaatatattatttaaattaaatcaacatttacttttttatattacatagcaaattaatgtacattattatagaagatatatctttgataaacaaattatttggggaaaaaattgtagttaagactaaacaattctaagagacctgaagagtgtgtatgtgtgtgtggggaaagagagagagagaacaaattccatgttttaggagcttagattttgaaatgaggtcagatgggtcatagatcccaaagaggagagaaatgaaaaaaaaaaaaaaaaaaaagactggagtcactggaagtatgcagagattaaaggtgcttcattcagcaagattaaaagtattgatggaaaagaggacattcagaaaatttaaagccacgtggatagcaagatgttcagaaacacagatacccagagacagctaaatgtctccagtagctctggaatattggaacatattcaaacaaaagtgacaacccagagtattgcaacccagtgagaaatacgtgttactacttgaaactttccttattgatctagttttgcaaatgaggaagccaagaatgggggaggttaagtgtaggaggtatagcttgaaactctccttattgatctggttttgcaaataaggaaaccaaggctcagggaggttaagtgtagcagggtgaaaatattggtaggaatagatcaagcactggtctcttttctcacagcctgaaagtttttccactaggaagagttaccttctatcaatgtttcattgcttgcagccaatagcatatcttctagttatatagatcaggtataatgactgctgaaaataagacaaaatgctgaatcaccaacatgcaaatatgtgtcttattaaaaaatccagtttttagtctagaactagtgtcaagtgattccacatgtattaaaatacctctaagcattataagctaaaatctacaaaaaaaatctctattttgaatggataatttcttaaacgatgttaaaagctgaaatttctttgtaaacagttttccaaacatagtttcaaaataattagttagagtaaggtgaatcccaggggctgtccgtattgctttttcttttcttttctttttttctttttttgagacaaagtttcactcttgttgcccaggctggagtgcaatggcacgatctcggctggtctaaacctccgcctcccaggttcaagcatttctcctgcctcagcctcccgagtagctgggattgcaggcatgcaccaccacgcccagccaattttgtatttttcgtagagatggggtttctccatgttggtcaggctggtctcgaactcccgaccttaggtgatccgcctgcctcagcctcccaaagtgctgggattgcaggcatgagccactgtgcccagccttcattgctttttctataatgaaattgttttatgttcaagaagtttcttgttatcaaatattgcactgtaaggatgattgttccagaggggagaaattgatgagtgccagaacagagactttcaagtttttctaaaagtgaaaactctatgggttaaactcaccccttctcatggtcccattactgagactcctgggtttagtttccctgactcagtaagtttagaacacaaggtctgggtctctgcattactaacaagtaccccaggtgattctgagataggagctcctgagaccatttcaggagaaagctggagagcataagacttacaatagcataattatttttactttagagatttcaataataaaggccttcttaacagctatgagggttaatacataactgtccattattcaaatgcagtcttatttacatcaagctttgctccagaaggctggctctctcccctcctgtctcctctgctttccttaagacagcacttcctacctgctcttagggtctttatcacatctatcaccttcagctattcagcgtgaagcaacacaagctttgcaagtgtattgcttaaacagcatgttttcactttgcactgttatcacactaaaaaatagcagccagcctaaggtaaatccagttgttaattactcagttgctttatttacaaatattgaaatctcttcagggggagacgtgagtagacccaaactaccattcaatggagattttctgcctatttcagccatctcttattcatttccctgtctccttaccctaccactctttttgcatttagtaaaagataattggtaataaagtaaaatcatgattctcatacagatatgaaaataaaagtttaaaagttttaaagatttttaaaatgcattattaatgaagaaattggaaagatattacaaccagttcgaaggagaatccaaagaaaagatgtatctacacattaggaacacagaaacaaatgtgcatacggaggcaacactggattcatccatggtggaggagggaagtcactagaacctcaaccaggtagcagttgcttgtctacagacaagacaagaattatttgttgtaaggaaacagtgcctgtatttctagacaaagacaaaaaaaaaagtctggcaacctacgttaaaggatgattaaatgcatcttggaagttagagatagagaattgctctgaagagatttaaaggcttatctcccccagatgcatttgcttattttctaagagtaataaaaacctaaggactgtaccttctctcctctaaagaaaatttgtgacattccagagccaaagtctctctatcactgtatggagggaaggaggagagagtgtgccaggcaccctctgtaagcccaagcctcataattttgtgaacctcctcttgtggtgcaagtccagcaggcacagctctatctagcactcactgcatgtgcaggtgggaaattgaggtatgagagattgatgctgattagattctctatgagcgaatggtccctgattcagaggtcctctgtgtctgttagtatagattagacaggtaggtaggtagtagatagatcataaacagatagatattatctgtgtattggcaagataactccttaacttgcaagtgggataacatctcagggcccagcacagtttcagatttaacattatttagcaattctattagttatctacaatgtatagaattatataacagctcaaagcaacgaacatgtcagagccaccgcagcatctgaatcagataacctaggaggttgtgctctaatctagacaatgtgttgtttttattcattcgtttgtttattccctcatttcttcaacaaatgtcttctgcgttttctatcaagccttgtgctgtgtgctggagatatgattgttaccagatcacaaactattgctattctcatagagcttacagactggtaggaaagaccagtaaagtcaaccacaaagtattgaattacaaattgtgatgaagtgcatgtcttttaccactcttattcctaaataggtgtttgtagaaacttcggatcactcaatcatgtctgaaagaacagtaaagaggctctaatttgagacttttcagagatttccagattaatgaagcacatgaggtttggaacctggcttttaaggcacctatctccgttgctcaaaatctattgtgacaatttcattgtgtctgttctgccctggaaatctagatggcctgataagtgtggcgtctgtttaacatcataccttgtagtgctttttattagagaataaaatcacttacagggactatcataatattgaaatattttagaatttcaaaaggaaacgttgttatgagctactctttaatggttgccatgcactatggccttgaatctcttgcaacacctttaaatacctttagaatcaggtgttaattgtgacccagtggatgctaaactacagggaagtctcactcagtgtgatccagaagggaaagagacaaaggcttcaagcaggtatattgtccgccttgcttggtagctagcttcttcttgcatgccattgatttaccgcaagaaaaggtgaatagtttttttgaacaaaagaaacagagtccaacagtggctaggctgtcaggtttgtctagttaataataaccttaaacttccgatagccaaggttgagttggctgaaattacagaatttcagacctcgttctgccaatttaatttccaaatttggaaatggaggctcagattttacctgactttcctaagggcacaagatccatgccagatctgcaactcagatctcttaattgacttcgacattatactgctggccacccgtaatttcattggctggtagattaagttctgtttgagagcattctactgttgaagggtgaactgaaatgcaagggggaaatacaaaaataacagctattgtttcgcagaaaaataataatccacacatggaaggcaataattctgtgaagttggtccagcctcatttagcctgcctctctaatccaaactctgatgactgggaaaggaatgggaatgaaattttcaaagtatacctccttatttggattgttgatccatgtgaatgtcttagctaaaaagagaggggaaagttttgcctactattactatttttctccaatttgggatattcctctgtattacagaagagttatgtgacttaacagcacatatgtagtagagttctgacaactttcactctgttttcttgtctactaaatcagaggctttttgatttatctgttcttgtgtctgcatatatcacagaaaatatagtataaagtctgttgctggtaaagttgaagggcagatatcacatgcctatcatctgttacaaacattgtgagatttttatttcatctaagaaattttgataatcagtatgatggaaatgtttacagacattcaggcaccaatagtgataactctagtagatactcaaagatattttacttttgtgttagttgagatgctgtgtcagatgcattcaattcaaaagagtaacttcctattgaactgcctaactgtccagatcacatgatatcaaaatgagtatttcaaatttaattttaaaaagatgcacactcataattaaatgttgattaaggagaggtatatagagggctacaaaattttgactttatttttgctgataccatgaatagttgttaagagtagaaaaggggctgcttacattatgtaatataaattatttcttgaattctaatatacatttttttaaatattgtgatatcattggattttgggtgtgttgatgaataatgttttgtagttataataggcagcatttttcctttcttgcagagaaataaaataatgatgcatctttaaaaagatggaatatcgatttcaatgaaataaaatacatcacaaaaataatcagatttcttaatatttttcatcataaatattgtgtggctaaattatatgaaaatgttaaataaaattactgtaaatgcatggcaatagtatatattttaggaaaaataatcacttaccataacttaaaaattccgagaatccatttgtgttgattctacctctcagggaagtttgatgactagaaacatttgactcagataaaaggtgattttgattttctttatttattttaacttttgcagactagtgatggtctcctctctttctccccccatttctgcatacaagaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaaggtaagtaaaccatggtgtctgtcttgttgcacacatcacatcatgcacttactcaactagctcctgagaattttaagtctgcaaagtggtggtgtctagccactgagggtatatgatctcacatacttagtaaacatgtcacagtctggaagtcacaaagatgcttctgcctgaagaaaagaacaaggtcaatttacactgagctttattcaaagccttgattgcttttaaactctcttcctggcattaattggataactgtacagcaaaggcctccttctgatactcagtgaatgcacagtgtttatccctgataaagggcaagtgacacataaggtttattttatcatggaaaacagctaataaaaatacgacttagttttctgaaagcgattattctacgtgcctctttctcatggattgttgacagcctctgggtataatggaaaattagaaaaggctgccagagacacagttgattcactagttcaaggaggaatcagaaaaccatcttgactctttatttgattctgctgtgaataaccagtctgctcctgagttctggttttggtctttctttagggcatctcattatgtcagagcctctgtttccaccacatctgccttacagtaagccttcatgagctaattcttgaagtcactgcaagagctttccagctggcctcctagcttgtcatctcttcacatcttctaaccatccaatgcaaaatccaaaatattagtctctatgaagaaaattaacctttaagaaatgctgcccccacttttaagaaacacagttctatttaagaagctctaccgcctttctgttgtttgtctgtccaacacagcctcttctgctggatcctggaattgcgtattctgtgtccaccctgcctatacaaccctcgtgccaccctcaaacacgtattttctagcagtggcattgaggtgtatttttctttacatattagataaaattctaagacgtctgtacaataacgctacttctttcatgttcactcctgcttgtcctaagaagggctggagtttcagagagaatgacaaaaatttaaaaagaaatttgtttcgtatagaaatagcatatgtcataaagatcatgcaaaaacgctgaactgtcgttctgacatttgaaccctgcatttccgattaagtctctctctatttattctccacccactaaaaatcagattattttctcccctgtgactgactgcccccttgcccttcttctcctctttctcctcctcgttttccttttttagaatgttttcatttggcctctacccctccaatcccatctttctggaacccacaccaaacttacctcctcctggaacctcaattctgtgtgcaaatgaggatcagacagttgtagtgcaaacagcataggatttacagctggaggtgtgggtgtgtttctcattggctaggtgcatctagaacatagatagatgaaaccttgattcatgaaatggacgaatggttaatgaatctcagtctttgttttcttttctccaaaatggggccaatgataccagcctcacagggttgcagtgatgattgggtggcatagcacgtacaaagtgcatggcatgagcccccctcatttccagctctccagggcattgtggccatcgtgaacatacactgtttagtttgtaatgggttgttcattgttggtgaatattcatcttagaataaaaaaacagataagcaaatctggaagggtattctaagaagaagaatggtaattatggaagagtaaatgaatgctgtggaacaaaatgaactcaggtcatttatgtggaaaagagagataaaagaaggtcatgcagtatatgtctttcagtgttcggcttattctgtttagtataatgcccttcatgttcatccatgttgtcacaaatggcaggacttccttctatttaaggctgaatgatatcccattgtgtgtgtgtgtgtgtcacattttctttatccattcatcaatggacacttaggtttttccgtatcttggctattgtgaataaagctgcaatgaacatgggagtgaaaacatctcttcaagatactgaaggatattatgctgagtgaaataagtcagaaacagaaagacaaatacttcatgatcccacttatatatggaatctaaaaaagtttaactcatagaaacagagtaaaagagtgatttctagggaaggggactggtgtggagatgttggtcaaagggtacaaatttgcagttgtaagatgaatatattctggagacatggtatacagaatgattactatagttaacaacaatgtattgtatacttgaaatctgctaagagagtcgattttggtattctcaccataaaaatataaagtagctatgttaagtggtgggtatgttaattagtgtgattgtggtaatcatttcacagtgtatatcaaaacattgctttgcacaccttaaatgtgtacaatttttatttgtcaattttactgcgaagctgaaaaataaaatgtaagaaaatacaaaagaaggatggttatcaaagttgacaaagaagtcaagctgtaacagaaccagaaagcaaaatccctgagagagtgttgagcaaacaccacacagagtaaaagggcttgatatggtttggctgtgtccccacccaaatctcaccttgaattgtaataatcctcacgtgtcaagggcggggccagatggagataattgaatcatgggggcagtttcctccatactgttctcatggcagtgaataagtctcatgagatcttatggttttataaatgagagttcctctgtacaagctatcttgcttgccaccatgtaagatgtggctttgcccttccttgccttctgccatgattttgaggcctccccagccatgtggaactatgagtccatcaaacctcttttctttataaattacccagtctcaggtatgtctttgttagcagcatgaaggcagactaatacagggattgacacagaatgtgaaggaatccccacctttaaggccagttgtgcttgcacacttttttttttttttaatgcttccctggtctttcaggctcaataaccagttttagaaagtcaactccagaaaggcatggaagaggggatctagaaaggcatggaacatgactaaatacagaagtttttctcagattggtgacctcatgattcgtgtggaatagatttgaagtggagagagttaaaagagacagaacaattggattctgaggtcacaataagaaatataatggggtagaacaggaagttgttttcagacaagctatatttggagtttcagatcttggtgatttagtgtcaagtgataatgatgccatatgtgaatgaataaagtgaaatgtgtatgaaaatatgttttctgctgctgaggatctgtgactcagcacacaggaagggtgatcaatgggaatgctcaagtcatttaggaaagtaattatgggaggtggaatgttctaccatatccacgggtattttttacctttaatttttatttctcagggttttaaaaattcattcctttacttatttaaattccttagtattttttttaaagtcttggattgaaccacagtctataccttaaaaaacattcagtgatttctattttatagggaagacatgaaatttagatgtgggaatatggctcagtatttaagaataactatttttctttttaatctatgaaaacttaatgttttaagcagtatattgaaatatatttattaagtatttcaagcaattttcaccttctggtgaagggctaatcatgtaattaaaaaaagacgaagattcttcatattaatgcatttatgcataacacagcttctaataactctttgctggttttttgtttttgttttgacgtggccagactggcatgtatagtaaccctgggagagagcttgtcagcattagcatggggctatctaatagtaagttaaaatgagcattggcatttataagcaagggagaaattagtaaaaatcccagattctcagtagggctaatggtgacaacttgaaggtttgaaagtcgacagaaaaatggtcaagcacctttgagaaactgactgattctatgttgcttacattcttctcatgccctgattctcagatgactacaatttttcctccatactttttttttttccatgatagattggctacatgcttcacgtccttctctgaaaatcctttcctagatgttctgtctgttccttgctctagttacttggcatcgtgtttagtcttaactctgagaaggagctggtagctgaacatttatcgtaggaagagatgcatttggctgagggaaacttccattgagtgtaatattcgcttccagcatgaagatttttcagtgttatttctgtagtcttcaaataaatagccaagccattaaatggaagataaaatatatacttccaaataaatcttaaatcatgacaagggagtgccaaatcatgcctaacgttttttaacagctaggatatttttagagaataaatttattgagataaatcagggactttacataacattccataatgctttaatgggcatttcatgatttcaaatcaattttgctttggtatgttaattactatgatttatattttgatgctaacttgtttcaaaattatttttaaagaaattgcatatgtgagctgctctcaattcattttttactatcatgcctaaattaaataggaactgctggtttcttttctacccaaaaacaaatgtattggtcatttaagcctaaataataacttttttataaaaaaagtgttcttaaggaaatgccagcaatcatactgttttgcatatccttaaatccaatcaatctttctccttttctccttttattctttttaatgattttggaagaaaaggaattatattgggagagaaggtggtggaacataaaacagatgtcacatttttcacgtttttctttcagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggtgatttccatatgatttctttatgcaagaaaaagttcatttaaaaaaattaatcactcaaagtatgtatagctagccagatactgaacaagttagtgcaatgaagtaattaaataaaggtttgttttaatgaaacgtggtgtagtcaatataatcgttagtattaagtcaatgcctttttgagttattttctgtaatggaccataagtcatgtatattttaattttataatcaaacagagacacctgttatatggggaattaattattattccttttaaaactatatataagtagatattctattatcttaaaaatatgtttacagccaaagcacatttcttcaatagtctacctataaaagctttaaaattatcaacttagaatttactacaattattttaacatgcaattgttttatatttttaaaaagacaaatcataccacaaagaactaatgttctgtggattatattttgaaaaaatagatctgtaacattttaggaattttaaaatcaaatttaaaatattcctctaagcagagaagaatcttatgcatgtgttctttgtctgaaaagtttaaaaaagacattgatagtatttgagactagagttggcatgtatactgctcttatttattatttgtaaagtgaaaatattttaaatgtttatatttacatttcagcataacgtatatgttacattgctaagcaactagacctgtacagaaggcttatttttaacaaatattcatagtcaatctggatgtaatatgagtgattttgttacacaatgcatactgattacagtgataaatctgttaatgtaggtcataatttgaattagataatatttcatttagttaggaaacatcaactaaatcccatcacatcaactaaacatcatttagttgggaaactaatatttcatttagttgggaaacatcaagattatgttatatcatacatcaagattatatcatacaacagattatgttatatcataaacatcaagattatgttgtgtgtgtgtgtgtgtgtgtgcgtgtatttcttttagaattgcacttacttttagtgttacatgtttggtatgaagaatattgtctctcttacttaaactctcatttttcaaatttctactccctttggaaggcacccttttcttatcactactttcacaaaaaaatacctacacagtaatactgtattttaaaatgttcataaaatgctagtagtaatgcttagcaacaataaaaattacctaatcatcaataactctccaatgcctccataacatattgctaattaaaaatgacttttaaaaataagattataaaacttcttgtattaaattccgctaatggtgaagtaacttgcatagagctaacccttctcagataattgttgtaaatccaggaaaaaaatgttagaaaaacaactacttgaaataagcagaaagtaaccaaatgttggcagaaactgcccatgtgtttacagcaaagacaatatcccagatatagagataggattgaaaattaagcaaaattcacacaggctccacctaatgaactatcaaaccaaacaatggcaatttattgtgataaggctgtgatttaactgcctatgaaaacaaaaatgaaatctttaaagaataacaaaagattctggaatctttacaatgtatccatgatatccagcatgttataacatttactgaatattcaaaaaagagtacattttcatctaaagtcaagaaattaagagcagttattacaaaccaaccttggggtactgatgtttgaattggcagaaagaaactttacagcaactattataaaaatatttgaagacttaaaggtaaaaataatcacaatgtgtaaacaaagggtattttaagtagataagtgagaactgtaatatggaaccaaaggtaaattttagaatagaaaagagcatctgaaataacaaattctaatagaaattcttcaggctaaagagaaataatggatgaaaactcagatcttcaggaagaagtgaaaagcactggaaattgcaaatatgttggtaaatataaaagccagtgtttaaattattttcttaattaaaaaattaaattcactgtttacttttattataaagtttataacatatggatttacaatatattacagcaatagataaaagaatatgtgtgtggaggggagcagcgttaaatgaattatgtcttagcaagcttctgacatttcacattgttaaaaaacataatgtctaaatagactgtgataaattaagaatttactttgtaatctgtaaagcaaacattgaaatacaataaatatagctaaaatgtgaataaagaaaataaaatgaaatacaaaaaatatggaataaaccaagaggaggcagcaaaggaaaatggaagtacaagaaatcatatggggggcagccataaaaaaggatgagttcatgtcctttgtggagacatggatgaagctggaaaccatcattctcagcaaaataacacagaaacagaaaaccaaacactgcatgttctcactcataagggggagttgaacaatgagaacataaggacatgggggggaacatcacacactgggtcctgttggggagtggggggataggggagggatagcattaggaaaaatacctaatgtagatgatgggttgatgggtgcagcaaactaccatggcccgtgtatacctgagtaacaaacctgcatgttctgcacatgtatcctagaacttaaagtataataaaataaaataaaatgctacaacatttcaaaaaataaaaaagaaatcatatgggggaaacaaaagaaatagcaaaatggtagacctcaaactgcagtatcaatcattacactaaatgttaatgtattaaccaattccagtaaaaaggtagaaaattgtccattgaattaaaaaatctccaactgtgttctatttttaacatatgctatattttatattctctattacatattttctacaagagacatttaaatgtcattatgttttggccaggcccagtggctcacacctgtaatccccgcacttcgggaggctgaggcaagtggatcacttgaggccaggagttcaagaccagcctggccaacatggcaaaaccctgactctaccaaaaaatacaaaagttagctgggtgtggtggtacacatctgtaatctcagctacttgggaggctgaggcacaagaatggatttaacccagaaagaggaggttgcattgagccaaaactgtgctactgcactccagcctgggagacagagtgagaccctgtctcaaaataataataatagtaaataaatcaaatgtcattctgtttttatgtgctccgatgagtgactggatccatactcttttgtaggtgcaaatttagttcagaacatcttggttttgcaatgcaataaggactattaaaagttcttaagaattttgttgttgctattgttttttaggaccaatgacactggattgcttgcttataaagaacatcttccagtaactaagatcgtgattacagacacaggccgactgcattcagaagcagcttataaactggggcctctgctctgccagggagacagtaagtggttacaatgtgttgaaaccgtatttgagaaaagaaccatgacttaaagtaccatcacttaagcatcacgtttctatcatataataactaatcagacttctattgtgaacattttttttgtttgtttccacatacatgaggtgcctttagtagtcaaattcatagacagaaagtagaatggtggtttccagggactggggacaggaaagaatgggaagttacagtttaatgagtacagagatttgggagatgaaaagatgagttttagtgatggttacacaacagtgtgaatggacataatgcagttgaactgtaagtacacttaaatggtaaaaatttcaaattttatgtatcttttaccacaattttttttttttttttttttgagacagagtctcgctctgttgctcaggctggagtgcagtggcgcgatgttggctcactgcaagctctgcctcctggattcacgccattctcctgcctcagcctcctgcacaatttttttaattaaaaaaactctttaactatctgaaggctactatcatgacccttggaataatcttcagagtagacacatttatttccttcaaccattcttcatgtgacatgattaaagtccattcatacctccagtcactcacctctgaatgttctccagccactatacccctgtttgagactgtagacctcaatatgacactgaccagttaagaatggaaaaggcctatcactgccctcaatatggctactagatttggtaattcagccagacttcctactaatttattacaacgctgtttatttctatagagctaattttctagataaaactccaagttcttttttatttatttatttatttatttattttagtatttattgatcattcttgggtgtttctcggagagggggatttggcagggtcataggacaatagtggagggaaggtcagcagataaacatgtgaacaaaggtctctggttttcctaggcagagggccctgctgccttccgcagtgtttgtgtccctgggtacttgagattagggagtggtgatgactcttaacgagtatgctgccttcaagcatctgtttaacaaagcacatcttgcaccgcccttaatccatttaacccttagtggacacagcacatgtttcagagagcacggggttgggggtaaggttatagattaatagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctccctgacggggtggcggcggggcagaggggctccgcacttcccagacggggcggctgggcagaggtgccccccacctcccagacggggtggcagctgggcgggggctgccccccacctccctcccggacggggcggctggcctggcaggggctgcccccaccttccggacggggcggctggccgggcgggggctgtattgtgaacatttttaagtacggtctgaaatactctttcagtcagtcaacaaataagtactcctatgaggtacaaagctatgatggcaaactttgttaaggttctaagagaaagaaaccactgggcatctcaacttgattagttcatgagtacattccagcattcctgaatttctaattgctgttacccacataggaaagcctcagtgctaaacacagttattaataattcatgtgaatttcctactgttaggcctgggatgaaattagaatgtcaatggaatcatgtcattttaaccccaaatatatttcacctgtaaatctctttttttttttccagtttgtgtgtgtgtgtgtgtgtgtgtgtgtctgtgtgcatttactttaaaccagtggtgcatgctgttttgcatatgcaatgcattaacaccttaaaccagaattttaaagttcaaatatagttccactatatttatgttccatatatacatatatatgttttatatatatatattttctttgatcagggaatgaaatgagcatatgtattcatttatagattgttaacctctctgaaaatagttagattagcgactagtgcattaaatatgtatgcttttagtacttccagaacttaaaatggaaatagatgaaatatttgtttacattaacaccacgccttaaaataaaattttatgctaggggcacaacagaataagagggaatctgataattcagtggatttatggagacacagagcagaagttgcttagttaaaaagcaaagatgatactggccttaaaaattatatatacattgtaaatactgtttaccattatactcaccatctctgatatgtatcacctctacttcctgttctaccagtgagccttacacaatcccatgaagatgatataggatatttcatgggaagaaaaattatgtgcaaagagatgaggttgtaaacttcggatgcatccaggagagtgtaacgatttttcatggctgtagagaagttgttttatacatcacgtgtacctttcacttcttgctctgatcttaaccctgcagggacccaggctggcttcctctgccttccttatttcattagccaaaacccctgcctatttgtatgttttaagtgaggtccctaccaactctctcccttagactttctttctcccagacttcctgtcatcattttaagcacacaacatcattccacttagagcagtgattctccatccaaggcaatcttgccctgcagtggacatttggcagtgttcggagacattgttggttatcacattgttggggagtgggatgctactggcatgtagtgggagaggtcaggtttgctgctaaacatcctacaatgcatgagacggctctccacagagaagaattatctggccccaaatgtcagtagtactgaggctgagaaactagagctttgaactactgtgaccatgggaatacagaggggagctactacattagcactaagaatttacggccgggcgcggtggctcacgcctgtaatcccagcactttgggaggccgaggcgggcggatcacgaggtcaggagatcgagaccatcccggctaaacggtgaaaccccgtctctactaaaaatacaaaaaattagccgggcgtagtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaaaaaaaaagaatttacaaatagtttcaagtatttagagacccactaattaatctctgacttattaattaaacagtaatcaagtgattggtcttcttgcctcctgtacctatttttagcgttgaggttcatcgtcacgtgaggttattttctgcatgaaggactaaggactaaggactattttctgcatgaagcgttctttattttctcagttggatgagcagtggcttcagaacagcgaatactccttttttccatatgggaaatctgtaccacttaagttacaacgccataggtactttttttttttttttttcatttccaagtgaggctcactggacagatataggactaacagatagaggatcatgcacggtaggccttataagcagagaaaagctgcatggacattactttgaaggcatcaggactacacattgaataatttaagactgagaaataacttaattctcatgattcagttgaaagcctgatgatcagttataaatctaaagatcagtcaagtgacctctgatgtaagacaaggaaaagatgagagcttgaactaggcaatgattggcatggagctttaaaagggggatcaactacgaggtaaattcgatatgatttagatgtaagattgagagttaaagccttggggatgatctccagctttctgatttgaataaagccattagtgtcattcattgagacaggagattaacactttttttttttaacagaaaaaaaagtgagaatgaaaaaagtagtattttcattttctcacacaaacgagagatattgaaaaatgtagatcagccatgtttttctaggaaagaaggtgaagttgtgggaaagcaggacaaataaaacatgactgttggacctactagtaccggttatgaggttaccccaatttatttatgttgtcttttttcaaagctttcttttcgttttgttttcaatttcattttactgctgctattattgttgatatcagaaatcaactagcaaactaggaaataagagaacttcctccatggcataaaggacatctgtgaaaatctgatagctaatgtcatactttgaatagtcaaggatataactgctttccctttaagttcaggataaaggcaagaatgtctgctctcactactcctattcaatctattactcatggtcctagcacatgtaataagtcaaggagaggaattcaaggcatttattaagttgcagcaaaagttaatcaacctgattttaatggcaaatcaggttgccattaaaagaagtggcaaaaactgcaattacttttgcaccaaccttaagtgagaatgaatgaaataaaatgtctgtttacaggtaacatgactttctaggtagaaaatctcaaattatatttttaaaaagtgagtttagcaaagtcacaggattcaaggtcaatattcaaaagtgaattatatattttttattattatactttaagttctagggtacatgtgcacaatgtgcaggtttgttacatacgtatacatgtgccatgttggtgtgctgcacccattaactcgtcatttacattaggtatatctcctaatgctatccctcccccttccccccaccccacaacaggccccggtgtgtgatgttccccttcctgtgtccaagtgttctgattgtttaattcccacctatgagtgagaacatgtgatgtttggttttttgtctttgcgatagtttgctgagaatgatggtttccaaaagtaaattgtatttctatatgctaatgataaaaaattataaatgatattttaaaagtaccatttttatactagcaccaacaacataaaatattttggtgtaaatataacaaattattaagaaaaaattaagaaaattatatttaaaaatttatgaattaaaagatttgataagatgtcaatttttcccaaatttatatatagactgaaaactatcccaattaaaatccagcaatctcttttttgggaggggagtagaaattggaaagcttatctttaaatgtatattgaaatgcaaagaaagtagaatagcaaaaatgttttgaaaaatataaacaaagtttgagatacactactagattataagacttactgtaaaactaacagatattcaaggaagtgtgatattgacattacaatagacaaatacatgaatggaatagaatagagagcccaaaaatagacccatgtatacatggttgcttgactttttacaaagctaccaggggaactcaatgatgaaaggatagaatttttcaagaaacagatctggaacaattcgaatccaattgaaaaagaaaagcagaatgaaaaaaaaaagagtgtcaattcatacttcaaagcagatacaaaaattaactcaagattaatcataaacttaaatctaaaaccacaaactataacactgctctaagaaaatacaagggaaaatcttagtggccttgggttgggcatagatttcttagatacaacactaaaagtacaattcatagaataaaaataataataaattgggtttcactaaaaagcttctgcctttaaaatgacactgtcgagaaattgaaaagaaaagctacagactgggtgaaaatctttgcaaaatacatgttttatagaggctaatacccagaatataaaagtaactctctcgtggtgcaataatatttgaaaaatcaatttacaaatgggcaaaagatttgcacatacacatcacagaaaaaatatggatttaaataaacacagtaaagatccttagcatcattagttattaggagaatgcaaactcgtaccacaatgtgataccaatatgtaactgttaacatttaacaaataataataacaaaaaaaccccaaaatataacaagtgctagtaaggatttagagcaactagaactctggtacattgcactacagatgcaaaatggtacatactgctttggaaaagaatttggtttcttataatgttaaacccacatttaccatatgacccagcaatccccatcttaggattttatccaagaaaagaggaaaatctatatgcatatagtcagttttttgttattattattggctttattccatagtcccctaaaaatgaaaaccactcaaatgtttatcaactagtgaaaggatacacgttccattttactgtggtgtacccacaatacacagtggaatactactaaacaattaaaaaatagactattgataacgtgcaacaacatagatgaatctcaactgcattactctaagtgaaagaagccagactaaaaagcctacatgctttgaatgattcaatttctaagatattctggaaaagtcaaaaccataggaacagaaaaaggatctctgctgcaagaactttgaggtgagaggaattttacacaggggtacaagaaaactttgtcaggtgaacaaaatgttccatatcttgagggtggtggtgtttttatggtttcaggtccttttcaacttctagagctacacacaaaaacaggctgagttgtactctatataaattaccataacattaatatattttaataagtaataaatgatgtcttattcaacacatctgactgaaaaacaaaacaaaaacgttaataacagtttgcatagctatacttgcttaattttaagaattggaggctgagtgcagtggctcaaacctataatcccagggctataggaggtcaaggtgggaggattgcttgagactgggagctcgaggctgcagtgagctatgattgcaccactgcactacagcctgagcagcagagtgagaccttgtctcttacaaaacaaaattgggtcatcaaaacaaacagagaaacaaccgaccactagaagtaaattcatggaacagtaaagatttcagtaatatggatattctccaattctccagcacatttctggaatcgtgctgaatatgtttctaacttatattgactttagaaactttagaaaaagagtcaaaggaaagaatcaaggggaaacatctgggtttatcagttagtagaaaagtcatgagtaggaggagtcacctatatatttcctacgtaatcagcctgccaagagcagtgggaacgtatttatttttgaggaaccatccaaagtcttttagaccaacagttcctccactttagcatgtataaaaattacttggagagcttgttgtagcacagatttccactccttatcccagagactgtgattcagggggtgtgggggtaggagaatctttccttatctccctccctcccttcctcccttcctcatttccttctttccttctttcctcccttcctcccttccttcctcccttcccttcccttcccttcttccctccccttccgcttctcttccgttccttttttttttttttttttttttttgacagaattgccctctgttgccccggctggaatgcagttggctcattgcaaactccgcctcctgggttcaagtgattctcctgcctcagcctcccaagtagctcggattacaggcgtgtgccaccaggaccagttaatttttgtgtttttagtagagacagggtttcatcatgttggccaggctggtgtcgaaccccagacctcaaatgatctgcccacctcggcctcccacagtgctaggactacaggcatgagccaccccacctgcctgggtatgagaattgctaacaggcttccacatgctgctgccggtccatggaccactccatgtagtgctgcccccagccagtgaggttcacaggctggtactggtctgcacattctttgctaccattctgtgaggaggctagtacaaaaatatagagtatttcagaatgacttctgccatttggacagagtaatttatgtctgttggacataatagtaataaaaaatggactggagatagtattttgtatacctttgcttttcccattcatttttctagcaatttacatttttaatttttaattttaaaaatgtaaaattttcgtgggtacataatagatgtatatatttatgggatacatgagacattttgtcacaggcatgcaatgtgtaataatcacatcatggaaaattgggtattcacccctttaagcatttatcctttgtgttacaaataatctaattatactatttttgttattttaaaatgtacaattacattattattgactgtagtcaccatgttttgtcgtcaaatacaaggtcttattctttctaactatttttctgtacccattaaccatccccacctcctactggcctcccattctctttgccagcctctggtaatcatccttctactctttgtctccatgagttaaattgttttcatttttagacctcacaaataaattaaaacttgcaatgtttgtctttctgtacctggcttatttcactttacataatgacctccagttccatccatattgttgcaaatgatggattctcattttatatggctgaaataaaaagaggaaaaaaaagcacatttttctatataggtagtttaagactcacagctctaggtcaaaggttgggtatgaagtggaccaatggtgctgacatagggcctgcccaagtgttctaactgtagttgcagtatgttcagaaccagaaacagagtttcagagtagaagcctaggcattcatacacagggttaaacctactttcttgacacacagcaagaagaagtctacagagactttgtgctacttcagtgaatcttgcaacacaaagggagttcctggaccacgatggcatctggctctacgtccttgtcactcactctcccttatctgcaaaatctccctaattcttttaccaaaccctttcacactcagattaaaactcttccaccatgatttctagatgacctagtcattctgcgttctcaaaacatgtttagcatattacaaagatatctttctcatactggcttttaattatttttgagcccctcaagagcagggtacattcctcatttattcttgtgttcctgataactaatgtattacctattgcacaaaagataatcaatgaataacagttcatgaaataaagagaatgatttaatatatgcatgtaaagaaacctacagcttatgaattattagtaagagacatgaatacatttttggttctataagcaattaagtaaatatatacttttactaaaaggagtttagactctattgagttattgattctgatataaaaatcacatagtagaagaatgtctagttccatctaagccatttctcatcaatatgcctgaagttgtaatagtgaaagtactttcaaataagaatataattttagttaatattaattttttttaacttttcactcaatacagtgcctttattaaactgaaatgattgccccttcttggaaaatagattattttatggtctattttgctttttttttttgttcacttttttattaccaaccaataatttatatgcaagaaacttgatcaatgtgagggaacaaaaattgtttttagtactttcaaaaggttttcactttggaaccctgatagttgtcaggaccatggtatccttttgggggaattttatacatatgcatacctttagttaattgtcttaaatattaatgactgacttgatacaaaatcataactttttttttttttttttgagatggagtctcactgtgtcgcccaggctggagtgcagtggcacgatctcggctcactgcaagctccgcctcctgggttcacgccattctcctgcctcagcctcccgagtagctgggactacaggcaaccaccaccacgcctggctaatttttctaattttagtagagacgtggtttcaccatgttagccaggatggtctcgatctcctgaccttgtgatccacccgccttggcctcccaaagtgctgggattacaggcgtgagccaccgtgcctggccaaaatcataactttttaaagctatatagaaataccaaaaaagcaagtaaaaaagacaccaagaatcacataactcagaaataatgattaatatcaattgaatatcattccaaatgttggtagatatctctagtgcagggcttcccagtctcaccacttttgacatgtgggctggataattcctcatggtggttgaggaccgtcctgtgcattgttggagctaagcagtatccctggttcctacccaagagatgccagtagcatccttcctccaaatgtgacgaccaaaaatgtctccaaacattgccaaatgtcccctgggtaaagaattgccctaggtggagaatcaccactttagacaaaataattttaaaaagaggttgagaaatgaatttataaaactttattcattaaaattgagaaagaaaacaccaaatttaagccaagatggctcatgaaatttatatatctaacgaagtatattcaacgtaagtgatcccgctaaacttacaaaaaaagattatgcgcgttttaaaagattgtagagtcactacattttatattaaatgtatttttaaattataagcagcatttatctactgtgagaaatggaaaagctagcactcatttcttctttccccttctttatctcccccttcccagtttttgctagttatgctattatttgtatattgttacttttaaaggctaaccactagttctattctccaatgctttttattttgattaatttctttttgtcagttagttgatattttacctttttttttgtctttagaaagattcttgagggttgcatttttttgattttgtatgtgcttgagaatatttgttgccttaggattctaaaactctgatgctttaactttatattgtctattgggaacagcttaattgacatataattcacagcctataattcacccttttaaaagtgtacagttcaatcaattttagtatatttaatcattttaatgtactatacagatttgagcaaccatcaccataatcattttgaggacatttttatcacccccaaagtagacctgctcccattttccagacactgtccatttcacgcactccccatcccagccctaagcaaccagtaacctgcttttttttttctacagacttgcatattctgaatatttcatatagataaaaatacaagatatgtgatctcttgtgactgactacttttacttagcatcatattgtcaaggaggttcatcagtgttgtagaatacatcaacgcttcattcttttttatgaccaaataatactccattctgtggctataccacattttgtttaatcactcatcagttcatggacatttgggctggatccactttttggatattatgataaggcttctgtggacatccatgtatgcttttttttttgtggacaaaggctttatttctcttcggtatgtacctaggagtagaatttccctacatttaacctctttaggaactggcgtaatttttatgtggcatgctgtgtaaccttcagtagtttgcatatatgatcccatacttgtctgtgctgaggaatgcagttgtctcgtcttctactgcttttctaaatgtctttttagttgactgtatttcattatgaatataggttttgtttttgaaaaattttctcaacagggctcttgtatgctttattttcagaattctttcagacttgaaagtgtctgcctattgccttaacacttcagaagtaaactagactggataaattttctttctctcaggaatctatggacagatttcctttattttatgccattgagtactgtgaaggactctgaggccatactggtttttttcaccttgtatgtgacttgctttttctgtctgaatactcgaaggaacaattatccttaaaggtcactaatttaacaagaatgtacctgaatgttgttcatttggtattactttttctggaaatagaagtgatgtgataaaaggtatatacacattttataagttgttaaaatttttgcaaatgtggtctgaatttctgctctcagtctctctatctgagcaaggcagtatttttaactctttggcgtttgaatttttcaacccattttatcacatgtatttcttttcaggtaattcattacattgaaattttatgtttaatcaaagcaccctgaagccttcatagttagaaaagattgctgtaagtttctcgttccaaaaaattcttgagtcactggagttagtttcttcattttgtctgcatcgactagtacagctgtctgagaaatcacagctgcccagagtgcattaaataatcaaaggtgcatgtaggcaataaataactttgcagaagtgagactcttcaactggaaaaagatattgactagtgatttggttaatttctctttcatttgacagagttctcttccatttggcagactacatataaaccgttaaaaaaagtgaggatcaattccatttcaacacataataaaataatgtaactttgttagctccactatgcttgataattctctattataacatttttattttaacttttatattttactttatcttattgggtttatctttttcaatttcacttttgtatgccctctttctcttcctctttttcttcttcctcctcttctcttgtctctgtttttccacttttcttccctctttccacttgtgggaaagagcaaaagagcaatgaacaaaatagataaaaatatcggtattcttggagcttatattttcttggagagagagagagagagagagagacaataatcaattgaaatatgtggtacagtagaagctggtaagagctatgaggaaaataaagttgaggcaggagtggggtaattttaaataggatggtcatttaaagctcaggaagaaggtggcatttgaataaagatttgaagaaaacaggaatgcaaggcacatgtctacctttggaagagtactctacacagagggaaaggccagataaaccacacagaaatggggtgtagatggtatactcatggaacagccatatggtccaagtgtttggagcagagtgggcaagaaagagagtggtagaagtcagagagaaacctggtggtcagatcaggaaagattttgaaaatccattttcaatctgaatgaaattggagaacattagagacttttgagaagacgagtgatatgatctaactcaggttttagtgagattaaatagggaaagctcaaagcaaggaaaccatttaggggaccatatcaccaacccagctgagaaattatggtagcttgagccatgggtgcaatgatgagagttgtggtgtgggtagagttgaaaggaaaaccagtaaaatttcctgatgaattgttgtagtttgcaaaaggaaaagtcaaaaataacaccaaggtgtttgatctaatcaattagagggaaagaactggcattaattgaaatgggggagattgctgctggggtcagagttgtagagaaatataaagagcccagttttaggacatattaaggttgagatgtcattaaacattcaggaagagatgtggagttgtcagttttcagcatgtttaaagccacaagatggaacagcaggagttattttggatgaagaaataacaacagggctttggggcaattaagtatggataaattgacgaggtgaagaggaagcaagaaagaagactgagaatatatcacctatgagaaaagaagagtgtgggtatcctggactccaagtgaagaacgtgtttcaaggaggagagagcaatcaactgtgttaaatgttgttagcttaagtaagataaaactgagaactgataatggctttagcaacatggatgttatagcgaccttggtgatggtttgttttgtcaagtgtttggggataaaagcctcagatagattcaaggaatagtgggaggaaaaaatgtgggaaaatgtaatggtaaatgggggagaaagtatgatcacgagagtggggtttctgagatgagagaattaatagcatgtctgtgttagtaagagagatccagtaaataaatccctgcattgtggacggttaattcattctgacaggagaaaatggagaacacaggtgatgttgcaggaaggtgaacaggtgtggtggtgggtgcttagaggaggtcacttctgtcttctgctcttttcttagagattactagaaaagttaaagaatgagaaatgagatgtattattggggagaggaagtgtgaagtaatcctctaagagcatgggacagtgaaggcatgaaggaaatatagtgtgatcgcagaggagcattgagtgtgcacacttggcatcatattacagcacgtgtacttacctgtagtgttctttaaaacccgatgtttatacacagtcccacataaggatttgtaactaagttctgtatgcaggtatcaggcaataagtatattatgaataatttactagtttttattttcaattattttagtctaatactttaattaatatttaaatgtattttctatacatggaaaaatattcaacatgccagattacaaatgggctgtaacagaccagtgtatagatgtgcctacttaaaaacagtaatgtgtatgctgtaaagactataagtgtgcaaatgcaggaagttattaagaacccttctacttactgttaattgccgagttaaaataattttttaaaagacagtaatctgaatatcaagtgacttttgactttaaccgtgtaaataaaggaatcgcacttttgttagtaaatggccaataaaaagctcaaaattctgattgggcacttaattattttgtgttgctgaaatcagaatcactctatctcatgttttttgaataaatgaatttggtcctcttctctgataaataactggactcaaattttattgcatgatcatgtgtgttcatggaggacatcaatcttggattgaccagatttaccttgaatttataatatgttctccttttatattaaatgatcgtcatttgctaattcagaataggttacttcaaatagaataaggatgttacgcttgggaggctctctcgtctgatgcccaactccacacctctttgttgtcactctgaccttcgtaggaatgactgagggatgatgcagtggcaaacttagataagtgttacttatctcatttactattttatatattctcttacatccagactaaaaataattggatgttgctccaaaattctgttcttccagtttcttctaaaataaaattatatgtgtgtatgtctttgaataattaaatacacaagtctatttctttgctattaatatcaaaacagttttgtgcaaaactagtataagactaatgaaaagaaatatcttcttcagtgatagtttgtaagatcttttgattataaaaacaagttctgctctgccttcataaaaggaattttcactttccatttgccacatctatcttactgtatgtgcatgtgtgggggtggttagggggtgtttatggaaacatctatgaacagctttgttctcttttatattgctctgcaaaccacaagctataattatctccagccagattttattttcttcatttttattttgcttatattgattcctattgaggttaataaatagttgaaaacaataatagatgtgctaaaaagaggaaccagtgaattatgaaaccaatacataggttattgtgttctgataatataacatataatttaatcttagaattttatttctgttaaaatctatatttttcagcttatttaaaaataattcatgtgtttagaagatgcactgattactaaaatattcttcacatcagcatttcaacatttaaagcatttttacttttaagaaaaggcttgttggaattttatatgcatataaaatttcctgtagggctaggaaatctaaaaatctaaacattttttagacttgacatcgaaagcacaatccgtaaaaggctaaattgataaatgagactttatcaaaatgaaattttactttgtgaaagcttgcatgaagaggaagaaaagtcaggctacagactggtcaaaaaacagttgcaaaccacctatctgagaaaggactagtatatagaatatatgaagaatcctcaaaagttgacagttaaaaacacaattaaaatatgggtgttacgtactaaattgttttcccaaaatttatgttgaagccctaaccccaatgtgactatatttgaagatagggcctttaaggagatcattaaggtaaatgaggtggtaagggtggtgccctaattcaataggaccagtgtccttataagaaagagacaccagagaccccactctctgtgctgactcagaggaaagaccatgtaaggtcacaggatgaaggcagtcatctgcaagccaggaagagaggtctcacaagaaaccaatcctaccagcaccttgatctttgacttttagcctccagcactgtgagaaataaatgtgttttttaagccacctgacctgtgagattttgttatggcagcctgggcagactaacacaatgggcaaaagacgtggaaggaggttcaaccaaagaaggtatacagatggcaagaaagcacatgaaatgatacccagcatcatcaactgctaggcaaatgcatattacatcctcaatgaggcaccactttacacctctcaaaaggactaagatttaaaaaaaaaatagtgccaacacaaaatactggtcagtatattgagaaattggatcactcatacactgctggtaggaatgtcaaataacaaaaccacactagaaaaccgtttagtagtttctttttgttaattttctattttactttaagttctgggatacatgtgcagaatgtgcagatttgtcacataggtgtgtatgtgccacaggcgttggctgcacctatcaacccgtcatctaggttttaagccccgcatccattaggtatttgtcttaatgctgtccctccccttgccccccaccccccaacaggccccattgtgtgatgttcccctctctgtgtccatgtattctcattatttaactcccacttacaagtgataacatgtggtgtttggttttctgtttctgtgttagtgtgctgagactaatggtttccagattcatccacgtccctgcaaaggacattaactcattctttttcaaggctgcatagtattctgtggtgtagatgcgccacattttcttcacccagtctatcattgatgggcatttgggtgggttccaagtctttgccattgtaaatagtgctgcaataaacatacatgtgcaaatgatttataattctttgggtgtatgcccagtaatggcattgctgggtcaaatggtatttctggttctagatccttgaggaatcaccacactgtcttccacaatggtttgcaactctcatacaatccagtgattgtactcttgggcattttccccagggaactggcaacttacgttcacaaaatatttgtacacagatgttgacaaaagctttattggtaatagctgaaagctacgtaggtgtccttctgcaggtagatggttaaataaattttaatatatccataccatggaatactactcagcagtagaaagagatgaactattgatacagaaaacaatatgagtaaatcttcaaagagtaattctgggccagaagtggtggctcacgcctgtaatcccagcactttgggaggccaaggtgggtggatcacctgaggtcaggagttcgagaccagcctggccaacatggtgaaaccctgtctctactaaaaacacaaaaattagccaggcatagtggtgtgcacctgtaatcccagctactcaggaggctgaggcaggagaatcgcttcaacccgggaggtggaggttgcagtggccaatattgcaccattgctttccatcctgggtgagagcaagaatctgtcaaaaacaaaaatgagtaattctgattttttttaaaagtaagccagtctcaaaagactgcatattttatgcttttatttgagagcattcttgaaatgacaaaattatagaaatgaggaactaattagttgtgccaggaggttaaagaaggggtaaggagggaggaaagcggttttagctgtgcgcgggaaggatgaagaatactgtggcaatagaaatgttctgcctcttagcgtcagtgtcactatcctggttttgacatcctgctattgttttgtaaggtatgatcatgggggaaactagataaagggtgcatggaatctttctgtgttatttcttacacctgcgtaagaatctacaaacatttggaaataaacattttaattaaatccgtatttctggcttatttctttatgattattaagcattcagaaagactcatttgaatagtgaatgattccttgcttcggcatttctaaatttcattttattttgcttttaagaaaggtagtgttagcatgttatatgcattttgattttaaaagtacaatgtattaccttgaaaaacaatgtgttttttaaatactgttcctttataaacagctttattgatatcaaattcatatattgcacaattcagtaatataaagtgtgctattgaatggcttttagtatatctacattgtgtaacaatgaccacaccaattttagaacatggtcattaccctgagaagaaaccttacccctctgagccgctgctctccctcgatcgctccatctccctaaccctgggaaaccacaaatctactttgtctccataagcctgtttttttttaaaaaaggaattctataaatgtttagcaaaataaattatttttaaaagtacttatagtcctagcatagtactaagttaattttcctaaattgacttcatttttaactttctatatgaaattcaatacttagtacatcttcctcttttacgtgaatgactatatggatttattcttttatataatttcctttattctggtaagataaaaggtagggtttctagaaaattattattttatttatttattattttttgatgcagagtctcattctgtcatccaggctggaatgcagatgcataatctgggctgactgcaacctcagcctcccaggctcaagtgattctcctgcctcagcctcctaagtagtgggggttacaggcatctgccacaatgcctggctaatttttgcatttttagtagagacagggtttcaccatgttgttcagactggtctcgaactcctgacctcaagtgatctgcccacctcagcccccaaaagtgctgggattacaggcatgagccaccgtgcctggcctaaaaaattattctaaaatctctagtaccctatattgaattgaattgacaatgatgtagtttagagaattttatttttacttttttatgattgttatttaaatttttttctagatacataatacttatgcatatttatggggtacgtgtgatattttgttacatgcatagaatgtgcatgcatagaattacatgcatagaatgtgtaatgatccagtcaggggacttaggatatccatcaccttgagcatttatcatttctgggagttgggaacatttgagtcctttctcctagctattttgaaatacaaacgacaatgttcttaactgtagtcaccccagtctgctattgaacatgaagcttattccttctatctaactggaattttgtattcattgcccaatctctcttcctcttttccccctccgccatttcctgcctctggttactatcattctcctctccccctccatgagattagggaattttaaaccacctaatccatagaatgctgtcttcaaaagcctgcagctcctgctgctgcctgcctgctgagctctgtttcctccctctctttgcccttcctttctctgaggtggcccagattctggtgggtgtctcttagcacagggggtaaagggctgggataccacatgccattaacattatttgatcatggaaatattggcctttgctttctttataattgttttgaattagcagcaatttcttaacccaataaaacttccttacctcattttctaccttttgtgaacgtataaaataaggtctcctaactaaatgaaatagacattattatgtatatgagagtgctgaatatgcctaaagtaataaattggtttcattgctttaaagacattcatgtacagatagcagcaattcaaagaattgttcatctggttcaagcacttccttgaagccttctatatgatgctttattgagttagttatgatataatatgaaaaaaataaatgttatgtcataatattacctaatttaaacctttaagtaattatgaatgttcctctttctaatcagacaaaataagatttaataacattccataatgtgaagcttatttttatgttaatgtataacatttaaacaaaaaggcatctaattccttctgaaaacagatcagctaagaacttctaagaatgcaaatgtgttgttatccctgacttgatattttacattttcttgcatttattttgtcctagagatccaaaggtctagtacaggaatagctgtaaaagggacaaaaggaataggcttgatgtgactctgataatatatggtttcatttgactctgggaggaaaaacttcaaagtagattattagttgaataaattcagctctaaaattgtccacacacaagctgagaattgacttttgaatcagatccaccagaaaaacaaacaaaaatagaagcattattcggtctagaatttatacaaagtaaattaaaatttaagaaacacgtataagcaaagtcaagtttgtgatttttaactctgtatcttggtatctgttctctgctaacataacaaactgttgttttgaaattgctgttttccaacatcagaggatcaacacatctttcttccaggaaggtaatttagatagaattttatccatgtaggtaatgtgtgtagaggcagttgcttaaaactaaagatgtatattcgtatttgatgtgcagagaacttgctagtggcagcagacaatacagagtttgtttctctgattttactcctcatcaacctcctgtatccagtcggatttcactcctgtcagctcatgctgttgcatttatatttgattttccatagtttttgctatatatggttcataatattttttcgaaagaaaagttgtagatatgaaaaaaggagtgagaaattaaagataagtggtatttgggcagcaattataattaactttatagtctacatttttttcagatctcttaatttatatcccaaccttttcaacattttctgcccattttgaacatttgtaaacattttgagaacacttttaatttgctgtcatctacttcattcttattggcaaagtaagagataattttgaataaaaagagcattttcatgagaatgtcagcttggacagagtaagctgcatgttggtttgtaattagacaagactatttagaatgccggtctcagtttagaaaatcacaaggcccattaaagaaaacagtttatgtaactctgtgaagtgtgtgtgttagaagtgttagaacaaaaaatactgtgagcttctcttgggtttttgtttaaagcaggtaagtgttttaattttgaagttataaaagattgcctatttatcaatgtttggcagatcgtataatatcactttggtggaggatatactattgaggctgaggatatttgttccgtataaaatataacatttagaccatttctgtaatgatcattcttactctctattggaaaaaatccaggatttcaattcctgtaaaatctcttatgatatactcatatcttgtatactacatagttgacagaaaaaaagagcagatttgtataaataacattttaaatagcaaaagtgctaaaaatagaacatgtaattgtcattcattttatttcatgaatttgttttctttctgaatttttttttctttttttttttcacaaaacaggatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctgtaagtctccttttccagagaagtgtatgagattctatcatttagtagtaaatcttttaactaatttttaaactactcatgtgtctactttatcatctgattcttttcattgcgcccctttgaaaaactcaataatattaacttatcctgtttgtaagaaaataatttgatacttaacatgtgataatttggggaaataactggtagtttcttgtaccaatttaaatgcagttttaatttcagttaattaaaactaaaacacaattttttagttaattacaaattacttaatcaaccactcattttgatatacttctaagctgctcttatcttaatatcaaatgtgtatagcatgccttaaaaattatgtaaactttgagttactgtaacagttatttttacgtacaatgccagttgctatttagtttccttgccttggataaatagctttactttttatcgataggaaaaattagctctgaggaggactatcttagaataccatttttttttcaaaaacatgaatgtatttaactgtctcatttcacatcagaagacctagctctgtgtcagtgtcatgagtttcaaacaatagcattgaaaccatctatgttcgttatctttctgttcagcgattgttacgctgtagtgtgttcctaagtatattggagactcggcacttcgccataggaactcactagaacaatctttatgtgtaatatttccagctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtaagttctctttttaagcaatcattttattgtatgatatgtgttcagaaatggcccaagataaaataataccaactatagaaacaaggataataacaacaagcaataataacaaatcaccatggattcacaaactgtgtccaaatgcttcatttcttctgcataaccagcctgtgaaatgggtgttatccgtattttacagatgagatagctgagcttccagggttgacttgcctacagaaattcatctcataaatgagattcagatttgtgtttaactaattcctatttgcctgcctgcctgcctgcctgccgccctcctttctttctctctctctctttcttttctttatttccttccttccttccttccttccttctttctttcttttctctctttctctctttccttctttctctctttctctcctttcttttcttttcttttcttttcttttcttttcttttcttttcttttcttttcttttcttttcttttcttttcttttcttttcttttctttcttgacagagtctcgctctgtcacccaggctggagtgcaatagtgcgatctcggctcactgcaacctccgcccccagggttctagcaattctcctacctcagcctcctgagtagctgggattacaggtacctaccactacgcctggctaatttgtttgtatttttagtagaaatggggttttgccatgttggccaggctggtcttgaactcctgacctcaggtgatccacctgcctcagcctcccagagtactaggaagacaggtgtgagccactgcacccagccttacctgctttcttaatattacaggttacatgattggtttcagcttatttatttattatcttattgttttattatgataccaggaatgtttatctctgttctcagaattgttgaggaagccttctttgatgaggaaatcatccagccgatgccaaacattgaacactcccccggcccccccgccccaccaaccatcacatcaaaaacaggccaatagcaaaaagaaaagaaaacaaaacagatacccagtgtgtatagaattcatgtttgacagtttcaccagttcctctgctattttccctcattttgcccatttttttttctgatattttctggtcaccttcttaatatttatatcagaatgttgttcctttatttcctaaatccattcatgtggcatttataggtttgatagtggaatccttctggatgtgtttgttttactttgaatctttgctaattcgtttgtagaagttatggaccatgaattatctcttacttgatcacttctcatatagtttaacataaatgaagacataaaacactataaagcagaataaatgataagttattagaaattgtacttcaaggccaggcatgatgtagtcctagcacttttggagaccaaggtaggaagattgcttggggccaggagtttgagaccagcctgggaaacacagcaagatccatctctacaaaaagtaaaaaattaaaaaaattaggcaggcatggtggcactcgcctgtaatcccagcgttcaagaagctgaggtgggaggatggttgaacccagtaattggaggctgtggtgaactatgatcacgctactgcactccatcctgggtgacagagggagcccctgtctcaacaacaacaacaaagaaattatttttcaagaattctcaagagttacacttttgaagaaatttgatcagatccccattacaccttttatttcttaagagtctgatcttattaaccctctctcactggaaaggatgaagcatatttttaacatatttgaggaagacatttttgggatttccaatatatttgtgtaattactgttttgataatttattatttcctttactcaaatatttaatgaatagcttctatgagtaaggcactataatagacaatctaatcatgatcttgtgaccacttgattgacttacttaagggtatgaaaataataaagaatgtatgagaagaaatatataacttttaataacacgctagaagctcagtcaggaaattgacaaagctatttcttgaattacaaaaaaatgagagatggccacaacaaaaggtatggcaatttaaaatctgtcagtagcttggaaatagccttactattcttggaaattgagaggctgaaatagtcctcaaatttttcagtgaaatatgctgcagtttgcctgtggatgacctttcattcttggtatgaatttcagcttcatgagatggagtgactgtgtgttgtgccgtgtaggaatcttggccttaacttgatttcagacagaaatgaagcactagtatgtcatcagaaaactgctttaaaacagacttgagtcttttaacatcgatcatgtgatacaattttaataaggatctgaaagattttgtcttcatggaggcaattggttaggcctttgacctcactgtatgtgttgaaatgtaaggatgggtgttattccaatgttgtataaaaaataactgttgattatatttaagtcaagtcactgaaaataaaaaagatgaggcaacataaagatttgtgaaaaaaggtgacatatactgttaataaaaatctgtttatgcattttcctccttcctgctcacagataactgtgagcaagctgacatgatttagtgtggtgatactaagggaagggctcataaaaaagaaaaaaaaaacacttgtagtcttgggtagagaaaattactggctgtcaaaacaccacatgaggggcttgggtttatcttcacctccaccagagtgaactagtctgttaggaaagggcttcaatcaagctgataaaacagtgcttgcaagacaaaatattcatttatcaatttacaacattactatcacacaaatcagaatttaagaaaaattgtaactggagatattttttttttccctgtaggcagactcagtgaaagacacattataattgaaaagtttatactgaattagagtatggtgagtgaaaaactaatttaaaaaatcagtagtaattagagctaatttaataaaacacctactaggaccaaagagttctgtgtcttcctgagagtatatttcagtggaagagaagagacaagcaattaaaaaaatctgtctatccatctatctagaaaaaaatctatatagagagagaaaaaatgtatataatatagagaaaaaatatatatataactatatatagtttttatagtttatagttacatagttatatatttcagtggaagagacaagagacagccaataaaaaagaactatttgtatatataaaaaattttatataactatatatagttttatagtttatatgtagtttataactacatataaactataaaattatatatagttatataatttatatataaacatattataaactaatatatataaactattatatacaatatatataaactatatattgtatataatatagcttatatataaacagtataagctatatagttaaactagttaaactagtttatagttaagctaaactatatagtttatatataactatatataattacatatataactatatataaactatgtaactatagtttttgtatatagtttatacatatataaaatatatagtttatttacatatagttcatatatggttatatatcatcatatgtatgtatccgtacatgtatgcatgcatgtgtgtgctcatatatatatacattttcaggtagtgataaataccataaagtaaaaagggtagcatggaatcaggcagtgatttgtgttggggacttctatgtcaagtagggtggtcagtgcagtcttctctggagtcctctctagcgacattagcagagtcctcctaatttgagcagaggccagatgaaacagaagagaaaaccctgtgaacatctgaaggaagagaattccaggccatggctcaaagtggtgggaataagctttagggattcaaggaacaaggaaaaaaacaatgtggctggaaagaatcagatttagggaaagtatgatgggaaacaagattgaggtatatatcggaccttgtagggccatggcgaggactatggattttactctaaggagtcagaggagtgacataattttcatttttcaagctctctcttactacccagaagggtatggatggaggaaatggagggcaggcaggctatcacagtggtccctctgagagatgatggtgctgcaggctaaagtagacatgttgaaatttagatgcacccaacttgctaatgaattggtcattgatgttagtgttttaccacttatctatgataatatgcttggggatgaaatgcttctttgtagttctttggttttctcacattatttgccagtttttgtttttgtttatttatttttgagacagagtctcactatgtcactcaaactggagtgcagaggtgtgctcactgctaactgcatccttgatctcctgggctcaagggattctcccacctcagcctcccaagtagctggcaccacaggtacatgccaccacgcttggctaatttttgtattttttatagaaacagggttttgatatgttgcctaggctggtctcaaactcctgggctcaagggctccacccccctcagcctcccaaagtgctgggattacaggtgtgaggcaccgcaccagcctagctttgaatttcacttggagttagcttttcttgttttctcccttcatcttaatttatagcagtgattaaagctgtttcctggctccacaatccaaattatataccacaagccataagcttgccaggctgcaaagagtctctggtccttcttcacaggccagagaaaatatttaatcttcttcctctcctttaatgagacacacctgctctgtaatcaccttctcagcagtaaattgggcttctttgtttatagattttgttccagcacatgtcatatgtagaaggacccttctcccattccctcgcatattaataccctgaaatatgttagggttaagtcttgctctattctcagagctggtgactccgtgggtgactggtaatctctacttcaatccaatataattgattttctggttacagttttaaagggtaatttaattccccttacttgcaagttcaagaatttaatttgtggttcatctgtccatcttaaagataattatagctaatcagcattttcggtgtgcatatcgactatcctttgtatctggatatggggcaaatgaatgaggtaaacgtgattctgaaaagtaagtacagttttcagcatgactttattcttctaataagaatgttttaaatacagagactgatggtaataataataatgtttaaacaagtttagagattaaacatacaacaggaggactatagttaataaaattgtatggtatttgagatttttgttaaatatagtagatttgtcacaaaaaagtaactatgtcagattatagatttgttcatttgctttattacagtaacctttttactacctctgtgtttcctgtaacatcatgttgtaaacctcaaatatacacaataaaatttatcttaaaaatgaataaattacatggaaacactgtttttataatataggacaagactgaaagactgttagtgttactcattctaagatagatgatgttatttttccagcattaagtagttttgttaaaaatgtaccttcttcttggtaaacaaatttggtagaaccctattgtggaatatttcaaataacaaagttattttaaaatataaatatgaaatgttagaaatttcaataacatggaaatatattaatttgagatactgtgcttaacactttacctgcaaataaaatgtgtggatatttggatatataatttggatttaaattatattctccatcttactaactgggtctatgttggtaatatttattagcattaagttttttgagattaacattttttaaaaatttgagatggatctctctctctgtcacccagactggagtacagtggtgtggtgcaatcttggctcactgcaacctacgcctcccaggctcaggtgatcctcctgcctcagcctccagagtagctgagactacaggcacatgccaccacaccaggctattttttgtattttttgtagagacgcagtctccctatgtgcccaggctggtcttgaactcctgggttcaaaagatccacccgccttggcctcccaaaatgctgggattacaggtgtgagccaccacgcctcacctgcagattagcattgttggtaatctctcagaagtggctgttgcaatgagaccacgtgaaagaatccagtgtatttactccattgcttcttcaccctctctgctaaaagccggtcataaagtgtgttcacatctcagagtgaaactgtgaggaaagattaatgctttactttctgagaaaaatcagtaaaaataaatagaaagcacttttaaaaaatgtgatccagttgggcagcagttatatatgacaattgaaataggaataaggaaatgataaatggagtttcagagatgcagctagcattagcctacatcacccgagcaatacagatcagaaggcttttgagcaatccctgacgtttcaaatattagaacaattaacttcaactaatctaaactgtaggatgtcatgcaaagtaaaggaagaataaaataatgcacaaaacccttgtatgactaagtgataagaattaacatcagcgtaatgtgatagattagacacaatgagcagcaacgcaatgaacatctcctcctctcctccagataattccagccatcacatcacattgctttttataataaaatggattcgccttctctttgtagcctgtctttctccatttttgttcttagttgtgacattgggtctttactatccttttcatgttctttcactttgtcctttgtgtgtgtgtgtgtgatttatgcctatcttaaagagtcctattcagaactgcctcttattgtcttctaaaaaatgttttaggacctaatgctaatcagtgtattgaacacgtgcccttgacttgctaacactgaggacttagcatccagtcactgctgttatcgtagactcacaaacattgtccagccacagaaatgatggagagaaaagaatcaatcatttttaaagctgaaatgtgacagtggtcattttctattttggtttgtaaactcagcattttcgtagaagcttcttaaattagccttgaattgatttttattcaaccagctccgcaatttttgtttccagtctcaattcttttactgacaggttttcaaacggggctaaatttatttcagtactttgtgactctcacctggaggagaagtaaggacccctgacatagtcagaagtaacttgctttgcatttgaattgcatggaatctataaatatttatcgactttttagagtgaacaatttctaaaaaccacatgcaaaggttgatgttgaactctaaacatattgaagctctgagactgtagtgatgaatctcagctgtgtgtgtgtgtgtgtgtgtgtgtgtgtaaacatgtgtgtatttctgtgatttcacctgggagtgaaatttctaggtcacggcatatgcataggctaagcacaggaaatagtgccatatctctattcaccattggatagcttcctttataaagtggctgttcagatctgttgcccgttttctatgagattgtcttattttttttaaaaaaaacttcataagaattctttatatattttaggtgagtccttttcatataaatttattataagatcttcgacctctctgtgagttgattgtgctttcatattgttaatagtgtctttgaatggacacaagttattaattataatatattccagatttttatttttttaatttcggttttttatatgctaaaatgtagttatgggaagagaatatcaagcagccttaggtttgaattcagtacaatagaggtcgcatttctctttaatataatcaaattgtttatcttaattacgcacttctcccatccttgaggcatctttttcatgattagcctaagacgccccgagtgtacttttctatatccagtaggtaaatcttagcgatcattgactgaggtcagaattcagatgggatgtctggggacaagagaatgtgattattcatcagtgaacaacagctgatttctctaaaataggccttagcatggtcaaactagagactcgctctggcttcagtgtgtgcgaagtctaaatagactcgttctttctgctgctactacgactggggcacgttttcacccctgactttggttcagggaaaagtgactgaattttcttcccatgacactgtcacttgcaacagctgcctctttgaaccacgatagttctttgaacacaaggaagaatagtcctgttcctcccctcctttccaggactttgcttaatgaagaacattgcgtgacaaacttagagctgggcctccagattccctaccttctatgttaaccaacagcactatttctgcaaggcagagttttccaccaggaagcgaacagggttgacggtccaatgcttgacatatagaagacaactttttcccttcaatctcctgacttggtcctgggcccagcctgcatgccctgtcactattctgccccaagttaatttgtggttgaggctttgcctgtttttctttgccatagtgtcaaagtcaggcagtgtccttgtactgtgccaggcaaatctctatagctttgaattttaaagagaaggttgaggatcttgatttctttatttctgtaaggcccctgggtgagtgggtgagttatgcagttgttcccaattaattctcaataatattcaagcacagcacatgaataatttgccattaaaaatttaaagtgtaatctcaaaggtctttctgccacaaaaatagtggaaaattggcataggaaagaaccagcttctactccatgacaataacgtctgtcgcttatagtaatttcctgagaataataaacatgaggaaagggtttggtgctgggtctctactcagcacccagagaaattattcagatgcaggccctcaataccattgcataagtggacaggttcagttaaactcaataaacacggaaaggttgggcatttgtttcacaggatactcagtgtttgtgaagtcccgaaattcattatatctgatataacatggcaggtaaattgatagaaaattaattggaagacagttccaaacgtaatagctcagtggaaacatccagaatcaattaaccaaactgcaactcattttaattggacacactctaaccctgaaaaggcactggaatctttaattaagctttcaagcccagtcctatttacattagccacgtttttcaaatagttacatctgaaaataaagttactgacttgaaacctaacagtaaaggaaaaattctaaatacatgtatgacacaacggtttgtgtctaattagacattatgttttctggtcatttagagtgtggcttaaaactatttggttaggtaaataacgaaagtacagaattaagatgtcatgtttttaaagttgtgtactgattttcttctcactcttacaaatattatctaagcatatatttcacatgtatatacatttattttcttctgctactcaccccacactctgaccttcttctttactgtgtatttatttttattatcttgtagtaatcttgtgtttccccatctaaatttattactagagctttttgtcagcaagattgatttcatatagtttcataccttcagtgcccagaaagagctgctaaataaagcttggagagctgaagtgttgttcaatccaaagatgagctgatgcatacaagaaaacggataagtcttcttttaccagatagtggtgtgaagtgcaaagaaacttccttggaatggaaggctatctgtgggtctgaatcctgcctctgcctctaacgaaatgtgtttattctagtatttcctcagatggacctgtggaccaatctttgaaattctctatgcccctagtttcccatcatccaaaacaaactaaacaaacacaaaaaaatcagaacagctggaaatggactttagtcagttgttggaccccaagttatttagttacgttgttactggcagaatgagataagcctgtgagttagggagactgtgcatgtttcagagcagcaaatgtataacaatgtgatttaatgttactgtatactgtagactgtataccatgatttaatgtgggataatacaaagtaaattaaatacaccaagagcacacctttaattcagagttcacagaatgtggcccccctgcaaaaagttcctgtgccaaagtgaaaaccaagatgtgagctggaccttacccagggaagaaatatccaacaaggacgccaaaagaatcctggccaaagactttgagccctgggagctcactgagttgagtcaacagagtggaagaatagggaggtgtgaagataaagaagtagcagctctggtaaggaagaaaaagaaaaatcctgaggataagggcagaagagagacttcaagaacggcaggtcctcaaaaaactacaaatagaactacaatgtgatccagcaatctcaataatgggcatttatccaaagaaaagaaaatcagtgtattgaaaagacagctgcacccctaagtttattgcaacactattgacaatagccaagatgtggaatcaacccagttgtccaataacaaatgaatcgataaaaaaaaagtggtgtatatatgtaatggaatacaattcaggcataaaaaagaataaaatcctgtcactcacagcaacatggatggaactgaagggcattatgtttagtgaaataaaccaggaacagaaagttaaacacagcatggtatcactcatataaggaagctaaggaaagggtgatctcataagtaaaaagtagaacagaggatactagaagatggggagggtacagggaaggggcacagagatttgttaaaggatatactattacagctagacaggaggaaaaagttctagtgttgtatgccactgtagaatgactatagtttacaataatatgtagtttcaaataactaggaagatattgaatgttcccaacactaaaaaatgataaatgtttgaggtgatggtgatgctaactactctgatctgatcactaatatcatgtatatcacaacattatgtaccccataaatatgaacaattattatgtgtctattaatttttacaacagaacaacaaaaaggaataaacaactcaattgggcacccatattaaaaatcttaaaaaaaaaatggcagaagtaaatgtaaatgtaggaggaattaaacaagaagatttccaggcattccaaaactctgtgatgaaattaactccatgcctaccatgcccacttgtgacaatggcaatatgttgacactctctagatttataaatagatttataaatagaacagccaacacccttaagaccttggcatccttcactgaggagaaaccaagtatgtaaatggaaacattttgaatagacatttaaatacagcaatttggatatagttatagctatgaatctgaattctgaatagtgttagtgtccgtaagtccagaattctcaggaattcttagaggttccttttcatagtctttcattatttgcaaagagataattagtttattagaaatgttcattaaattcgggcctcattctcagtctcagagacccaagcatctctgtggggcaaaaggggtccccctttacccttgaagcactatgcccatttctcccatttctatgtatattgtggtttaacaaatgaatggatggatttcatagttataacacagaaattatttgtctaccactgttctttgtgctggatatacagtagcaattgaagtagcccttgttgaatgaaggctaggttaaggagctacctaaatgatttggaagaaacgaagtgaacatgttttaggaaaagagaatttatatgtaaagagtacatacaaggtcctggtgatgagacaccatcatttatccaaagatggagcttctttttagaggcctcataaccatctaattgcctctcaatagaattgccaggttatttaggttagggtactcttttcccgcttcaagttctgagcattaacttaagagtattcctggacacaaatttatgtatgaatctacccagggcttacacttctatcagggtagtgcttatacaatgatggtctagtgatcatctgaattagaatctcctgcaagctttgttaactgttgagattcacaaccctatttttggaccacagaaccagtatttcttggagcaagctaccgagtctatttattagaagctctccgtgtgattatgtgttacccatatttcttaaagtttgagaaactctaccttagaataatagggtctgattccaacccaacattgtagacctcttcaaggatgacttgataggtacatatggttatgtattcaataaacgttaccgttacatcacttatttctgtatcgatccccttttgcaattttgttaagaatctttccaagcataaaacactgaacactagactaatctttagaaaaacaatcactgggaaatatgtcagccaaaaacaaataatctgacattcaattaccatcttttcaatgaatggataacaaccaaaggaccatatcaatgcaccatcagaagatctcaaggactccttcataattctcacaaagttaaaactgtaccagaatcaagatcaggtttaaatatgaaggacaaaccacacttacccagcaatatatacttattcaaattcccagaaagtagtttctacattaaaataacgatacatgtcactgttattttcaatgagagtagtgtatgacctctattttattcctcaatttaaagatcaataaatattttttagaaaaaaaatgtaacatattcaacttttaaaaaaattgaattaaagttgtatctttcttggagtctatatttgaccatgaattgtgtttccaaaattatatttgctcatccattttttttgccgttctctgtaaggcctcagttttgtttggtctttaaaccctgaataaaacacctaggaacatgtttccatttgcagtatttcccttttaggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatggtaagtgtggcatggaagactgtaagaggaaaatttattcaatgtggattaaatgtctggcagttcttttctatgcagctatttgaaacaaaaaaaattcaatttctgaattgctttggcaaagtatctgttgaatgtaaagaatgagtacaagatcctggtgatgagacagcatcatatattcaaagatggagcgcatcatatttcattacttaaatatttgactcatttatgaaaaactagtgtttgttgatggtaaatccattaatagtcacctttatgtattataaagtgttagttgctcaatctgcttttttctacctagtgttgatgctcttaaataatatggctgtcagcaacctgccccatggggcaattctttattttaaaatcatttaaagcattacttttttttttatttgagactgagtcttactctgtcactctgtcacccaggctggagtgcagtggcgcaatctcggctcactgcaacctccacctcccaggttcaagcgattctcctgcctccgcctcccgagtagctgggcttacaggagcccaccactatgcccagctaattgttgtatttttagtagagatagtgtttcaccatgttgcccaggctggtctcaagttcccgacctcaagtaatccacccacctgagcctcccaaagtgctgggattacagacgtgagtccccatgcccggccctgttactattgtatttgttgaagatattcaacaatgcaaggatatttaagatgcattgttttttatttgagtttttcagacatagtttttccagaaatataaacaatataccattaaatatcgatgcattacaaaaatagacacatttatacattaatcatacattttattgtatgatatgttgaatatctgctggtgaaataaaatagtagaatacttttcagcttctctcattatctgatatgcctcatggaagaagaaaagaacagttgtaggattaagtgttctggacagacttccatgaatatacaaacatttattactctttcatagttcctcatagaagactgacatccaatttaaattcatttactttatttaaagtgtctcttggctattgaaccttttcctgaaggaggctaacaaaacttggctccagattaaaacaactcctgacttacaaagaaagcatgggatgagttaataaaaagatggccaaatgctcttttcaagtcatctgcttttctcaggaataatctataatttacaaatcaacttgtgatcataatcatatactgctggtaccattctaggacacttttcatgtttaaagtgatcattaagaccacttcattaaaataacatgtctttgttttctggatataaataatttccagttcatcttgctaagtgcaaccgtaaatgttactctgtatgcacatattatattgaatataaaatgcgtgttatagataataaaataatgaaacaattaaaaactctaagatgtcaagggagcctaaacattactgtatgatccagtaagtatcatctacaacttgtattcaataaccagtcctttttcagtaatggagagaagcagattcagggatttaaaactagttatttcttctgccatcttcttcattttcatacatatgtatttggtgtgtgtgtgtgagagagagagagaggaagacagagagaatttgggatattaatctcataccaggaaaatactacacttttgtaaaatgatttaaaagaggttggttagttctgtttgttgatcctgtttccctgtatcatgttaatactagacttagctttctttttatagtacacaataactatgagaaaatgtttagacataaaggaaaatttctgcctcttgatcctgggaaagaagagagtctctcaaacatccttccttcctaactattttgtagataggaggccctagacttcctttaagatacacttcatttaagattgtactatctgcaatataacagatgggagttaaaatttaaataaaaaagtagatgatcaaggagatagaagacaagcctggtttgtgtttgaactcagataagaaagcatttaactttcaactgtaaaattatactagtgcattaattatatgtcattttaacagaaagccatttcaaagatcattttgaaagctctattaacttactttattatttgattctattttggggttggttcttctatctatgcaattcattaaagaaactaaaatataattattgtaactaaaacaaaatccttgtacttaaaatttttaacaaaaatatatatatatattatttcagagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggtgagttctttttagatgagagagagaaaattaaattagaacactagctctgtaataatatggatcattctcgtgttctggcttctcaagctacaaacagaaaaatggagtgtgcctgttttttgtagtcatatttttagtactatcctataagtataatctaaaaggattatttaaaatgattaagatgcccttatctctttatgattttgataattttacatattcaatgtataattttatttatataaaacatttattatattattgttagaagctccttgactattccatatggctatcaatatttgtttcatagttcattttgaaataaggtgtcttgttgtatgtaactatttcctgcaaatcaaagtaaagaaacattaagggagtgttaataaaccagcattttgagtaagaatatgtccacaagatgaccttttagttgtacttttagttaaaaaaatcatcatgggaaaaaaatgttatatccatgcagtgttaagggaatgtagattaggaaatgtgtttcctacagaaaaccatttactgctatttttctctttcccacatctagattaaaggtaaaaattttggaaataacttctctggataagaaaagcaaacatacaaacatgtgactatatcatttcaactgattcaaatatatcccaagggtactgtactgaacaccaaaataaaaataagattgttcgataagtgtatttattcttactgtgcattttgagcttgaagcttatttatatattagggcattttctttgtcaaattgaaagatatcctgtgaaataaattaactgacatctctgcaggcaattaaatgagtagtactaattgtgatggtaaatttggcttaaaatcattcatcttaccattatttcatttcaaagtctatgaccatgactacttggacatatttcttctctttagtaaaactacatttgtgtttaataatttcattaattgttgtatttccagagtgtgagatatattttttaaatataggaacagaatattattgcaatattaagcaataggttggcatttcagaaatacttaatattattttttaagtgagaggcaagtgcagagatttgcatatgcttaatctgagttgatgttaaattaaaagatttgcaggaaagagagtgcttgtgtgcaacatacttggtcatgattttgcaaatacattattgcaatttcacttggaaactgactcttggggattataaaaaggtatcttccaatttttccctcgaaatgaataaatagcaacaaaaaatcactctgatttttaagtaagccgctctcaaagtacgatttttactaaaagaatcacaatttttccccactctaggaagtttgcagatcaggtacaagttaaataaatatcaagagcctgatgttgttaactttgattttaaaaacatggctgatggacaacttcaccacataatgattaacagagaagaaggagtggtctttatagaggtaatgtagtaaattcagcagaagcaatcattttaatgactctccagcatgaaggatctcaagcagaaatttgataatgaacacaataagcagagacactttcattggtcttcttctgcagataatagacctcaaatgtagtcaggattcttttaagcaataagattttgttcattatattattaacatcggatactttaaatgccaatcttttctaacttgtttctgctcagaaggaaaatgatgtcatagtgtgctactggtaggaccattgctatgctaatgaaaccggtttactttagataaatgcagtaataaatctatcagaaaataatgattgtaatatcagaatttttgttaatgatatgagtcacagcaaagaaaatggaattattcatggagccagtttttgaagaaaagcactaataattttttggttctctgcctagaagaaaatttcttagctgcctacctcaaataaaaataccaagtaaaagtgttaaggtgaaaaataaccttttgtatctttttgttggcttcatcaattttggattccttatccagtggagaaaaataaaatgatacaaggggatagaaggtagggtgcactggcatctgagggtagtatagaaataatactaatattgtattatatattaataattatataataacacttagaaaaacctttctaagtggctaagcttttaaattttgtttttttctaaatgtttggggccatgctaacaactgcttaatgtatctttttctcttgtcctctgttgcttcctgtcttctcaacaaaacgtcatccatttggatgtttttatcttgtgtaataattttgtagattgacgataatagaaggagacaagttcacctgtcatcaggcacagaattcagtgcagtcaaatctctggtattgggcaggattttaggtaagtgaaagaaacaacctttcccctaaccatgctaatcatgatacataagcatggatcagaaaagtcatattacacacacccacttcgtcatggcaaaggaaatcccttgcctattttgattatgaagtgagtgataatcaagacagaggcatatgcaggcatgagtaggggcgtcctgtgtgatgagcaagcatcttcctttgatggtaaggtcactctggtctcagtcctgtctcaataaagtataatgaaatatggtattattctcacatttcaaaaatattaaataattgaaaataaaaaataacaaagtatgtattaattaggtgccaaatatacaaactttcctctaatgataaaactaagattagatttaaaaaatggaagaagaatgcaattactttttcttctagttagttaatatgtttcaggttatgacttggattctatttgctttgttgcaatgttgcccttggcagccacgcttgctcagatgcaatctaaatgccttataatgcttatttatttccatcaattacctttaattacagcactggagtagaaatgcactgttgccattttaacatcagaatatgtttgcatttttttacacttgccaacaaggattaaattgaaaagtaaattttaatagatatttattttttagttatacattaatcattaagagtattggaatttcaccttatttgaggagaggggggctcttgtagcctaatttttattcctactctggtatttgacactaatctgaaatattttgtccaagatagtaaatggaattttattttttgacctttgcagttatttgtacctcaattaatcattccttatgttgcctgtagctaatctcagaaccttgagaatgtttgattaaacccataggtgaatgatcaaaatattggcccctgaggttaatagttcagcaaataaatatttacaggctttcaagtgctatgatgagcaccaagattatgtgttcttattctccaaacaaacaggggaaataccatgaattgcaatgttcttccattatctatagtggacagaaaaaaatatgtgcaaagtacttcttagatgtttggaagcttaactgaaaaattccaagggagtctcacagtgttattatataaatccagctatttaagactgacatgtgtatcatttgctctaagaatatgtatatagccaataacatatttagcatgaaatgacgattctactttattccgttgattcaagtcttgtcctctgatgtataattaacagataagaccgtgtgcactcttaagtctgtgcacatgggtattagctttagacaaaacttcagatgcatagaaaaacatggctaggctctccctttgttaaaaacaaaagagaatatattcagttatttcatatttagtattgggaaatatttatagctatttcaggccactgtggaggtaagaacattagtgtctaggagactattcagctctgggtatgtaactatctagctctgcctatttagctttggatatgtgactaaggtatttctgaacattattttttaataacattagagggtcttattccatgtatagctatggcatagcgtaggaagccaaagagaattgtaaaagtctaaacaaacaagcagcaacaaaaacaaagcctcaactgttttaactgtgggacccatctacttccctacagatggctctcagctttgggggaggtaagcgtgcaggtggctgggaaagggatgagagccccagagagacccaggatgaggcaaagatgtagggatcatagggtggagccccaacctctgcaatgaggcaatctgtctaaaaacctctttgctgaacatcaggctcacagaagactcagctccttattctgtcctcacttaagcctacctgccacataactattgttatttacagaattaaaaatatgtgcaactgtgatttggaagagtcctcgtcccccaaactctacactagtacagtagataccattaatgagtggaattataagctgatactatgtcaagatgtcaagaagaaattttaagtaggttttctgtgcaagatattataccactgtgagtagaaatatattcaacatattataaaacaattgggaagctgattttcatcctataaggaggattgtattaaccaaacagtagaataacattcactatataagtcctcatttccctttttgtaaatgaataagggagattcctatagaattaaagacgttaaggtttttactcaagagttgcatattatccaaatatgcatatcatatatgctgaaaagtgaaagtccaaactgagcaatgaactttatggtctcagtcaactgactctcctaaaagtataagtgataatttatttggcatatgtctaaggtatggatcttgattagggactaatcatttgtaattcaaaggaaacccataacttgtggtcaaattttgtgtggtatatgaatttatagcaacatgttacatagtatatccttatattttaatgcagtatatttatagtgaaatagatcaacaagagttattaatatttcaaagagaattgttctgtcttgaagtcacttactgtgttagtccaggtcctccaaacaacagctgtgaagacaggattaagcatatgaggattttattaagggaacaatcatgtaagagaaaatgtgaaggagctggctaaggcagacaggaccgttagatgtccatgacactctgtctacagggatggagaaagagagggaaaattagacagaagcacagaagtgtctcagaccaatgtgcagtctaagaaagatttagcaatgttcagggagccattgagttaaagtcagcctccagaggagtcccttgtttgccagggatgagcctgtcttggaatgcctgctgtgacctgccactggctgggggcagtccttgggaatcatggccttggtacaagcatgaggatggatttcagagcccagcagtggggacccttggtcaattaatctccctgtagttcgtggtctttgaggcacattctcacgtttccgcacttatcaaatatgttttgcatttttgtaagcccaggtgactccttgattcatatattaaatacataccttgtgatcacctaccatgtaaacagagaacgccactcaacaaggtagacgttacatctgcccttacagagcttatggcagtggggatttcgataatcgtgataacaaaatgtgcctttgtatcgacatgagtgtaatgtgccccaatattgctttagataaagtagtcccaaattaccctccaaattaaaatatattaaaattcttctgtttttataatgtctggatatttcttctaagggagtagcatataaacattgccttttttttttttggagttgtaatttgcctacaattacaacaaacgacttaagtatataactgtcccatgctttttcaggtggaaaaagagatataaaggaaatatctcccctctcttgaatttttccagtactcatttcttaaatgtagaaaacattctaggggtaattttgaattgctgaccctgttaaaaaatattactagcagatattgagaaaggtgggtgaattttaagaaacagtatcaaactgtactctgatgacatggtaaccatttctaactacctgttacaattaaaatatagaagtacttaataactttggcaataataatatattgaaagtttagagctatagtgggaagataaaggttttagttaaacagctgagttcagatcctctcataatcagcagactacattgcatttgctttttatatttaattttactataaaattaagctcttgagttctattcctggacacttttatatgttagattagttttatgatttatttaggtaaaaactgagagattgttttcactctttctcagcatatagcttttctatattagatacggtggtccataataatcatttctcttttttggggctgcagagccaagatgtactttcaaattactgcagtggagatttaggccagatgtaaataaagtgtgtaggcagcaaggaaaaggaagtctactcagtctcctctgatgagctataagagaaatctccaatgtatcagaaattctttatgtaaaacttgcttcagtgctcagaggtgagacaaaaggtgacctaggtaaattaagggaactgtgattttataaatatatcatgaaataattttcaaaataatggattggttattttaaaagcatgttttaaaaggaaagtgcaagttagagcaagaaaagtaaaatcaaaatctatcttacaatcttttaaaaaaatgtatcaggtccattgatttttaatttttttaataattaaaatgtcatagactgtcttcagtgcgtagcatgactttcttcttgtgaaggctttagtcgattccagagggttagccatactgtattgagctggccatacctagaagcttattctcgtaatcataatacatgaaagtagatcagaggtgtcatgttccaaatccaaaaagtattcatgacgttgaaagaatcacattacctgattttaatagtagaacaaatgataacttggaagttgagattttgtcataagcacgtatagtcataggcaggtggtccccgtggagtgggcaagtgtattcctctgacaatgatgtcacctgcaaagctttttatttggcagccaagcataataacacatagagctctacttacactaaaaaaaaataccaaatgataaaagcaagagtcaccaatccaaaattatatattttcaggtgcctcaaatctacaaaccttcatacaatgataaaacaagaatttcaaaaataaaaaggagaaagggattgtttatttctttaattactaacatgccttaaaaggtacccagccaggcacagtggctcacgcctgtaatcctagcactttgggaggccgaggtggatggatcacgacgtcaggagattgagatcatcctggctaacacggtgaagccccatctctactaaaatacaaaaattagccgggcgtggtagcatgcgcccgtagtctcagctactcaggaggctgaggcagtggagtcgcttgaacccgagaggcggaggttgcggtgagctgagattgtgccattgcactccagcctggtgacacagcaagactccatttcaaaaaaaaaaagaaaaactaaaaagtgcccacaccaggaataagtaaaaaataaagccccgattaggcactgatgataatatgtgagtgaatttattaaagaatagtcatccatgtaaggaagagaaaggaagggattggctggggtgtgaacatggaacctgtgaagtggagagagggcactatgcagccacaacaaggagatactgcaagatcagtatgatcgggggttcctaaaccacgggccacggacaagtactgtgctgcacagcagtaggtgagtggcaggcaggcaagcaagcgaagcttcatctgtatttacagctgctccccattgcttgcattaccacctgagctctgcctcctgtcagatcagccacagcattagattctcacaggagtgagaaccctattgtgaactgcacatgtgaaggatctgggttgtgtgctcattatgagaatctaatgcctgatgacctgtcaccaactcccatcacccccagatgggaccgtctagttacaggaagagaagctcagggctctcactgattctacattatggccaattgtataattatttcattatgtattacaatgcataatagaaagtgcacaataaatgtaatgcacttgaatcatcccaaagccatccccccactcccatctgtagaaaacctgtcttccttgaaactggtccctggtgccaaaaaggttggggaccactgaggctgatgatattccaaaggactaatcagaatcagagcagagaaatttgaatgctaccagcattgtctgttaaatgtaatggggtgttagagatgattctcatgccatcatagtacaatttaatattattacataaaaattatcccccttgcttgatatctgcttctaatgcttgctaatggtgattggagtgaaaaattgtcactatagttcatcctcatttgtagaaattagtactagaggatggggaagaaagcatttcatttctttctggtcttccctgtgaaaaggcagatagtctgatgtcatgtctaagtactttgttcacaatgtacataaattccaatgccgaagtgactgacttgtcaatcagcttccttaagataaatatttactagaaaattatagaaaaagaaatctctctaggatgtaattaattaaaggaaatatacagatacaaagttgttttgccaattcattaagctattactggatcacaattccaccacatggggaaaaagagagatcgcaattaagatatttacataatcttattaaagttgtataaaacctctcatgggaaaatatgcccacattttgaataatgatgtaatttaacacacagtaaaaatgactgaaaaaaatcactactcaaaagttgaatgaaatttataattactatttgttattttttgtgtcaaatacataatggcacaagaacactaacaataatgtgttgataattcatggtggtagcagtaaaaaccaggttgcatcaaattaacttggttgacattcatccatcattaatagggtgtgctacatttgctttttatctccaaaactcattgtaaatttcagttctgagttctgttcatttttatgttataggagttttctataagcctggagattattttcactcgttccgagtagtagctttggtgtatttagaggcgatgacccatagggatcatttatctctttggagtccgcagagctcaggaagcacacctcaggtttctgcagtggcaatttaggccagatgtaaataaaatgtgtggtctgagagaagaggatgtctactgaatctccccagaagagctttagagacaatcttccatctcaaggatattttaagtaaaaccagcttcgaagccaaaggggtaaaaaagaaagtttaattagcttacctaagtacactgtgatttttgcaaacatcttgtaaaatgacacttaaaatgagacaggttatgctgaaagcaaaagggaaatacctgccactgtaagatagctgcctgtacataacctgtgcattaatcaggctttcaagtttataactcagtacagtaggtttggttggcaaacaaataccttttatgataaactgcctctttatccacatagtatttttttgtctgctttgccattttactttcccactaaccctttttgtgttgagtccctggtggaattgcataaaatagtaagagtgcaccattcagttccaaccctggctctcttgattcactgcaccttttttttttttttttttttttttggcaagccttcttaatggattccagacattgagatctttctttttaaatgactccttctcataggtaggacatataaagtacttcgttttctgagtttttatttttttgcttacgcctcaggaaatttcataaagcactccttgtaattgttcttacatgtattgtcgtatctttcaaaaaaacagtcgtttctctgtaatagaagggcacttcaccaaattctaatttctcggtactccatttttcttgcaggccttttgttaaaaggtttcttctttcgacaagcagaagtcactccctttgttggaaattgcacttgagggttactttttaacaggcacaaacacccagaaatccgagtcagttaaggattattatcacaagaaacacctaaaacatgactgttttatccagatttctgtgaagcaggagacatttgtcatcagtctctccctccacctaccctgttctaactcattacactgtgttggcttttggggagtcagataacaagaaaaacttatatttttgcccattggcttattagcacaattgtcaaagcagatatctgatgctatgtatttctaaggccagctttgcttatgagcaacttaatatagctgctaattttgtttggactcaattctgggaggacggcggctgagttgcttgtagtttccctccacttccgattcgaattctaccccaccgacgcttctgaaatgagttgttggtccaggcggacaggcagggggatcctggagggaaccagtgaggaggctcttgtggggcttcctaccttctgggttggaaggaagtccgggggccagcctagaagaatctcagggggggatttgaattgtttggatcttgtggattgcttgccttacagaggtccctgggccccatggggaaagataagcattagaaagtattaatgtgcccattttctctgtttctcaaggtgctaagatgacctgaaatttgggccatgccctctctgtcccaaagctgagtgaggagaggtttcttcttagggctgtggcctgcagctctgctcctggtccacccagatcaccacactgtctacttgccctgggtgtgagccacctaaggtgatcagtggctgggcaccggcaagcagattaaaaagtaaactaacaaaccaactccagacttaaaaccattcaacatcaataaaaggagaaaaaaactaaaccaaaatgattttctatcaaaataaagctattcaaggagacagacaacaacatgaatgaggcttagtaagagtactttaaggagattctcataaagcaaaaaaaagaccttgaggatctaaaaaatatgattttttttcccaaacaaaaaatataacaggaaagaatgatcttttttgctacttgaatttgcatctggaagatcaagtgaatgaagtatttgacccacagagatgtaagtcctaaataatagaaatcaggatggaaataaaatgaatttagagaatatatagaggagacctaatgtgaaaaattggcattctaagagaataaaaaggaagaaggtgaaacagcagtagtgtgcagattgtatgaaaaattccaagctaaataaaaactttgtgtctgcagattgaaagggcttatcatgttctatgcagaatactgagataagatacacacttagggacaatctgatgaaaattcaaaaatcacagggtatcttacaaattttgaaaaagaagtaatacagccagaagatgctggaataatatccatagtgtactaagggaatagggctgcaaaaaatgtcacccttaaaataaacacataaatataacctaatccatcagggtaattttctgttccagttacaaccatcatattgtctaatttgttttcttcatagtattatcagtctttaaaattctcatttagtttttgtttctatgtttattgtctctctccctttccctgctaacatgtaaaatactcaaacatccgggcatttgttttctgtttctttagctcataaaaggataaatattaactgaccatgtgtccattttgagttttagcggtcattggtttttgtacaataattttgaaataggtgaaatgttttcagtttgtaagtgtgaggcttttaaaatatatctcatatcagattattaccagagaagtaaatcttgtctggtggggtggggctgaaaagggaagattttttaaaggcctatggaaattttattcaacattttaaccttgtagaagaaatgtgaaaagcactctcccaattatgctcctatgagagtttttctttttaatttttattttctttttaatttctcattaaagtaaaaagaaaaaaaaaactccaaatcaagaatgcggtctttttcatgtatatatgtttaaatctacatatattcaaatgaatgattgccaaggtggactaaatgatttctttggttccatacacattgatgaactgcctcctatataatgacgttatgctggatgttggcagtcatctttatgtttgaggagctcacagtatcgtatgtaagcagcagagtgatgctccctcagtgctatctttgggtaatgaagaagagcaaggtgggtcagaacatggctcaataccagatccctcacaacaggaaagtgatataatcgctctgattttccattttctttttatagaggatgatattcaaaatactaaacattgtatcaggatttttattattacgtagaaaacatgaatgaaaatagagcccctcaaaattctttaaaaacttagatataactggccaggtgcggtggttcatgcctataatctcagcaacgttgggaggccaaagtgggtggatcacttgaggccaggagttcaagaccagcctggccaacatggcaaaactccatctctactaaaaatacaaaaaatttagccaggcgtcaatcccagctactcgggaggctgaggcaggagaattacttgagcctgggaggcaaaagctgcagggagctgagatcgtgccacatcactccagcctgggtgacagagtgagagtctgttaaaaaaaaaatatatatatatatatattagagctcagatgcccagggttagttaaagtctagctctcaagcaaagatgatttaaaaaataaataaataaaagccactacagagactgaaagcagagtaaaggaaagagtatctcaaccagagagtggtttataaacaaaagaagctcataatttggaatacagtaggccagaggtccagtaatgccaacaactgtgtaacttcaggtgaatagttaaaattctgaacttaactgttccatttgtgtgacttggataatatactccagtgtctactgtaaagttttatcagtagcatgcaaatcttttagaacactggctagcacataatatacactcatatatacttaatatccattgcattgtttttacttttaatttaacttaacttcctgggaacgtagattcaagttgccctgaatatacactcccatattattatattttcaaaagaaagactaaagtgcacattttgtctttccctacctatatacagtgcaggggagaatagttgtattagtccgttctcacactgctataaagagcttcctgagactgggtaatttataaaggaaagaggtgtaatcaacacagttccacatggctgggaggcctcaggaaacttataatcggaaagcaacttataggcagaaagcaaattataggcagaaagcaaaggggaaggagaagcaaaaaccttcttcacatggcagcaggagagagaagaaggatgaacttccaaacacttataaaactatcacatctcatgagaactcactcactatcacaataacagcatgggggaaactgcctccacgatccaatcacctcccacagggtccctcccttgacacgtggggattatggggattacaattcaagatgagatttggatggggacacagagccaaaccatatcaatagttgtgctatttttttttatcacactgggtggatggatgcattgtattttgatgacatctgagccttcaaagcctatgataaatttctcttgtttagatttcatgcttgctaagcaaggagtatgtataatatattcctaagttaaaattataattaatatcccagcattaaaaccaatctccgttccacaagagtctcatactaactaaattcttattaataggaggaagagattatctgtctttagagggcacagatatttctgtcccagtgacaagttgtcattgaaacaagaagaaaagacataggggtataaagggttttattgctgtacatgagtaattagggaaagaccctaataacttcgaggtatggcctccactgcatgatagtatcatcctcctgttatgtttgggtggggccataaaatatcagaaagctttcagccataacaaattgtcgggttgggcatctgataacagaagtccagaggctcaattttctctctagtttctgttactttcagggcataagtcttgaaacctgtactgaacttgttttcaaatccaggatgtacctcttgatattgactacaagccctattgtaaatacattgcaataatctatatttaaattaaaagtatcatgacaccctcatcacttcttaacctgacccattcttatgctttgtttctagggagcttaccatatcacttttaataatccatgcttaaaaacttgacttcattaacattggaaatcttaccaatagtagtggaaagaataatggatttttatctttttagtaaagataaaattaaaaaggaatttagtaactttattgctattgcattagctcagaatcctcaatttctgcatcatcgcctattttcacttttcactactaatatttcggtgtttctttgaatttctagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcaggtgacttagagttcttcctctactcagtcacagacgtagcttgtccatggaatttagaaaacttctcatgtggctttcaggctaccttctcaagatggcttcttaaagttggttttgtttgtttagcttttagttctccttcccatatcttttctaggtgctcaacttcttatttatgggggtcattgccattgacattgcttaaattgaaaataacagagatcccacattcgcctccataattctctgtggtttaaaacatttatgatgttttcaaaatttcttcttttacttgcctatatcaccttccccctttgttgtgctttaactgcagatcattctggaacaatagatgacagagagccccttgctaatgcaatcaaaagtgactctgcagtaattggaggtaataagaagcatgaatgagctcttctttggttgttcttattaataatgatgatgaatatttagcattgtagaaactgtgaagaatctgcacatactccaagtgccaggcactgaatcctgaggtcattggggtgatttactatttgtactggattgtctttagaatctttctgaattctctgcttccttggagattttcagtataaataattgacaatttcactgaagcatggcactcaaagattaattgctaacatgtgtaataatgaatattatcaagcttgaacatagccacaggtagtcactagagaattgtgaatatatttgagtaaatttcgtttttcttcacttcttggacatatcactgcttctggaaaggttcatgcaaaaagtaggaaaaacctgagattaacactagaagcatatattttgtattgcctcaaggcttaataaagatgctatttgcatagtaaactatttaaagatgcttctatcaactaaatattacactttcagttgtatttttatcaaatattagattaatgaactaaaagtgattagtagtaactttaaattgcagaattaacacaaaaacttttaaagtatgtctccctggaaatgtgacagcatattctctgatattttttttcaaaagcaactcaaaaaacaagctttttttcttcttgattaatgctcttaagaatgttattaatcagattattgaaatgttaacttgttcacctttctttacactctgaatatgatacggatatagaaagtaaacaattattctgttgcattgccagggagatacaattttaaagtttttgtgccagtaatatgattattcatatatgaaatatgaatatttcgtttgcaggtgacttagagttcttcctctattcagtcacaaacccagcttgtccatggaatttagaaaacttctcatgtggctttcaggctaccttctcaagatggcttcttaaagttggttttgtttgtttagcttttagttctctttcccatttctcttctaggtgctcaacttgttatttattcatatcatatatgaataatcgtattactggcacaaaaactttaaaattgtatctccctggcagggcaacaggataattgtttactttctatatccatatcatattcagagtgtaaagaaaggtgaaccacttaacatttcaatttgggcaatttatgtggctttatacctgattcatttggatgtattttttctattcatctagacatatattgctttcaagtagttaggattttatttggacagcaaataataccagtcaaatctttgtgtggatattaactcccccatgctatttcagttgcttttctgtttctcaagttaatgatgtacaaattaaagttataaaaaataggattcccatttaatcaccaaacatgcaaaacaaaaaacccaaaacaaacaaaaaaactctatttgaagaggagttaataattgtatgtctaaaagaaacacgttatacagtaaaaactcacttaaagctatagtatttacaatgtgtccaagagtttaagctagaattcctggtcaagcaagttgtctcagtcttataatattgctttttccagacattcaaccaggatagattcaggtaaatacagatacagagacagatagaaatatagagtggtatatagtcatcaagccaatgctagaacaaaatatttaatctctagactattgttgttttgctcaaacatcattggcaagatttacagagttaaacaagaagtgcattgataagtcatcctaaagttattctagaatagaaacaagttacagttcatctgtgaaattctcacttagctcaaattcacaggacagaaacaatatggaaggtttgtagttcaggggcttgccagggtccctgaaactagtgatgtctggttttggtcattgcagagactaaacttcagaagcagagcatctggtaatggccatgtaacctctgaaggccttgtctgggccacacacaatttatttgctaaatcataatgtatcgtcctccagtgtgttacacaatctggtagaactgtggtagaatcctttgttcattgtctagtcactcataaattgcacccactatgtaataataattaacccatccaaggattttccaaattggctaatccccctatgttctacatcttagatgatttttttttacttgcaaaatgaatggtataagatgggataatttatttaataatacatttaaaagtggtgacccagatgtggtagggggtttctggccaggctacccagatacagatagatttagccagagagaaagctatatatatacatcttcataaaagcagattcacacagtgctttaggtgcagcatcatagaggctggccacattttattcataataactaatttattttttatttttatatttttggtataacacgtgtgatcaaagtttttcttgagcacaacaaatcctgacatagcactttccccaaattaagtgctaaattacatacatggaacaaacaagttccagaggccatccctgattttgactgtctggatattctgtctcggccaatgtaacattcattttataattgtagttgtctgctgtctatatcatatttcagaatttttcacattgaaattgttcagaatctttctcttcaagccagaggcctataactagcctgtagaaatatttatagcaattcaactgtttattttttctaaaatgagaagcaaaatatgtaacaacaaatattctgattaaagttattcattaattaatatgactaataacaaaagcaatcatatttattaatgaattcttcagatttcatgtacagaatttggttaccacatttatattaatcagcaacgattttctacctgtctcaggtaaggctgacctagccaaaaattggcttggctattggacgtgctctaattggccagggtgaatcggcctagcaggttatatgcacaggaatctgttgtgattaataaaaaccttcaaatctttgacttcctcgcactccgttacagttgtatacatttgctttagaatggagtcttagttttaccatatgagatttgattcacattgctattttcatagtacctatttttgtcttaagaaaatgacattagtttgtaccttcactgatcttatcagaaaattctttaagtattaggcaactctcacactcttggcggcagaaaatagttttccaaattcaatttttcatttgaaaacttgaattttatctttcacaacatatgctgtgtaattgtttttcttgaagtgacacatttacttcattcattttagagaaaatgtccaccaaatacccaagtctgaacaaccatagtttgtctgttagtcattctttcaaataaaaatggtgttacatgaagcaaaaagcaactaattcagttcacaactcaaaggttcacgtaagtgcttttcctggagacaatgatcagacttcagagtgcaccagaagtactttatttctgtttcccattttaacacacaaaatgttagaaagtcttgcagtcaagggtcaagatttaattaaatgaagagtttttacagcttcattaaggagattcttaaataaatttggctttttattccttttcctacaattgtctggcagtgtaatgttttctacttcatgaattcaatgattattattattgttttgtgtccttgcgttaatttgtgctaagtaccaggaattttacctaactttgttttataccaaatttggttccgtattaaaatggaaatggaaatgtcaacagagtgaaaaagacatcttagaattatcatgaaatagttttgagcccctgtgccctctcaaagtgtcccagggaccactacacgtctacagatcacactttgaggactactgacctaatataatgccagcgttggtaaccattgacatagttaagaatcgcagtacttagaatttgtatttacaactagaagtgttaaaacaacattcctcatatagaaataatttaggcatatttgtatatgtgttattggtcagaatgatttatttacataacccatttctgctgttcagcagtataacaattgaataacaatttcattaaaatgtttacatatttaatcacaaaacagtttaatcattttatgatgttgctactactccataatttcaaaataattaaaactaatatgaagtggccacatggccacatggtcctagagacatatagttaataccttgtgttaaatataaatgcaccaagtaaatccgatataatatgcattcataataaatgtaggtgaacccacaaggctgatagaactcagaaataaactcaacatacaataatactgcttgagccagaaatacctgaagtttttatatttccaatttatatgtagtagatgcttaaagtggaaaatagtgttatgatgacttattaagcaatgaagtcagcacagtttctatttggacagaaattctgactttatatttcttttctctctctaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatg
